United States Patent 6,812,339 (POLYMORPHISMS IN KNOWN GENES ASSOCIATED WITH HUMAN DISEASE, METHODS OF DETECTION AND USES THEREOF) - sequence listing, part 7

SEQ ID NO: 11767 - DNA, 64638 bp, Human
  misc_feature (1)...(64638): n = A,T,C or G
acttagtatctttgttttcatttgttaaatgcaaggtcatcctttgaatgttgtcttcaactatgcttgaaatagcttgagacccagcagataattctgaccaggaggtatcagcagacagtgggcagcacagttagaggaaaaaaatgttgcagggccccactcccaataaaaacctacaataaaaaatttaaaaattttaataaagaggaaaatgacaaagaggttttccaaaggatgttcatattctctatttaaaaaccccactgggccgggtacggtggctcaggcctataatcctgagccctggagttcgagaccagctttggcaacatggtgaaaccttatctctaccaaaaatacaaaaattagccagtctcataacccgctcttaaataaatagattaaaatttaaaaataaataaataaataaataaataaataaataaccccactgatatgaacatttcttccattttggagtaaaggtgcctacaaggctaggcaatgtccatatttctttcctgaatgtttccaacggggctgcgcctagagcagatgtatcataaatactaattacttattataatgaccaagctacattgttagcatagaataattccacaggcttccctattggtttgtttgatcctaagcctattaatacctgcttctatgtcagaaaatctacattaggccaggcatggtggctcacacctgtaatcccagcactttgggaggccgaggcaggtggatcacctgaggtcaggagttcgagaccagcctggccaacatggcaaaaccccacctctcctaaaaatacaaaaatttagccgggcatggtggcaggtgcctgtaatcccagctactcaggaggctgaggcaggagaatcgtttgaacccaggaggcggaggatgaagtgagcctcaaaaaaaaaaaaagaaaaaaaatattattttgatacatgttttaaagctcaccttcggcattatgagataatccctcaagtgaggaaaaaggtccatttattaatctcaaagaaaacagttacagcagatgtcactggttaagagttcagttggtgaatagcatttcacaatttgtaccaacatctggggaaagacgctttgcatggaactgtaaaacaattgagcaccaaatctgcacaactgcgtttctagaaaatgcgatgggttttatagagatgaggtcttgctatgttttccaggctggtctcgaactcttggcctcaagcgatcctcccgcctcggtctccccaagcgccgggagtacaggcgtgagccaccgacggaaatggattttaagtgaaagtcctatcttcgtttgcaaatcaatttttccaggatcaaagttctagcaaccataaatcctatccttctagacatagggacccacataagggccacttgatgtgacacttgccccgacagcggtgccacctggcccctaggtggcaggtgcgtttttaactaaacccaagagtctgaagtcacattattctcttgccttgaaagcttaagagttggttcctaatcggtggcttaactcggtctctctccaggcaaggccacctgtttgctgatctttcacagggcgaggggaccggagcccttcaatgcagcgccctcttggcctgaagagggggcgactgggcgcccagaccgcgtctttctcactgagatcccagctcctggacgactgcctcttttcgggttcggctcattccgcaataagtggaggggtcccgcctgatcctaggggccggcgcccttttccttccctccctgcgcttgcgaacccctccgggcgtctccggagccgcgacccctgctggggaccccgggggcgggaggccgaggggcgcggcgagggccgtgacgcgaggcggggccggccaatgggagcgctccgcggcgcaggctgagccgccgggccataaaaaggaggcgcggccgggctttccagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcaggtcagtgcgcccgcgggctgctagagcgtgcgggcggcgggggcggtgcttgcaggaaacgcgcgccggctccaggaagtttccggagttgcctcacttttggcgcaggaagccgggcgctgtcacctccgaacccgccctagcctgccgccctgccgaggccctgcgtggggcacagtcggggcttcctgggtggcagcgacctctcagccccggaactcgctgcagccgccttccaggggcccttcccgctcccagcgcgcagccctcctagaacgccccgggtgggcgtggacgggagcccggagccctctcgcctgagcgcccagcgcgggattctcggggtacctgcggttccaaacttgcccacgataaggatcacctgggcacttgctgcggcgacggcttcctgggtagttccttattgagatcccattgtcagggtgtgtatctggattgaagcctcggcgcgatccttccccgaaacctcggggacctgcattcccactgatttgccaggggatcggagtcttagagttgtgcttttttttttgtccacctcaagtttactccagttcaggacatttacaaaattcggcacaattttgggcacgggcttccccggagtttgaggtgtgaggttgattgggtgagtttgctgctgaaatctgtttcctccccccacccccaaccccgcaaaaagcagtaaagctactccgggattcggagggctccgtgggttccaggactcagtctcatccccgcaccctcccaccctaaaataaagccgggttgacccggtgctgttagcgtctgaggcgtgtcggcttttcacccagagggtggggatgcaatcagtgtgggtaggatgcaagatggggtgatggagagtggaaaatggggactttgctgcctgttggccagagaagcagtattggtctgtgtttaaaaaaataaagcttctggcttctacagctgggaccaaagacattattttccagtctacaccttccgtgtgtcttggtgacatttatttatttgccctaagaagcattctaccgttcactgttttttgaaagaaaaacagtgcgctggaaaggcaatctccctgccccagttatttctctgaaggagtgtagagcgattccaccaaatagaccctgggaaaaagaaagttattttttgcccagtcttccacaccccaaaggaagggtgggaaatcagaatgtgaaagagacggggccccaaaaggaaatgatgctacactctaaaaccggcagtgacttctagttctgtttccaaattcacttttttttacccctcaattgcaaaagtttggaatctcagaagagatttcaaaatacaaagactgaaaaataaactttcagttttctgtgggatcagctctttggaggtctagggctttaaatttgtgtgtgtgtgtgtgtgtgtgtgtgtgtgtgtgtgagatatttcacaatgtaatgaaatgtcttcttaaggccttactcattttgccccttgcagacacagaaagtggtttacttcacagcatcggccaggctttgggaatcctcccttaaagagaattcataggacagtgttctgtaatctagcatggatctaattacccaaagagagaggaatttctgaccctgagacaggtcacagaattatctaaagtgactcacagatttacttgagaaatggttagctgaaatatctcatgagcgaagattcatttaaagaggattaataactgcaaagaacacatcattccacattagaaaactgttctggttggccgagctcggtgctcacgcctgtaatcccagcactttgggaggccgaggtgggcggatcacctgaggtcaggagttcaagaccagcccggtcaacatggcgaaaccccgtctctactaaagatacaaaaaaattagccgggtgtgatggcgggcgcctgtagtcccagctactcgggaggctgaggcaggagaatcacttgaacccaggaggaggaggttgcagtgagccgagattgcaccactgcactccagcctggacgacagagggagactctgtctccagaaaaaacaaaaaaaacaaaaaaactgttctggtcaagttttactatttaaaaagtccatgggccgggcgcggtggctcacacctgtaatcccagcactttgggaggccgaggcgggcggatcacctgaggtcaggagttcgagaccagcctggccaacatgggaaaacccattctctaccaaaaatacaaaaattagccgggcatggtgtcaggtgcctgtaatcccagctactcaggaagctgaggtaggagaatcatttgaaccctggaggcggaggttgcagtgagccgagatcgcaccattacactccagcctgggcaacaagaactaaactccatttcaaaaaaaaaaaaagtccatggatgtagagacactgcaagattagtagttgtcagggactggcgagaagagggggatgggtagtgattgtttaatgagtatggagcttcctttggagcttccttttggagtcatgaaaatgttctggaactagagagtggtgatagttgcacaatattgtgaatgccactggattgtaacttcaagatggctaaaaatgaccaattttatatatattttaccacaatataaagacaggttttgtggcgtgcctgcagtcccagctactagggaggctgaggcaggaggatagttgttgctcaggagaacagcctgggcaacgtggggagaccctgtttcagaaaagaaaagtccatggagcggaccatttaagattattattattatgtttattttcatgtttttgagacagggtttggctctgctgcctaggctggagtgcagtggcgcaatctcggctcactgcagtctcactctgctggactcaagtgatcccacctcagcctcctgaatagctggaactacaggcttgtgccaccatgccctgctaatttttgtatttttgatagagacgggtttttgccatgttgcccgggctggtcttgaactcctgagctcaagggatctgcctgccttggcttcccagagtgctaggattacaggtgtgagccaccatacccagcccatttaagattattataagccattaattgaatataatcatgcattacattatgatgtttccttcaatgatggaccacatgtatgaaggtggtttataagattacaatggagctgaaaaattcacattgtctggtgatgtcttggtgatcctgacctgtgtaggcctagagtaatgtgtttgtttgtgtcttagttttttcctctcgtctcccccatgtcttagtttttaacaaaatttaaaaattaagaaaattgggccaggcatggtggctcacacctgtaatcccagcactttgggaggccaaggtgggcggattacttgaggttaggagttagaaagagaccagcctggccaacatgttgaaaccccatctctactaaacatgtaaaaattagccagatgtggtggcgcatacctgtagtcacagctacttggaaggctgaggcaggagaatcacttgaacccagaaggtggaggttgcagtgagccgagattgcaccaatgcactgcagcctggttgacagagtgagactccgtctcaacagtaaataaataaataaaaataaaaattaaaattaaaaatagaaaaaggtatagaacaaggatataaaatatttttgcacagctgtacaatgtgtttttgttttaagctgtgttattacaaaagagtcaaagttttaaatacattaagctgaaattattgaagaaaaaatatgtttagtgtagcccaagtgtacagtgtttataaagtttacagtagtgtacagtaatgtcctaggccttcacattcacttaccatgcattcactgactcacccagagcaacttccaatcctgcaagctcctttcatggtaagtgccctacacagacataccatcttaagtcttttctactatatttttactgtaccttttctatgtttagatgtctttctaaaattattattatttgtattttaaatatagaggcagggtctcactgttttgcccaggctggtctcgaactcctgggctcaagtgatcctctcctcttggtctcccaaagtgctgggattacaggcatgagctatcccacctggcctacatatctttaaatacacaaataccattgtgttacagttgcctgcagcattcattacagtaacatgccatacaggtttgtagcctaggaataataggctctaccgtgtagcctaggtgtgtaataggctatctcatctaggtttgtgttagcactctcttccttcagtgtttgcgatatgaaactgcatttctcaggtgtttctcagaatgtatccccattgttaagcaatgcatgaccgtactttttaatgggttaaaagctttacgttggatggtcttggttcatcttccagttttcaagtaaacatttctcttatccccatgacaaggcaactgaggcagagaggttgacacaagtagtagagctggtatttgaatccagagagtctgactgcagaattcttagccacttccttatactgctacagagagaactgaatcagtgtaccctatctgtatatttcaaactgtgaattgggtcaacagcattaaaaaaaaaagtggagtagccgggcgcggtggctcacgcctgtaatcccagcactttgggaggccgaggcgggtggatcacctgaggttgggagttcgagaccaacctgactaacatggagaaaccccttctctactaaaaatacaaaaattagccaggtgtggtggtgcatgcctgtaatcccagctacttgggaggctgaagcaggagaattgcttgaacccaggaggcggaaattgcagtgagccaagattgcaccattgcactccagcctgggcaacaagagcgaaactcagtctcagaaaaaaaaagtgagtagaggttgggcacgggggctcaagtctgtaatcccagcactttgggaggctgaggtgggcaaataacgaggtcaagagatcaagaaccccgtctctactaaaaatacaaaaattagctgggtgtggtggtgcgtgcctgtagtcccagctacttgggaggctgaggcaggagaatcacttgaacccgggaggcggaggttgcagtgagccgagattgtgccactgcactccagcctggcgacagagcaagactccatctcaaaaaaaaaaaaaaaaaacaaaaggtggagtagaatggataagatcagtctatcacatatagtaaggacaagtgttttgagaaacttcttcttttgttttttttttttttgagatgaagtctcactctgtagcccaggctggagtgcagtggcgcgatctgggctcactgcaagctcggtctcccggttcacaccattctcctgcctcagcctcctgagtagctgggattacaggcgcccgctaccacacccggctaattttttttttttgtatttttttagtagagatggggtttcaccgtgttagccaggatggtcttgatctcctgactttgtgatccgcccgcctcggcctcccaaagtgctgggattacaggcgtgagccaccgctcccggccgagaaacttctatgtaggttttataggcataattgtgtgtgtgtgcactggctccagatgtaaaatgcatttcttactgtaggttgtagtcaaaagtttgaaagcctgtatctaggggatctgtttaaggatttaatatttcttttttttttttaaagagatatataattaaagagaagacagagtagtgagaacaaggatgatgctgaacttaaaggaatgaacctgaaatgtggtggggtcttggaccaacctggatggcagggagaaggaaggatactggtgggagataggagtgagtgggaacccacatctttaggtccataaacgcttctgcacaatcccttttatttctttagagagcatgagtcaagtggccactatatattgtttttggataagaacatacttctctgaaggtcacttttctgtgcttgtaaacaggatacaggactttatatcttttatatatctgtattctatatattaactcctggttagtaatgttgacttaagtgttgtaaaatttaaaataagttggtattttacattcttcaaaatccatttttcctcccagtgcctcttgtgtggattgatccaaattcctggcattctggggaatttgttcagttttccctacgttgcagcgtctctccatgactgtctccttgtgcaccttttccctactttccagtgtgtaccttccatgggagcatctgtggtcatctgtgaccagggtggtgtcagggttgtataggtttcctagtactattccctactggactgtagctcatgggctaggagggagggctggaggagacgctatcatctctcccaggaactggctgtcctttgaatctacatcacaagctgatccttggaccagctcagaccagctcgtcttgatctatttctgtgccatttcagtttagctgtatcctagttctcttaaatattcaaggttttatcttggtgagttctcctttctatataaggtacctttcctgtatttccactattcttttattcagaacctacacttagttaaattggagagtctgctattctctgagggccttgatcttcatgcccctgtaactgacccttccaggtatacatgggaacagcctttcagacagcattatctaccaaggattaaatgggtataacttgttccatcagttgttttttatgagtttttgggaatatgcaagagtcttgactctgtcacatttccagttaaagtaggttttagcttgtctgccaagacagtttttataaatcatgttaacagttcaaaattttgggaagcatgcatataatccagcgtgaggagatggcattggagatggctgactgcttccctgtgagggctgaggaagcacagacactggcagtgagtcatatccccacctcagccattttcactggaagattatgtctattcgctaaagataatgggaggcaattagatactttgtttatacaaaaatgcatcttagacacttcatactgaaatgtagcaatcacaaaaggtttttctttttgaatcacaaacctctcggatttattaaattagactgctgtggtgaactaagaattttaacaacttctaagatgtgaagaggaacaaaaacataaactatttactattctctcctatatcatgggtgaaaggtgagtttatatcccaagttttaaagtatattatagaaatgctcttctcatcattaaaaggtactattttagatgtgtagctcactcaaattttgatccattaataatttttgtgcttggtttgttaatgaacacttatataggacttagttgtgttcattgccagaaagagcactgtgaataaagaagaaaaaataacaaggcacttttgacatattatatgattggaattttggacatgtctaagtggaataaaacagttaagaagttactgagaaagggggagaaaagccaatcctaatagtttcttttaaaaatggattatctataaacaatttttctgacatgggaagaaaaatcaatatacataacttcactatagcaagcaaagccttcaggttggtactcgtactagattcccagggctgctatcacacagtaccgcaaactaggtggtttaaatgacagaaataaacagtctcacagttctagagactaaagttccaaaatcaaggggtcagcagaaccatactcactccagaacctgtagtgggggaggctgtccttgcctcttcccagcttctggtggtggccgtcagttgatggtgttccttggtttgagctgcgtcactccagtcgctgcctctgtcagtgtccatgtttttgttttgtcttataagaatgtcagtcatatgaggcagggtccactttactccagtatgcctgtgttagtttagctaattacatctgcaacaaccctacttccaaataaagtcacatgctaaagatacctggggtttaggacttcaacatatcttttttggcgaatggcacaattcaacttgtattagtactaaatactattattaaaaaaattagtaggaattttactacaatttcattgatcatcaagtactacgcacttcactgaacgctgggaatgcaggatgagcaaaaccaggtatagttcctgccttcatggaacttacagcctagcagatagaatcacatgaaatagaaatgtgttgtgagattgagaaatgtgatgataaacaaaaacacagctcagtgagagcacttggcataggaacttgaccaatgccaggagatgggagcatgaatgggtgaagcgatgcttaagccgactgatgttctgagtaacaaatactgctgatggcttactttgtgctaaacagtgagtttttacatgtgttacctcatttgatcctcacagtagcacgatggggtaggcaatattattcccattttatacataaggaaattggggcacagagagaactttcccaagactgtatcttgaaagtggcggagctgagaggatgatatagaaagagaatcattgtaatctctggtaggtgatttaattttaataataatattttactgatttatttgaatgatttctcccttcttcctcacctatccccgcttttgtattttctctgctatttgctttgtccacctctagaaacccttccatgcctgggcattccccacctgactcatttgccagtgatttctatatgaggactgtaatttgagtctagtatttggttgagtagactgcagtgttaaaactcaccaggagagggcaactgtctaatcattggatcccagattatgaatcctggattatgtgaacaattctcagttccaggttatgcaaacaaatatgtttcccatggttataaatttgctagagtctatagtaattagattgggatataatttgtgttgggttatgcaaagagtatctgaaccaagttaaatctgttatactcaaggccaagaggacattcatttactagaattttattctattggagcccattagtagaaatatttatttatttggaggcagagtcttgctctgtcacccaggctggagtgcggtggcatgatctcagctcactgaaacctctgccgcccaggttcaagcaattaccctgcctcggcctcccgagtagctgggattacaggtgcccaccaccatgctcggctaatttttgtatttttagcagagacagggtttcaccatgttagccaggttggtctccaagtcctaacctcaagtgattggcctgtctcaacctcctagagtgctgggattacaggcatgagccaccgcacccggccggaaacatacaatgtttgtccttcatgtctggcttattttactttgcaaaatgtcttcaaggttcatccacattaaaaacatctattttatttttatttttattttttgagatagagtcttgctcttccgcccaggctggagtgaagtggtgtgatcttggctcactgcaacctctgtcccctgggttcaagcaattctcctgcctcagcctcctgagtagctgggattacaggtgcccaccaccatgcctggctaatttttgtatttttagtagagactgggtttcaccgtgttggccaggctgttcttgaactcctgacctcagatgatccgcccgtttctgcctcccaaagtgttgggattacaggcgtgagccaccacatcagtaattcattctgtacaatgttgtatattctcaacacatattatattttaatttccttatttcaagaaaaccttagaattgaagatacagtagttccccttatccttggggatctgttccaagacccccagtgggtgcctgaaactgagggtagtaccaaactggattgccatcattcagaataaatttctgtttgtgtcttctacccacaaatttcatgccttttccatcttaactaagcacttaccatgtgctgtggccatagcttttgcagtctgaagtacaataacaatactagcatgaatttttttttcctccttcacagtttcacagatagaagatttgttcttaatatagttttagcaacctcagcgtaatgattttgttcattaataaactgagaactttaatctttttcacttgaaggaaacacagcttctctttggcataactgaattgccaacgtcactactcttgtggtttagggccattgttaagtaaaataagggttacttgaaaacaaacactgcaaaactgaaggttgatttgatcactgagatggatactaagtgactattaggtaggaagcatagacaatgtggatgctctggacaaaggattgattcatattctgggcagaagggctggagatttcatcgcaatactcagaatagcgtgcattttaaaacttatgaattgttggctggatgcgatggctcatgcctgcagttccagcactttgggtggccgaggcaggtcactgacttgagctcaggagttagagaccagcctgaccaacatggccaaacctcatttctacaaaatgtacaaaaattaagcaggcatagtggcatgtgcctgtaatcccaggtactcgggaggctgaggcacgagaatcacttgaacccgggaggcggaggttgcagtgaactgggattgcaccactgcattccagcctgggtgacagagggagactctgtttaaaaaaaaaaaaaaaaaaaaaaatgccaggcatgatggctcatgcctgtaatcccagcaccttgggaggccaaggagggcgtatcatttgaggtcaggagttcgagaccaggctggccaacatggtgaaacccccatctctactaaaaatacaaaaaaatttgctgggcatggtggtgcacacctgtaatcccagctgctagggaggctgaggcaggagaattgcttgaacttgggagccgaaggttgcagtgagccgaggattgtgccactacactccaacctggatgacagagtgggactctgtctcaaaaagaaaacaaacaaaaaaaccttatgaattgtctatttctggagtttttcatttagtattttcagaccatgtttgaccaagggtaactgaaactgtgaaaagtggaactgtagatggtctctatgagtagtcactgttaaaggggaaacaaagatgattgttggcctgatcttggccttcaaggagtaaaggggttctgtgtagtcagagggaagctgggtgcttctggtggagagacaggaaagtccagatgttatggagaaagtagcttttgagttgaacctagaaggaaattcattttgagtttttttgggttgtttgttttttgcagaacgtgtccatgctggtttagagattatggtctaagtgtttttcaataaaaggcatacactaacattcatagttacctgtaccagagttaaaattaaatggagttttcaaggcaattagatttattttaaacttttaaaagatcaatattaatggcattagggccagctcctttatctgatgtctttaaagttcattctggccatagtcaacccttgtaatgaattttaacctgacacatgttgctacttcatctagtctttgtaacctggttatttatttattttttgagatggagttttgctcttgttgcccaggctggagtgcaatggcgcgatctcgtctcaccgcaacctccacctcccaggttcaagcgattctcctgcctcagccttcccaagtagctgggattataggcatgcgccaccaagcctggctaattttgtgtttttaatagagatggggtttctccgtgtgggtcaggctggtctcgaactcctgacctcaggtgatccgcccacctcggcctcccaaagtgctgggattacaggcgtaagccaccgctcccggcctggttatttgttttatctgcaattattctttctcgtgaatccccttggctaatcatgctcacaaagttctgacacatataccacctgaatatttctagaatctgagtcatctttcacttaaattacaataacctcttaactggccttcttgcctcctagcttgtcctgctctgatccattcatgccaaagtgatttttctaaaattgaataagttttttccttgcaaaaaacacttgattgattttctgttgtctttcctcaccattgctgtgaggttttgttctgttgtagcctcttgctacattttttggcatttttttcttatcttccatcgcatttcctcatatagggcaatttagtattttagtttagtgcatagtttagtgcacagttaatctgagaaaccactctgtctcatttccttgctggagctggagacccaggtgaagatcctgaggtttgttcttttgcaatgtttggcctttattatctgccctcctcctgtaatttattttactgtcctttttgtttttggttggcaaccatggggaggtggctgctgcctcttgcttatcaacaactgttgcttatggagacttctgtgaacaagcagccaggtttaggtgaggaaattggccgtgactgaattctgggtgaatttttcgaggtccagttggtccaaatgtttgtgatgtgcagtcctaagaggccatggctcttcctgtgaagtgtgatgtgttttatgtatcacacattagtttttatttgtcctaagcaggaatcagaactcagttcaatagaggccattggcaaacatcccaaacaaggaatctctcactaaaatagcttaaaatataattttacctgtgtggtctaggcatttgtggtacagtgttcgttagcagtgaggaagggctatgcgtgcctggagatcagatgagaggccttaactcagtgaggtcgctgactagttgactttaaggcatagctgctgtagatcatacccctctaattgaccccaccatttatcgtttatcacatgggcagccctggaggtatgcctctctgatggcctatcaaaaagaatctgcccttcagcttcaaggaacagtttgctgacagcctccagctgttagtgctgtcaggctttgcctccacggaggccatacttatcccatgctgcgtgtcctttcattttggtgtcatctctttctccccttctacccctcctccaccacagtaaacagctttttgagggctggggctgtttacaagtgaagtagtttataaaaagtagatgcacatctttcagcttcatatttagcatgttggaaattctgttcactgatctaattctgaaatctccttggtatttcttaaactagttgtataggctgggtgcagtggctcatgcctgtaatcccagcactttgggaggctgaggtgggcagatcaccaggtcaggagatcgagaccatcttggctaacacgctgaaaccctgtctctactaaaaatacaaaaaaaaaaaaaaaaattagccgggcgtggttgtgggcgcctgtagtcccagctactcgggaggctgaggcaggtgaatggtgtgaacccgggaggcagagcttgcagtgagcggagatcatgccactgcactccagcctgggcgacagagtgagactccatctcaaaaaaaaaaaaaactagtatgtcaacaaagctttgtgctgctgtaatgggaagaacagctagcctgggctagtaatatgctaactggtttatgaacttaggtaggtgagtcacttgactattctgggtctgttctgaagggagaggcagtaggactaggagttaaattgtcatgccgaggtctctgagcatgggtgggcctgtcagaattgtcatcgctcactctgttgacttccagcagctgacaggcaaggccctaggaagctcttcagcctcctttccttgctagaggtgctgttttccctggaaatgttcaagccctgcaaatcgtttctatagtaacaggtctctgtcttttttcttatgatgcagatttttgaaaaggtttcttatctaaatgttcttgggatctatggtcttcctacctgtagctcctttgattagacagagcctttatttaaagacttttccccccaagaatgttgttgttgcttctaccaaaataataaccagttgttagttttactagtgcttgaagttttagtttattaataaagcttcatataaactagaaaaggagtggttgggtagaatagtaataccgaaaaaactaatattcactgttagtctcatgtatttgtaaactttaattttttattatgtaaaaccttcaaacataaaagtagtcaaaattatataatagacacctatatacttaccacctagattgaaaactaacattctgccatattggcgtagtttattcgtttactgatagtaaatcagagacatgtatttagaggtgaaatgtcaccctaaaaagcgtttttcttaatgatttacaccacccttagtaaaattagctattcattccttcatatcatctaatacctaatatatattcacatttcctcaggtgtctcaaatgtcttttactaatgattttttccaacaaggatccactcaaggtccatacatttgcatttgattattacgttttaatctggaatagcgcctaccgcccccaacccctgccactgctttatcagagaggtcagttgtcctgtaagatactctacctttatgatttgtatgatttttgtttgtttgttttcatttaacttctatatttctcatattcctggtaactgcaagtcaggtctaaagacctcactaaattcctggaaaacatttttagcaggaatgctctgtacttcatgcactgtcacaactgggagacactaagtatttggatcttgaagatttaaagacttctaattggtttttaaaagccctgtttcactggttttctaggataagcttctctagagaagttcctttttaaaaaatgttttattagtttgaagatttaatgggattttcctttcccctgaaattcttccagtttgatttcaaaaagaaaaggtcaacatagcattacatttctgaattttccctcaaataagccaaataaatagttggtgaaacagtattttgtgactgatgcgcaccactttggttctggcagtctctgggcattaggccactctttctgctctgctctcctggctgacagtttataatggattttacttttcttttaaaaaatcagatttgctgtcttttgctgtcatcagctctgggccttgtcaccacatggcagacttcaacctacaataacccctgatgcgtgtttcctgaaggggacctctccccttcagtccacacttctagtaggttgagttcagcccaagattaaggctctggtctggagtcagaagatgggtcaaaatctagctctcccaccggctggttggctcttcttcagcagtcagctagtgtttccaaatgacagtatctgtgtcctcatctgtaaagtcgggacaataactggtgttttttttgttttgttttgttttttgagacagtttcactctgtcacccaggctagagtgcagtggcgcgatctcggctcactgcaagctccgcttcccgggttcacgccattctcctgcctcagccccccgagcagctgggactacaggcacccaccaccgcgcccggctaattttttgtatttttagtagagacggggtttcactgtgttagccaggatggtctcaatctcctgacctcgtgatccaccggcctcggcctcccaaagtgcggggattacaggcatgagccaccgcgcccggcctataactggttttgactaatgcgagttgtggtagggcttgaaagaaatcacaaactaaatgtaaaatttaatttgaaaaatgctgtccaagcaggaactcacatccaggaacaaaatgaatggagaccagaaatccagatatgtatgcccaagaaaagcagaattttatccaggacttctcccaggttgtcaggatgctgactgaggatgagatggggcacccagagacaggagagtctattacctggctcaaagaggtcctggagtacactgccactggagacaagtaccactagggtttgatgatgctggtagcattccaggagctggcagagcccaggaaacaggatgctgatagtctccagcaggtcctgtctgggctgttgtgtgaactgctgtaagcttgcccgtttttttttgttgttgttgttgtttgttttttgagatggagcctagctctgccgcccaggatggagtgcagtggcacaatctcagctcattgcaacttccacctcctgggttcaagtaattcttgtgcctcagccccctgagtagccaggactacaggcgcattccaccgcacccagctaagttttgtatttttggtggagacggggtttcgccatgttggccaggctggcctcgaactcctgacctcaggtaatccccctgccttggcctcccaaagtgctgggattacaggtgtgagccactgcaccttgtgctgcaagctttcttcctggtggcagatgacatcagggattcatccctcaccttgctgggggcagatctgcttgtatcagaagccaggtgtaggtttggatgccatcaatgatgctatgcttctagaagcatctatctatcacctgttgaagctctgttgctgagagcaaccccattacctgaacctgaaaaagcacttcctgtggagttcctattagacagagatcaggcagaccctggaccccatcacagccccccagagcaatgtggatcttgactggttcactgaaaagaggtacaaatcactgtcaagtataagacagctttctacttcttctaccatcctgaagctgcagccatgtctatggcaggcgtcagtgtggggaaggaatgggccaatgacaggaagatcctgctggagttaggagttctttcagattcaggatgattaccttgacctctttggggaccctactgtcaccactggcagagtttgtactgacatccaggacaacagatgacaacaaatgcagctgactggtggttcagtgtctgcaatgggccacaccggaacagcaccagatcatgcagaagaattacagggaggaggcactatatgaggagctggatctgctgaccatgttcttggtatgtggaagatggttacagccaccttatgggtctcattgagcagtgtgttgcaccactgcccccagccaccttcctggggctagcgtacaaaatctccaagcaactgcaaggcagggagaggaggctctcaataaattactgtgtaatctttttttttgttgttgttgttgttgttgttgttgttttgagacagagtttcactcttgttgcccaggctggagtgcaatggtgtggtcttggctcactgcaacctctgtcttctgggttcaagcgattctcctgcctcagcctcccaagtagctgggatttcaggcacccgccactacgcccggctaatttttgtatttttagtagagatggggtttcaccatgttggccaggctggtctcgaactcctgacctcaaatgatacgcctgccttggcctcccaaagtgctgggattataggcgtgagccactgcgcccggcctactgtgtaatcttacaaaaaaagaaaaaaagaaaacaatgctctaaaagagaagggaattttgtttctgttccatgcatagacctacacaggcttttttccttttgctgtttcccacttccatatcttattttatatggtacttttcttcctttccctttctaggaaaccctccctccacctttcctcctactcgacctttaggcctgggtaaaattttaatcttcaatacaatcatattgttttgtctcagcccacaagttttcatttatgtgaactatcagttttacaatttaacctctagtcattctccaaatatttttacacctaggcctcttatttctgcagatctcaagttgcttgaggtcatggtttgatagatttgttttcagctcagaactatgaaaactttattgtattaccctagacattgatttctaatgagttggttgtaggatgcaactggtttcttaagtgggggatatttttctagaatgtgggtacaactttctgatgtgaggtcctcacaaatttttaaactttgctccagcaaaaagaaccacgtagaggttctctacctgggtccttcctgcctcaccttctttaggtggagttggctccagtttcctccttgtctctgcctccaccccacccctgccccaggcctcatagtgttccacaggaatgacgtggtgactgtagtgagggttacagtgaagaattgcccactgtttggccttgctgaacagcaaatttgggccagcagtgggtctgttttctctcttttctttttatttatttatttttttgagacagaatcttgctctgtctcccaggctggagtgcagtggcgtgatctcggctcactgcaagctccacctcctgggttcactccattctcctgcctcagcctcccgagtagctgggactacaggcgcctgccaccacgcccagctaattttttgtatttttagtagagacggactttgtccgtcttagccaggatggtcacgatttcctgacctcgtgatccacctgcctcggcctcccaaagtgctgggattacaggcgtgagccaccgcaccgggcttttttttttttttttttttttttttgagtcggagtctcactctgtcgcccaggctagagcgcagcggcgcaatctctgctcattgcaaactccgcttctcgggttcaagcaattcatctgcctcagcctaccgaatagctgggattacaggcacgcgccaccgtgcccggctaatttttggacttttagtagagatggggtttcaccatgttggccaggctggtctcgaattcctgacctcgtgatccacctgcctcatcctcccaaagtgctgagattacaggcgtgaaccaccgcgcccggccagcagtgggtctgttttcaaccctcatgtaccctcagctctcaagcctgtgtgctcccaccccagccagtcaccagaatcacatagattttaaaacgacttatcctgggtccatccctacacatagtaaatgagatttttgctgggtagcttgggacgctatattttccaaaactccctgttgattggctgtatttgggaacccctgttgcgaaggaagatcccttatctcttcatctgtcactaatgatggtggcttgcgcactctgatggtacttacttggatgggattacagatggttccatcacacccatctgtatgaaatctcgtggtataagtgaatgtaggatgataagggacgagcctattagaggcttttgaagcaaatggatagtttaatcagattggtgtgttttttttttctgtagaactgctgtgaactagaccttgttatcaccatctgtttcgtaaattccattttcggtttaacagctggattgtgaaagatatacaaaattatccagttaaaaaactaaatttggcaagtgtgtgtgtgtttttaaaaatgactccttgaatacactgttttgattccttagacagtttctaaggctctaattttggtctaccagaaatattcagagtagtaaactgagaccagaaaggcgagttctttggcttggataactttgagagttaatagtatacatgattggcagccttcagttttatccagcaataaatctaaacagtttaaaataagtactttccccttacctcagtacagagaggccctggccactgccatgcacatctcagaagctgagcagtggggcagaaggataacttgtaatttggcatcaatgtccaacacccttgagctctggactcttttattcattccttctactttaccattctacatcttgaaccactgtgcgtgcggttcccctaagaggcagtaaagtaattgcatcagggtggagggattttatgtgctttcactttctcatttgattatttctacatcttaccgataaacttccatgaatattactgttgtaatgaggagcaaaatgttagtaaagataactttatacgtgaaaacttgaactcttaccaagaaacgtagtgtttgtgacaaggctggctgagaggatgagaatagctcatcagtactgggttggctgaaggaaacatgcatgtcagtactattttgagggcagctgagaacatctatttcaatagctttggctatattttaatagctaagagcaacatatgaatttgtctctgccaaagatggagtgaaaatttccaaaataaccaaacttttactttttttgcaatacattaggtctttcctgctgacaaacctacagtttatgaaataagtttgtggagcatatcaaagctgtgcggcagctctgtgcactccagcagatggtgtgactggttgtctgtagtcgtcttagtttccgccattgtgtcagtctgtggaatgtttgggttcatgcttattttggccaagttttccaaattctgtcttggtaagtacaaaaagctgtgagtgtcggaagctctaacaagaggtgtactcatgatgaaagtgaaagcagagagagcgatttttttttcctctttgaatttgttttaacatgctcttacttgtaggacaaatttttcaaacaggtggtagaaagcaaaacatcttaatgccatcttcagggcagaagactttgagttgcaggatgtgatttagggaggattttgaaagagtttgcagcactgcgtgaagctggctgggtcttcctgtgtactcctccttgccctcctcctatagcccctccatgcaaaggtaacctgtttttttaatgtttgtttctttttaaaatttttttatttttatagaaaaaacaaatgccagcatgtgtatgaagaccttaatttaaaaaaatatttttattggcctggcgcggtggttcacacctgtaatcccagcactttgagaggctgaggagggcggatcacctgaggctgggagttcaagaccagcctgaccaacatggagaaaccctgtctctactaaaaatacaaaaattagccaggcatggtggcacatacctgtaatcccagctactcgggaggctgaggcaggagaatcgcttgaagctgggaggtggaggttgcggtaagccgagattgcagcattacactccatatattatggagtatatatatatggagtatatatatatatggagtatatatatatatatatggagtatatatatatatatggagtatatatatatatggagtatatatatatatatggagtatatatatatggagtatatatatatatatgagtatatatatatggagtatatatatatatggagtatatatatnnnnnnnnnnnnnnnnnnnntatatgggagtatatatatatatatggagtgtatatatatatatggagtatatatttatatggagtatatatatatggagtatatatatattttatatattatgtattatataatatatattatattatatataaaatatatattttataatatattattaatgaaatttctcacatatacaagactgtatgaacaagtttaatcaaaatacattgggttttgacaaatcttagtattttgctataattgcttttaaaaaatacagatagtttaaacttcctagttatcacttcctgatccagttatcatctcactacagaggtaaccactatactgaatttggtccctaactttctttttttttttgagatggagtcttgctctgttgcccagactggagtgcagtggcatgatcttggctcactgcaacctccgcctccgggttcaagcagttcttctgtctcagactcctgagtagctgggattgctttcatgtcttttttttttttttttttttttttgagacagagccttactctgtcacccaggctggagtgctgtggtgcaatgttggctcacggcaacctccgcctcccagaatcaaacgattctcctgcctcagcctcctgagtacctgggattacaggcatgtgccaccacacccagctaatttttgtatttttagtagagatggggtttcaccatgttagccaggctggtcttgtactcctgccctcatcggcctccgaacgtgctgggattacaggcgtgagccactgcgaccggcctcatgtctatttttatactttcattttctgtatatgtttacaaacaacatgtaacattgtttttacttaatttaaatggctcatactctacatatccttctgctacacgctttttacactgaatatcctttcaaggatttataaatgcagcccaaatttactgactttcattgctgggtcatattttattgtgagtttacccaaactgtgtaattgttcttctgattcactcttctctatttttgctattaccaacaagatggcagtgattttttttttttttttttttttttttttgagacagggacttgctctgttgcccaggctggagtgcagtggtgtgatctgaagtcactgcaaccttcgcctcccaggttcaagtgattctcgtgcctcagcctcccaagtagctgggactacgggtgcatggcaccacatccggctaatttttgtatttttagaagagatgggttttcactatgttggccaggctggttttgaactcctgacctcaattgatccacctgccttggcctcccaaagtgctgggattacaggcgtgaaccactgtgcccagctgaaaattcttatgttcccttggctgcatgaatttctttggagtcccttcatttaaaaatgtattttaaggaagtgaattggtccagcgtggtggctcacacctgtaattcgagcactttgggaggctgaggtaggaggagcttgagcccaggagttcaagatcagcctgggcaacataatgagactctgtctctacaaaaaaataaaaaattaactggatatggtggcatacctctagtcccagctactggggaggccaaggtgggaggattgcttgagtctgggagatggaggctacaatgagtggtgattgcactgctgcactccagcctgggtgacaggacgagaccttgtctcaaaaagaaaaaaaagtgaatcatagagtaaagacagacatattaattgaataaacacagaagatctatgtttaactccagctttgtgcatggtgttacagggaagtgtgtagaagctccaaagccttcagatataatgcttaactcagaaacttatagcccagtgtgtctgtgggacgtgggcacaaataaccatggtactacgaggcatgatgagataagcgctgtatgctggtggaggtagctctgatattagatggaactatgagggtctggaccattctccaccaaatcaggataggcttatctttgttagcaccttgagttgatttaattccagccaaaagcagaggtgtgatgccctaggcacttctctctgtctcttctcttaattttaaaaccagtaggcagactccattagctctttcctatcctttaggatggatgctcactcagatgttccaagtcatcttccactgtcttttaactctgtccttccagggagatgcgtcaggtgtccggcttcctcagagagctggagttgttggtgctgatcaccagatactccagacggcactaattcctatactatgggttcagagggaactccattggacagaaatttccttttgaggaaatctttccctggagtttcttcttacctttttccctcactttctccacagcagaaacaggtctgtttgtccttaaatatttacctatatatttgagtaggagcattttgaagagatgaagtttctgtgtagcagcacaaaacatgaaatagttcaaaccaggggcactctggttctcagaccgggagcttcaggatcttctgggaacttgttagaaatgcaaattctcaggtctgctcagatcacctgaaacagaagccctaggggtggggcctagagatttgtgtcttaacaggcccacagcgggagtctgggaacccctgtttcgaagtatgcttaaataagcacttgggggccaggcatggtggctcatgcctgtaatcacagcactttgggaggccaagacaggcagatcccttgagctcaggaatttgagaccagcctgggcaacatgacgaaaccccatctctacaaaaaaatacaaaaattagccaggcatggtggcttgcgcctgtaatcccagctactcaggaggctgaggtgggaggatcacctgagcctaggaggtggaggttgcagtgagctgagattgtgccgctgcattccagcctgggcaacagagggagaccctgtctcgagagaaaaaaaaaagcacttgggcttgtattgtgggcctgtcttactatactttcagaaaagggtctggcagactaaatacttgagggatgttacccagcagtgttatttgttgacattgcttaattatgaatgacatgagaaaggtatacctgaaaactgacattgtgtggtgttgttgtagacaaacctttaacttgtggaggctgctttcattttgtttgtggttgtgaccaaccgtaggaaacagaatgccataaatccctgtttccagggttaccttcttgctgctgataacaggcaggaaattaaaacaatatgtgatagtgttctgttcttattacctacagatggtagcttttagatatgttggagcaaaacataagtaaatatagcagggaaactttattactgaagaaaaatgatttggctaggtcaaggttatagtctggttcattttaataaaatggggcataggcaacatatcagtgttccattatcacatgaagcatttagctgtatgaggatcactagattttttttctctttgatttaattttgagtatgtaaaacatttacatgattccaaggtcaaaactgtgtaacaaattatattcaaagatgcttccctttcatccatatcccttctgtctcttctcttactgctttgcaggtaatcatttttactagcttctgaatttatccttccagtgtttctttttgcagataagcatatacattcatatgtatatgtcatatgttcatagctcctccttccactttcattacacaaaaggctacatactatactacaattttaaaaattattattattattatgatttttagagacagggacttgttctgtcacccaggctggaatgcagtggtgtaatcatagctcactgcagcctcaaactcctatcctgggttcaagggatcctcctgcttcagccgcctgaatagctaggactataggcacatatcaccatgcagtactttataattttttttttattattatactttaagttttagggtacatgtgcacaatgtgcaggtttgttacatatgtatacatgtgccatgttggtgtgctgcacccattaactcgtcatttaacattaggtatatctcctaatgctatccctcccctctccccgcaccccacaacaggccccggtgtgtgatgttccccttcctgtgtccaagtgttctcattgttcaattcccacctatgagtgagaacatgcggtgctttttgtccttgcaatagtttgctgagaatgatggcttccagcttcatccatgtctctacaaaggacatgaactcatcattttttatggctgcatagtattctgtggtgtatatgtgccacattttcttaatccaatctatcattgttggacatttgggttgcttccaagtctttgctattgtgaatagtgccacggtaaacatacgtgtgcatgtgtctttatagtagcatgttttataatcctttgggtatatacccaataatgggatggctgggtcaaatggtatttctagttctagatccctgaggaatcgccacactgacttccacaatggttgaactagtttacagtcccactaacagtgtaaaagtgttcctgtttctccacattctctccagcacctgttgtttcttgactttttaatgatcgccattctaactggtgtaagatggtatctcattgtggttttgatttgcatttctctgatggccagtgatgatgagcattttttcatgtgtcttttggctgcataaaggtcttcttttgagaagtgtctgttcatatccttgagaagtgtctgttcatatccttcacccactttttgatggggttgtttgtttttttcttgtaaatttgtttgagttcattgtagattctggatattagccctttgtcagatgagtagattgcaaaaattttctcccattctgtaggttgcctgttcaccctgatggtagtttcctttgctgtgcagaagctctttagtttaattagatcccttttgtcaattttggcttttgttgccatcacttttggtgttttagacatgaagtccttgcccatgcctatgtcctgaatggtattgcctaggttttcttctagggtttttatggttttaggtctaacgtttaagtgtttaatccatcttgaattaatttttgtataaggtgtaaggaagggatccagtttcagctttctacatatggctggccagcttttccagcaccatttattaaacagggattcctttccccatttcttgtttttgtcaggtttgtcaaagatcggatggttgtagatatgcggcattacttctgagggctgtgttctgttccattggtctatatctctgttttggtaccagtaccatgctgttttggttactgtagccttgtagtatagtttgaagtcaggtagcgtgatgcctccagctttgttcttttggcttaggattgacttggcaatgcggtctcttttttggttccatatgaactttaaagcagttttttccaattctgtgaagaaagtcattggtagcttgatggggatggcattgaatctatggccattttcgcgatattgattcttcccacccatgagcatggaatgttcttccatttgtttgtatcctcttttattttatggagcagtggtttgtagttctccttgaagaggtcctttatgtcccttgtaagttggattcctaggtattttattctctttgaagcaattgtgaatgggagttcactcatgatttggctctgtttgtctgttattggtgtatagaaatgctcgtgatttttgcacattgattttgtatcctgagactttgctgaagttgcttatcagcttaaggagattttgagctgagacaatggggttttctagatatacaatcatgtcatctgcaaacagggaccatttgacttcctcttttcctaattgaataccctttatttctttctcctgcctgattgccctggccagaacttccagcactatgttgaataggagtggtgagagagcacatccctgtcttgtgccagttttcaaagggaatgcttccagtttttgcccattcagtatgacattggctgtgggtttgtcatagatagctcttattattttgagatatgtcccatcaatacctaatttattgagagtttttagcatgaagcgttgttgaattttgtcacaggacttttctgtaactattgagataatcatgtggtttttgtcattgattctgtttatatgctggattacatttattgatttgcatatgttgaaccagccttgcatcccagggatgaagcccacttgatctggtggacaagctttttgatgtgctgctggattcggttagccagcatttttttgagggttttgcatggatgttcatcagggatattggtctaaaattctctttttttgttgtgtctctgccagactttggtatcaggatgatgctggcctcataaaatgagttagggaggattccctctttttctattgattggaatagtttcagaaggaatggtaccagctcctccttatatgtctggtagaattcggctgtgaatccatctggtcctggatttttttggttggtaggctattaattattgcctcaatttcagagcctgttattggtctattcagagattgaacttcttcctcgtttagtcttgggagggtgtgtgtgtccaggaatttatccatgtcttctagattttctagtttatttgcatagaggtgtttatagtattctctgatggtagtttgtatttctgtgggatcagtggtgatatcccctttatcattttttattgcatctatttgattcttctctcttttcttctttattagtcttgctagcggtctatcaattttattgatcttttcaaaaaaccagctcctggattcattgattttttgaaggcttttttgtgtctctatctccttcagttctgctctgatcttagttatttcttgccttctgctagcttttgaatatgtttgctcttgcttctctagttcttttaattgtgatgttagggtgtcaattttagatctttcctgctttctcttgtgggcatttagtgctataaatttccctctacacactgctttaaatgtgtcccagagagtctggtatgttgtgtctttgttctcattagtttcaaagaacatctttatgtctaccttcatttcgttatgtacccagtagtcattcaggagcaggttgctcagttttcatgtagttgagcagttttgagtgaatttattaatcctgagttctagtttgattgcactgtggtctgagagacagtttgttataatttctgttcttttacatttgctgaggagtgttttacttccgtcaattttggaataagtgtgatgtggtgctgagaagaatgtatattctgttgatttggggtggagagttctgtagatgtctgttaggtctgcttggtgcagagctaagttcaattcctggatatccttgttaactttctgtctctttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgaattgatccctttaccattatgtaatggccttctttgtctcttttgatctttgttggtttaaagtctgttttatcagagactaggattgcaacccctgccttttgttgttttccatttgcttggtagatcttcctccatccctttattttgagcctatgtgtgtctctgcacgtgagatgggtttcctgaatacagcacactgatgggtcttgactttttatccaatttgccattctgtgtcttttaattggagcatttagcccatttacatttaaggttaatattgttatgtgtgaatttgatcctgtcattatgatgttagctggttattttgctcgttagttgatgcagttttttcctagcctcaatggtctttacaatttggcatgttttttcagtggctggtaccggttgttcctttccatgtttagtgcttctttcaggagctcttgtagggcaggcgtggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatcagctgttagtccgatgggcttccctttgtgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggatgatatcctgcagagtgttttccaacttggttccattctccctgtcactttcaggtacaccaatcagatatagatttggtcctttcacatagtcccatatttcttggaggctttgttcatttctttttattcttttttctctaaacttctcttcttgcttcatttcattcatttgatcttccatcactgataccctttcttccagttgatcgaatcagctactgaggcttgtgcattcatcacgtagttctcgtgccatggttttcagctccatcaggtcctttaaggacttctctgcattggttattctagttagccattcgtctaatttttttaaaggtttttaacttctttgccatgggttcgaaattcctcctttagcttggagtagtttgttcgtctgaagcctttttctctcaattcgtcaaagtcattctccgtctggctttgttccgttgctggtgaggagctgcgttcctttggaggaggagatgcactctgatgtttagagtttccagtttttctgctctgttttttccctgtctttgtggttttatctacctttggtctttgatgatggtgatgtacagatgggattttggtgtggatgtcttttttgtttgttagttttccttctaacagtcaggaccctcagctgccggtctgttggagtttgctggaggtccactccagaccctgtttgcctgggtattagcagcggaggctgcagaacagtggatattggtgaacagcaaatgttgctgcctgatcgttcctctggaagttttgtctcagaggagtacccggctgtgtgaggtgtcagtctgcccctccttgggggtgcctcccagttaggctactcgggggtcagggacccactttaggaggcagtctgtccattctcagatctcaggctgcatgctgggagaaccactgctgtcttccaagctgtcagacagggacttttaagtctgcagaagtttctgctgccttttgttcggctatgccgtgcccccagaggtggagtctacggaggcaggcagggctccttgagctgcggtgggctccacccagttcaagcttcccagccgctttgtttacctactcaagcctcggcaatggcgggtgcccctcccccagcctcgctgccgccttgcagtttgatctcagactgctgtgctagcaatgagcgaggatctgtgggagtaggaccctccgagccaagcgcaggatattatctcctggtgtgccgtttgctaagatcgttggaaaagtgcagtattagggtgggagtgacctgattttccaggtgccatctgtcaccgctttctttgactaggaaagggaattccctgaccccttgtgcttcccgggtgaggtgacgcctcgccctgctttggctcactgggtgcgctgcaccccctgtcctgcacccactgtccgacactccccagtgagatgaacccgatacctcagttagaaatgcagaaatcacccgtcttatgcgttgctcacactgggagctgtagactggagctgtccctattcggccatcttggctccacccccaccctttttttttttttttttttttttttggtaaaaacagagtctggctaggttgggcagtctggtcttgaactcttggcctctagcaatgttctcaccttcgcctcccaaagtgctagaattacagatgtgagccaccgcacccagcctaaaaattatgtttgaagttagctttattaaggtgtcacttatcttatgtaaaatttacctactttacatgtacaatgtgaattttaacaaacgtatgcagttatatagccacccatacagtgaagataggaactatttccatcacccaaaaaagtttctttctttccttttgcagtgaagttctctctcctacctctctggccctggtaaaccacctgtctgccttctatcactatagttttgccttttctagaacataggtagtctcttctgtgtatggatgtcttctttcacattgtagtgtactttggagactcaaaccatgttattacatgtatcagtaattcattccatcttcttgctgagtgtactccattgtttatatgttccagttgagggacattgtccttttgctttttagaaaactttttattgggccaggcacggtggctcacgcctgtaatcccagcactttgggaggctgaggcaggtgggtcacctgaggtcgggagttccagaccagtctgaccaacatggagaaacccgatccctactaaaaatacaaaattagctgggcgtggtggtatgtgtctataatcccagctactcaggaggctgaggcaggagaattacttgaacctgggaggcagaggttgcagtgagctgagattgtgccattgcactccagcctgggcaacaagggcaaaacttcgtttcaaaaagaaagtttttattttgaaacaattttagactgacttacagaataattataaagatagtagagagagttttcatataccctttccccagtttctcctgatgtttaacatctcacatggccatggtacaattatcaacatttaagaaattaatactggctgggcatggtggctcacgcctgtaatctcagcactttggggggccaaggctggcagatcacgaggtcaggagttcgagaccagcctggccaacatagtgaaaccccgtctctactaaaaatacaaaaaaattagctgagtttggtggcacgtgcctgtagtcccagctactcgggaggctgaggcaggagaatcgcttgaacccgggaggcgaaggttgcagtgagccgagaccacgccattgcactccagcctgggtgacagagtgagacttcatctcaaaaaagaaattaatattggagccaggtggtggtgcatgcctgtagtcccagctacttgggagaccaaggtgggaggatggcttgagccgtggagtttaagactagcttgagcaatatatcaagatcccatctctaaaataataataataataataaggccaggtacggtggctcacgcccataatcccagcactttgggaggctgaggcgggtggatcacgaggtcaggagatcgagaccatcctggctggcatggtgaaaccccatctctactaaaaatacaaaaaattagctggggtggtggcagacgcctgtagtcccagctacttaggaggctgaggcaggagaatggtgtgaacctgggaggcagagcttgcagtgagccgagatcatgccactgcactccagcctgggcgacagagcaagactctgtctcaaaaaaagaaaaaataataaaaatatactttattttaaaaagtaatattggtacaatactattatttaaactacagactttattcagattttcattgtcatttctctagtctcctacaatctgacaattccttagtctttctgtgtctttcatgactttgatgccttaatttttttttttaatttttaaacacttaaaaaatagagacaggatcttgccctgtcactctatttggagtggagtggtgcaatcatagctcattgtagcattgaactgctgggcttaagtgatcctcctgccttagcctcctgaatagctatgactataggagtgtgctgccgtgcctggctaatttttttcttattttttgtggagatgggatattgcagtgttacctaggctggtctcagaatgctgggctcaagtgatcctcccaccttgccctaccaaagtgctgggattacaggtgtgagccactgtgcctggcctgatgctttctaagagtacttgtttagatattttgtgtccctagatttgtctgatgattaggctgcagttatggatttttgggaagaataccgcagaggtgatgtgcccttctcatggtgtcctatcaggagctacctgatgtcagtatgtcctgttactggcaaagttaaccttaatcatttggttaaggtagcctctgccaggtttctccaccaagttactatttttccttttctgtactctgttaaggcaaattattgctttttaaattttgatgtacctcaatatgcatgggagatacatagctttgcagctccctcaatcttaattgtaataataatagtaataacaataactagcacttgctccgcctgcatagttctaaacacatgtgcccatttaatcctcatgacaccctgtgaagcaggcactttatgctcattttatagccgagaagactgaggtacagagtaccttgcccaaggcctaataactagtaagtgatggagccagatctttttttttttttttttttttttttgagacggagtcttgttctctcttgcccaggctagagtacagtgacatgatctcggctcactgcagcctccacatcccgggttcaagcaattctcctgtctcagccccccgagtagctgggactacaggcatgcaccaccacgcctggcttatttttgtattttcagtagagacagggtttgaccatgttggccaggctggtctcaaacacctgacctcaggtgatccacctacctctgcctcccagagtgctgggattacaggcatgagccactgcacccagcctggagccagctcttcacttcgcctgagttgaagggctgactttaacatgggccatatggttgtcgtcagagcttaggatggggacgctctcattctttgccagagaaaacaaatgcttcctatatttaatgcttctctcttgttttttctttaagacatttttttggtttgtttttccttccaggaatatatcttgtgtgactaaagattttagtaagctatatgtggcaatcataccatattaaaatcttggggagaaatccaagaaacttttggaaacattaaggatctatttttggtcttcttttcagaaataagactgaaggtagggcagaatattcagcatagaaaagtgctgtggtagaagaaatactcagtgagtgacactgcgcctttttctcctgggatgttatcagccacttctaccaggggtgtctctgtttgtctgtatgtgtctaaccctgccatgttcgcctttcttgaccacactaatgacttttctatgacacagtcaaatgtatctctgaatagcctgacttggggtaataactgtggtttacgtgatgacttggtctctgtgagccccctattctagtagcagtggagccactgaaggtcaggcagtgtgggtggacatttgtccatcttcctgtgactcactcagccgcctgcctttctgaggggaaagagctgcaggtgcaaagctctaatacatcccttcccttctctgtctaattctattatgtatattgcatatcccccaaatccttgaaattactcagctacgtgtcttattatatctagtctgccaagctgtctaggtatcagtacagtttttttctatgtctatatttattttccgaaaatgaaatcctactgtatttctttgtagcttcttttctcatttgacaatatagctgaagaagtttccatgtcatatggcatttatctacaatgttgtttgggtacctgcctattatcaatagcttggctatattatgattggtggggaatgtggcttgtttccctctatccctcttcagcatccaggacaggatgttcttgcagtcaccgaatgttaggaagctcagagtgctctcaggcatcatctgattaatcttttcttttgcacatagcatagttgaggataagtcagtgcaatttttaaaaataaagctttttttttttttaatgtctattgtatgtctggctggaagtgccagggtccacagcttaaacaagacactgcttatcttccaaagccttcccagagaggcatatacacacaaactgtaggatttatttccttaggaaggcaactgtttagaataagtctgatgctagcctacaatatatagaacactttacaaatgtagaaaattacttggggaattgataatagaggtcaggtttacaggtgtctggatctggcctcagaagtcagagggctaaggattagtctttttctcagatatggttttctacatattgattatagacaaaatataaagtagaagaaaatgtaaggaagaaagtgaaagtggcccatttctactgccagaaatagccactgttttattttggtataatttttcctttcctccctccgttctccttcctcttccatactgcaaatatgttcataatcctgcatttttcatgtaacactgtatcaaggatttttaaatgttacttacagaaaaggactttgctactttgataaggaaaaatatctagttttaatttgtattcccttaatattttagggaggattaacgttcgtttatgttgactgtctattcatgtttatccataattctacctttctataaaattggacatgttactaaagcaagcctctgatttcagatgtcctaaacgatgctatatttgatgaagatcatgatgagatggtgattgtgaaggacatagacatgttttccatgtgtgagcatcacttggttccatttgttggaaaggtaaggttctctttgttgtttcccagcaatttaaaacatagtgaaagtttttcaattagaataattatatttaaaatttttagctgccaattgctgatatctcaggtatttacaattatacatatatggttattctttattaacctgactaataacttgaaacttaaaaaacaaaaccaaagtagcagaaggctctcaggataagcctttcatgttaaataccaggttcataggttaaaataatgaggtttaagtagcatctctctctctcttttttttttttgtagctactacaggctctgaaaacctttaacctttatttatttattattagcatcccaatctagagatgccctttattttaacttgaataatgtttgatccaagatagatatgtatgtatggcatgtcatgagcaacaataattgcagaatttcttgtgacagaggttatggtatttgtggatttgtttccattcctttctatattaggaaaagtgaatctaatgcattagattcctcagcacctctgtgaatttcttttgtcagaaatgtttagtcctagtcttatgaaactttagatctaatctagtttacaggaaatccagaggctgaatggaacaaatccagaaggtggggcactctgctgaacagctggcctattctcttttcaatagagaatattatgggtgggagcactattttaggacaaaagggacttaagaggtataaccaaatgcagtgtaaatacaaatgtgtgactctccattggattcctgtttaaacaaaccaaaagtaaaacatttgagacaattggaggaatttaaatctgagttagttattagatgttgtctaggaatgactacttaacatacctttgagaacatgtggtatagaacaaagagttgtcccatttccctacccccatcataattttatttaattttgactctttattaataatctttaaacagaagacttacaagaagcagtgttatgaatacttatatacccatcaactaaagttaaagtgttaacatttgcttcatttttgtctttgttaaagtattgtatcttttcacttttttatggaaataatatatagatagaaaatgcataaaacttaagggtgttccttaccacttcagagatcaagaactagaataggctggcacggtggttcatgcctgtaatcccagcactttggaaggctgaggtaggtggattgcttgaacccaggagttcaagaccagcctgggcaacatggtgagaccccatctctaccaagataaaaataaaaattacctgggcatggtggtgcatgcctgtactgccagctactcgggaggctgagatgggaggatggcttgagtccaagaggcaggggttgcagtgagccgagattgcgccactatatcctagcctgggcaacagagccagactgccagaccctgtcaaacaaacaaacaaacaaacaacaacgaaacccccacaactacaatatgtgtagcatcctggaagctcacctcatttcttttctcttcttaatccctaatccatcctttgtatcagtttatcaacttataaccctatggattcgttttcttgtttttcaactatatgtaagtggaaagattctacgatatgtactctttgtgtctggcctctcttgttctacatagtcggattcattgatgtcattgcctgtcattgtagtttattttcattgttatatcttattccattgtacaaatataccacaatttatctattctgctcttggtggacctttgtattgttgcctcttttttttttttttttttttttgctattacaaacaatactgctgtcaatacttttttggagtacatgtgcatgcttttttttttttttttttttttttttgagacggagtctcgctctgtcgcccaggctagattgcagtggtgtgatctcggctcactgcaagctccacctcccgggttcacgccattctctcacctcagcctcctgagtagctgggactacaggcgcctgccaccatgctggctaattttgttgttgtatttttagtagagaaggggtttcacggtgttagccaggatggtcttgatctcctgacctcgtgatccgcccgccttggcctcccaaagtgctgggattacaggcgtgagccaccgcacctggccctaaaatattttcttacttatccacagcagcactatcacaaaattaacaataattcttaaatagtgtctaataacgaattcatatttaaatttctccaattgtctcaaatgtttactcttggtttgtttaaacaggaatccaagggagagtcacacatttgtatttacattgcatttggttatacctgttaagtcccttttgttctaaaatagtgctcccacccataacattctctactgaaaagaaaataggccagctgttcagcagagtgccccaccttccagatttgtttccttcagcctctggatttcctataaactagattagatctaaagtttcataagactagggctaaacatttctgataaaagtagttcgtaagggctgggcacggtggcttacgtcagtaatctcaacactttgggaggccaaggcaggtggtggatgtatcgctttgagctcaggagtttgagaccaacctaggcaacatggtaaaaccctgtctctaccaaaaaaaaaaaaaccaaccaaaaaaaaaaaaaacgaaaaccaatcaaccaaacagacaaacaaaaaaacaggcaaaaattagctagcatggtggcatgcacctgtggtctcagctactcgggagggtgaggttggagaatcgcttgaacccaggaggtcgaggctgcagtgagccgagatcacaccactgcactccagcctggcaagagagtgaatccgtgtccaaaaaaaaaaaaaaaaaaaaaaagagtagtgcttcataagggtgctgaagacttcatattatatcacatcagggccgagtgaggtggctcatgcctgtaatcccagcgacttgggaagtcaaggtgggaggatagcttcaggtcaatagttcaagaccagcaagtgagactgtctctaccacaaaataaatttttttttaaaattaattgggcatggtgggtgcatacctgtagtcctagctactttttgggagtctgaggcaggaagattgcttgagctcaggagtttcaggttacagtgaactatgatcatgccactgtaccccaacctgggtgacagaacaagaccttgtctctaaaaagaaaagaagagaaagcaatcagaaaacccagatacatcacatcagaagccatatcgtatctggaaatcctgcaattgataatgaaggaatctttgaaagggaatctattggtgagcaaattaggcacagaaagcctgtgacttgttcaagaggatagagagagttagtggcttggctgcagccagatccaaggcactgattctgtactcagcctgtcaccattttatcctgttactttctgctattacttcctcagtgtttgtgtttttgctacctttgttttaaaaatatattatttagtgattttttttttttttttgagacagtttcgctcttgttgcctaggctggagtgcagtggtgcgatctcggctcactgcaacctccgcctcccaggttcaagcaattcttctgcttcagcctctcgaatagctgggattacaggcacccgccaccacgcctggctaatttttgtatttttagtagagatggggtctcaccatgttggccaggctggtcttgaactcctgacctcaggcaatccacccaaaatgttggaattacaggtgtgagccaccactcctggcctatctagtgattttgtgaaatggacatttaaattacctaggatcttaagaccaaaaatagtataaacaatgaacaaattccgtgtctgcatggaaatgtaaaaatttcagacagcatagaagaccttggttcatgggaaagttttaactctctaatttttctttgaaatcctcaatgttcaggtgctattttactttttcctcctgccaaccaggaaggcaatgaggtggacttctcaaattcctaaagcatagtgccaatggatgggggaaaaaatcactaagtactactagatcaattatgtaaatagtaagtgaacaatgaaaacagtgttagcaaaccatgatgccgttgagtctctaattttatattcggttaattaattgcctacaagtgaccatttactctattaatcttttcagagaactaatgtttttcgtatgtagtatttggccccaaaagagtaacttttatatttgatattaattggtgccatttaagataacagaaatggcctggctgtatattgggtcctttaaaacttagttcttagggtgcaggttcttgccaagccatggtggtagcagtgccctttttctccagttaggaagatggggccgggcgtggtggctcacgcctgtaatcccaactctttgggaggccgaggcgggcagatcacaaggtcaggagatcgaaaccatcctggctaacacggtgaaacaccatctctactaaaaatacaaaaattagctgggtgtggtggcaggcgcctgtagtcccggctactcaggaggctaaggcaggggaattgcttgaaccttggaggcggagcttgcagtgagccaagattgggccactgtactccagcctgggcgacagagtgagactccatctcaaaaaaaaaaaaaaaaaaaaggaagatggtgcactctctagcagcttagaaaccaggaagccaagcacaaaagggtgtggagaccttctgtgctgcagggctttgcggtgggatcttaaggctgtgaggtgggatcttaaggctgctgtgatgtgtggaatggcaatacttatgcttacagtttttgccatttaaaggaggctttcctgtatacattttagtgttgctatgagatcatttgcctttccttgagaatgtttctcctccataaagaagaaactttcagatttgtgtcaagagttcaacttcacaggtaagtgtcagggccatgcaattgactcttgaacaacatgaatttgaactgcatgggtccacttagacatggctctttttcaagcaaacactgatcaaaaattctacagtatttgcaggatacaaaacctgtatagatggaggggcaacttttcatatatgcaggttctgcagggccgactgcgggacttgagtatgcaggatttgggtatacacaggggtcctggaagcaatctcccgcatttaccaacggacaactgtacaagtttgttatttgattaatagactcatacttatatattttgcttttactgcatttatgtaattttaaaaatacatatataaatgtttcattttctaagtcttaacagttccagatgttttcaaggtaatacattgtcgtgataaattacataaaagtgtactatattctttctatatttccttattttgtcacaaagaaggcactgtattttcactcagctaatgatttccgtctcttctctgaaggtccatattggttatcttcctaacaagcaagtccttggcctcagcaaacttgcgaggtaagtgtgactgtgcagtgaacaagaatacaggtttataggacctgccctcatctgctgagaatctatctcatcaggctttctctctttacctgtatggatctaacttggaagtcatattgcaacttaaagacttggagggtctgaaacacagatgccccttccttctcgtcccctactgcctgcttcctcttccacttcccaccctttcttccatagatacatacatcctggaagtctcagcccacctctttctctgcagagccttctctgactggagaggtcctgagcttaccttcagtccagccccatcctttaaggggggtttagctaacagtgaggggttggggaagaagctgggcaggggtctagctgcagtgctctgctgtcgaacttgttgtcaggcctgaggactcttctatccttgtcaaggggagtgctcaccttctttgctttcatacaacactgctttcagacttgtaatgaaacttccctgtgggatccccagcctcaaccctgccttgctctgcactggatgcctccaggcatatctcaggggtcctgcaggccagtccgttcatgtctaggttctttgtttctgcaaacacaagactgcctgccttggctttgcacagctttattctgatacagtgttcacgctcctcgctctcatttctctttcctgctacaatcttcttttctgttgtttatcctgtgggttcatgccttaaaaaattcccttactgccttttttatttgggttttaggagaggtgatgtacatacacgttcatctgtgtttaactggaagtcaacatgggggtttgtgttcagatatctctggtaggccccagccaccaatattttattgcccttaaatatccttgttgtttcttcgtataaagttagtgaattttgagtgatggaggaaatactgggaggtgtgtgtgtgtgtggagagagagagaaagttaagaacaagatgaaggggtcgggtaaagtgttcctactctttttttttttcaaaaataatcaagctaagtttgaataacttgaggttatagtgaccatatcataattgaaataaatgagtctcggccgggtgccgtctttcacacttgtaatcccagcactttgggaggctgaggcgggcggatcacttgaggtcaggagtttgagaccagcctcaccaacatggtgaaaccccatctctactaaaaatacaaagattagctgggcgtggtggcgcacacctgtaatcccagctaatcaggaggctgaggcaggagaattacttgaacccgggaggcagagcttgcagtgagccgagattgtgccattgcactccagcctgggcgatggagtaagaccctatctcaaaaaaataaaaataaaagaagaggaataaatgagtctctgtgaccagttgactgtgctgtggctctgatgtgttcctgtttctttatgcaggccctgggatttaacacagttgtgaaatggtggtcctgatatttctcaattctgtgttggaatctgtaaaaaaaaaactactccagcaatctgacaactgccctctaaagttgttcctgttactttgttttcacttccactttctcattcatttcctctggggatcaataagaaagtgggtagaagagacaaatttaacttccccagtttctgacctcattcctgctcagctattttgctattagatagggctgcttggcaccatgaaagaatattatatcatagctgtaattgcttcactggaataaggctcttagcacaaatccagaaacattctggctgcttgcgtgtgatccatccctggtggcagtgctgaaaagttgctgagaaaaagtgtgttggtagtgattgggagtaattaatcttactataatttttattaacgactcccttcccagtaacttaccctcaactaatgatgtattaaaccaatttcatgtcaactgtgagtaaaagtatctttactaaaattggttattcttatggttttataatatacagtctaagtaaaatcagcatgcttactgtgcaaacatagctgtaggcccagtcccctgggcctccctgtcagcaagattgctaaccctataccttgcccatatagaaattccagcactgctgatgcctataacagactgtccatatgtgaaaggtgtaatggatagtttcatagtgtaaaaaagcttggcagatcacattaggccttggtcttaatgtaacagccttctctgaaaaaccaactgttgatcatgattaacactttatgggaaatggactcttgagtgattcagtgagatcatacaataaatggcaacctggtggtagaaggaaataatcttagttatttcctttccaagtgaaaggaaaagatctcaaataattaagcttttatgaaacaatacaaaggagttgattattagcatggggatttgtccttagactaataggattaaaatttaagaataaaatggaacatgaagccaaagaaccaagtgtatgttgctttcaaatattttgcaaaaaatttgaataaagagtctattaaatagaaaagaagactaagattttatccaactacttattccttataagaagtaagaatatttagagaatgaagaggaataaaagctgaatgtcttagcaaaacttcactgctcattttaatcttatatatgaagtttgttatatgcttgcctttaaatgaatgacctttcagtgccagtgaagtcaaatatcaagcagtaaagccttaagtaacaagaaaatgccagaagtgagttgatctggctcaactctagtagaattctagaataaacttagtttgaatagaactttcttttgttgctgaaaagccattgaacatgtattcattttcttcccttagaaataactgagcctcggctgggtgaggtggctcatgcctgtaatctcagcactttgggaggccgaggtgggcagatcacttgaggtcaggagttccagaccagcctggccaacatggtgaaaccccatctctactaaaaataccaaaattagcagggcatggtagcatgcgcctgtaatcccagctacttcggaggctgagatggaagaatcgcttgaacctgggaggcggaggttgcagtgagccgagatttcaccactgcactccagtctcgtgacagagcaagactctgtgtcactaaaaataaataaataaataaataattgagtgaatgtacgaaatcttgaatttagagttgtagtatctcaggtagccatggctgacctgttgggtgggcactgtgccagctactgtggaggctaaagaagcaggacatggcagccaccctcaaggagagtgcacagggcaagactgcaagtgccatggaaatgcctgctgtagctccaagttcagaggagccatgatggctgtggcctggcaggtgaatagacctggaggtggagggatgagcagaattctaaatgggggagaagtttctctaggtatagttaatgcatgagcaaagaccagtcagagggtaggagcaaggcctattccagtggatgggaaccagattgactgatggaagtaagagtaagtgaggtgagtattagattacagagggagcagtatttttttttcttttttgactataaaagcaacataccatttaaatacaaatgagtgaataaagtgaaaacttttcttacctattttcattccccagagttagaactagagatttctttcactatccttctggaaaatatttatgcaagcacaaacataagatcatatcttatattctgtactacaacttgctttttaaaattttattttatttggtgtttttttgagatggagtcttgctttgtcggccaggctggagtgcagtggtgcgattttggctcactgcaacctctgcctcctgggttcaagtgattctcctgcctcagcctccccagtagctgggattactgatgtgcaccaccatgcctggctaatttttgtattttcagtaaagacagggtttctccatgttggccaagctggcctcgaactcctggcctcaagtgatcagcctgccttggcctcccaaatgctgggattacaggcatgagtcactgcacccggccagcttttttttttttttttttttttttgagacagggtctttctctgtcgcccaggctggagtgcagtggcactatctgggctcactgcagcctccacctcctgggttcaagcgattctcctgcctcagcctcctgagtagctgggattacaggcgtgtaccaccacgcatagctaatttttgtatttttagtagagatggggtttcaacatgttggcaagactggtcttgaactcctaacctcaggtgatctgctcaccccagcctcccaaagtgctgggattacgggagtgagccaccgcgcctggccctggccagctttttaaaaatttaaaataccttgaagttctttggacatcttttagtccaaaaagtccaagtttcttttcatagctacctaatatttctttgattaatacaattcatttaaccagtatttgctatagataagtacagtttgcagtttgagacttgccaaaaagtaaaaaagtaccctggtgaacaaattttattatctttgtgtgctttgaatctatctgaagtttaaattactagtatggaacttgatgggtaaagggtagccgaatttttgatattatgaaattgctctccaaagagaccatgccagtttatactctaataaatagatacataggtaaggggtggtgtatgtttctccacacttcggccaacacacttttcatcacacttttaaatctttgccaaactgataagtaaaaaatagtatctattttaatttgcatttccttaatagagcgaggttgaatctattcagacacttcctgttcttagctccagtattaatttttccactgagttatttgtctttttattcttggtttgcacaagctctgaatgttaaagcagtcaggtcaggtgctacagacaatgcttcccagctcgtcatttgtcttttgattttgctttatagtattatatttccataaagaagtttaaaacttttctgtagttcacaaacttcttttttttttggtacttgtatggccacattattatatttaaatctttgctccatctggagtgtattttggggtgaggagtgaggcagaacccatccactgctgcgtgtgctcactgcccggcaggtgcagcacccccacttcctgccttcctgccctccctgctgcaggtctttgctgggcctttcttatcttcctcctggagggaatgttaagctcctgcctcctccctgcctctcatctctgaggatccttcagtttgccctcatgagctgctgggatgttctttctaaagtgtggattggatcatgctgctcctttggtggctcaccacagcttttcagttaaagtccaaactccttatttagaataatttagaaaaagccaaagaacagaaatcacaaatctacaagttgaaaatcttgtatcataggttgctggggagtctgatatctaggaatgagacgatatgtaactaaaaatatgctttataaatctttacatcttgatgaatacgttttttaaaaagatggggagagaaaggaatggaccaagagtttgaaagcctgcatacattaataaccattagaaaaggtcaaattaatgatttgggggaaagtgcctggacccagtcagttttataagtgttctttcaagctttcaagtaaccacaaattttgcatgtgtataaataattcaagagcgtagagaaacctgtgaagtgtcaattaatttgatgaagctgcctattcttgataacaaagcctgataagcctagcattaaaaaaaaaaaatgataggcaaatctcactgattaatgtagttgtaagaatcttaaaatgtcaggctagtatagaagtactgttttcaacatgacccagggatgtttagtccaagaatgtaagaatggtttagattaaaactgacaactactgatgctgggtgtggtgaactagattaataatgcccctcttggcacagcgtatcaagatataatgcatatgtacattttacactttcgggaaagcatgaggcaattctagtgagaatccactggaattagcactaaagccacagtctggattctgtcctcccttttcccatcccaaatcaaggacgatacttacctattagcattattctaggaagagcaggaaaaagaaaaaggaactcatagacacattcataaagtttgggatcagaattagtactacctgtgtggccttcaaaaaatcaaatggaataatttagtttcaaacgaccccataaggccaggcatggtggatcatgcctataatctcagcactttgggaggccaaggcaggtgggtcacctgaggtcagcagtttgagaccagcctgaccagcatggtgaaaccccatctctactaaaaatacaaaaattagctgggcatggtggcacacgcctgtagtcccagctactcaggaggctgaggcaggagaattgcttgaacccgggaggtagaggttgcagtgagctgagatcgcaccattgcactccagcctgggcaagagcaaaaactctgtctcaaaaataaataaataaaaataaataaaacatccccatagaggtatccttgcaggcagctagcagaaactagtgcatgttctctgatgcacttttatccaggcttggaaggatacccaaagatgaagttccaaggagtaccatgagtcgagtcagacaaacacgatggaagagggcagatagtagaactatcagagataggatataaaacaagtacagtaagtcctcactttacgttgtcgatgggttcttggagactgcaacttgaagcgaaatgacttcaggcaaagtggcatataacagtcctggaataatgttgtttcattcaatgtcatttcagtatgattgagaaaaaaaaattccttgctgggacccactgtctgtgtggagtttgcatgttttctcccacatctgtgagtttcctccaggtgcttctgtttcctcccacatcccaaagatgcacacgttaggtgatttggcgtatctgatctgagtggtcccagtctgagtgagagtaggtggatgtgtgtgccctgtgatgggatagtgtcctgtccagggtcagttcctgccttgtaccctgaactgctgggaaaagctccagccacttgagaccttgaactggaataattggggaaatcaatatctttccattaatctttcttaaatgtatgtatcactcacatttattttagtgtttaatattagaagtgtttttgtgtttatttggaagtttgttgacgtttttgtgaccagaaatatgctatgggagcttaattcttattatatcaattagcctagggtaaaatttgttttgttctcagtgttttagtaaagtcatagattccgagaacctgtcgaccttgagcaaggacttactatatattaaaaaataggctgggtgcagtggctcacgcctgtaatctcagcactttgggaggccaaggcgggcagatcacctgaggtcagtagttcgagaccagcctggccaacatggtgaaacaccatctctactaaaaatacaaaaattactattgtgagtagtgctgcaataaacatatgtgtgcatgtgtctttatagcagcatgatttataatcctttggttatatacccagtaatgggatggctgggtcaaatggtatttctagttctagatccctgaggaatcgccacaccgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgaggagcattttttcgtgtgtctgttggctgcataaatgtcttcttttgagaagtgtctgttcatatccttcacccactttttgatggggttgtttgatattttcttgtaaatttgttaaagttgctttgtagattcctggatattagccctttgtcagatgggtagatcataaaaattttctcccattgctgtaggttgcctgttcactgtgatggtagtttcttttgctgtgcagaagctctttagtttaattagatcccatttgtcaattttggcttttgttgccattgcttttggtgttttagtcatgaagtccttgcccatgcctatgtcctgaatggtattgtctaggttttcttctagggtttttatggttttaggtctaacatttaagtgtttaatccatctggaattaatttttgtataaggtgtaaggaagggatccagtttcagctttctacatatggctaggcagttttcccagcaccatttatgttttccccatttcttgtttttgtcatgtttgtcaaagatcagatggctgtagatgtgtggtattatttctgagggctctgttctgttccattggtctatatctctgttttggtaccagcaccatgctgttttggttactgtagccttgtagtatagtttgaagtcaggtagcgtgatgcctccagcacatgcacacgtatgtttattgtggcactattcacaatagcaaagacttggaaccaacccaaatgtccatcagtgatagactggattaagaaaatgtggcacttatacaccatggaatactatgcagccataacaaaagatgagttcatgtcctttgtagggacatggatgaagctggaaaccatcattctgagcaaactatcgcaaggacagaaaaccaaaccctgcatgttctcactcataggtgacaattgaacaatgagaacacttggacacagggtaggaaacacacaccggggcctgtcgtggggagcagggagggatagcattaggagatatacctaatgtaaatgatgagttaacgagtgcagcacaccaacgtggcacttacatacatatgtaacaaacctgcacgttgtgcacatgtaccctagaacttaaagtataataataattaaaaaaaaaaacaaattagctggatgtggtggcgggtgccgctaatcccagctacttgggaggctgaggcaggagaaatgcttgaacctgggaggcagaggttgcagtgagctgagattgtgccattgcactccagcctgggtgacaagagggagactctgtctcgggggaaaaaaaaaaaaaaaaaaagaacctacttatatataaaaaaattgacaaaggagatcgggcgtggtggctcacacctttaatcccagcactttgggaggccaaggcaggcggatcatgaggtcaggagttcaagaccggcctggccaacatggtgaaaccctgtctctactaaaaatacaaaaattagctgggtgtggtggcaggcacctgtaatcgcagctacttgggaacctgaggtagagaattgcttgaatgcgggaggtggaggttccaatgagctaagattgtgctgctgcactccagcctgggcaacagagcaagactccgtgccaaaaaacaaacaaaaaaaaattgacaaagggataagaaacttgcagaattagccaggcagattgggaagaggaggaaatataacttttagaaattaaaaaaatgaaactgaagtccagtatactcattaaatagattagacatagattaaatacggtgattgggaagaaaggtctaaagaaattgtgctgaatgcagcgcaaagacaggtagaaaatatgaatgagaatttaagaaacatggaagactgggagggtataatatgcccttaattgaaattcctggagataacagaggcaatgtgctagatgcaacgttagagaagataatggctaaaaaagtttctagaacacatgcaaaatatcggtcttcagaaagcctaataaattccaaataagtcaaattaaatccctacttggattaaaacatagtaaattgcagtatatacttataaaatatagttaatataaaagcagccaaagaaagaaatatcgattatctaaaaggcaacagcagttacactgaattggtttgccaacagcaatactgaagggcaagatagatatcagtgtcaaactagaattcggttcccagcaaatacctctcaacaaattatctttccagaatgacagcaaaataaagatttttttttttaatctagggaagctacatgacatgctgaaaagatgtgttaggtttcatatttactcctcacttgtaaaagaaaactaataaactagggtttagaaataataagctctcagagcacagagagcatgttcaccatataatcacatacatagcaggcactcagtaaaaatctatgggaatgttcctcctgccatgagagcagctgtctgccagaagcaggcaggcactgtgggtggtagtgaaatcctagaggcattcctattgaagtgtggagcaaaacatggttgcccagtgttaccactattgtccaatgtggcacctgaagttctactccagaaaaagaatggtgaatacgagaaggaaaacattactaactttaaaatcaatggcatctcctacatatataacaaactaatcacctgaaaaactatcagaagtaatatatacagaaatttgacctagtaagaaatatgacatacctcctatctaggagcttaaaaaccattcctttctaaggttttgttcaaaataccaatagaatatagctattaatatatttcttcaatatcctagtaactactgctgggataaaggagagctaggatggcttctgccctcagggagctctgggctgagtggtaaacggggtggcggacctgttactgactttgttggctgtaatgggtataaaggagcaagttgttggttctgagacgtgtagttgggggaagagccaggaaatgcctcatagggaggtgaaccataaattgaatctgaattcatgatcaaaaggccatgaatttaaagaaaaggtcctcagtgtgaatagtcatcttcaaatggataagtcacgtggtcatctttatatttcataaatagaatgaaagatgttgaaaggggaaaattctggctgggcacaggggctcacgcctgtaatcctagcattttgggagactgtggtgggcagatcacgaggtcagaagttcgagaccagcctggccaacatggtgaaaccctgtctctactaaaaatacaaaaattagccgagcatggtgacgggtgcctatagtcccagctactcaggaagctgaggcaggagaatcgcttgaacccaggaggcagaggttgcagtgagctgagatcatgccattgcactccagcctggatggcaagaacaagactccatctcaaaaaaaaaaaaaaaaagaggaaaatttatcacttgacagattgtgctataagttaagatcaggaggcttttatttcttgggggttaatcttactaagtgcttacataaacctatcttatgaagaggtgtctgaagaagtctaatcagttccaatctgattctcctaataggtttagttggtatagtagttgaccgtggtgtgctattaattaacaaagtctttttatttttaacttgaattttaagctctgataaaacaatatgattaatcagagcacttgagacatgatctaaaattgatgatttggaactttaaaattttgttactcatctctgtttttcctaagtgaacgtcacagttggagactcattaattctctttctggggacatcaggaagcaccactctgcagtggttggtggtcttctgtattagtaagggttccctagagggacagaactaataggagatatatatatatatataaaggggagtttattaagtattgacttacatgatcgcagggtcccacaataggctgtctgcaagcttgaggagcaaggagagccagtctgagtctcaaaactgaagaacttggagttcgatgtttgagggcaggaagcagccagcattggagaaagatgtaggctgggagtcaaggccactcttgccttttcatatatttctgcctgctttgtattcgctggcagctgatgagattgtgcccacccagattaagtgtgggtctgcctttcccagcccactgactcaaatgttaatctcctttggcaacaccctcacaggcatacccaggaacaatactttgcatccttcaatccaatcaagttgactttagactacatctccctgtggtacttgtatctttctgtcatcttgccataagctttatttcctcttgcagcccacttgcttcaacaatgtcctttttgttttatgaggaaggcttatcaattttacttcaaatgatttgtgattaactaaaacaattctttcttttctaggattgtagaaatctatagtagaagactacaaggtaagctttaaaaatctgtattaacagaaaacatttttcttttttttctttttttaaatttttatttttgagacagagtcttgctctgtcacccaggctggagtgcagtggtgcaatctcggctcactgcagcctcagccttccaagtagctgagattataagagtgcatcaccatgccttggctaatttttgtatttctagtagagacggggtttcaccatattgatcaggctggtctcgaacttccgacctcaggtgatctgcccaccttggcctcccaaagtgctgggattacaggcatgagccactgtgcctggctacagaaaacatttttcctacacaaaaagtattttttgttttattactagtgcgataagtatgacttataaaaatgtaaaacctcttaggactataaaaagtctactgtttcaagcttccagaagaaatcactgttgtatttgcacattccttcacattttcatgcatatacctgcattttcaaatcaatttatttggattatgtttaaacaaaaatgggctcattttatacataatcagccttgcttttttccctgctttttttcatttaacaaatcttaaacatttttgccacatccatgtaactatctcattcattctggtggctgtctagaatcctaccgtatatgccatggcttggcgtaacctataccagctctgatagatactggggggtttcatcagttttcaaatagatgcagtgctgcaatgaatattcctgtatgaattaaaagacaagtcattttattcaggacaggaactatattatttaggttaaattgttggttttcaacattgctctaagcacaattcaataattggactgcagcccctttgttaaccctgttgcaggctatttatttgctgcactactttacctccatggaggtgcttggtaaccagtactgtgttgttctaactgcacaggtatgagataattgctattctaattccttcccgcagtgatgctggagggcttcagggtgttctgagatctctttagccctgtacttcaggtgagggagttgaatccgggcctctctgtggcccagtcagcagacaaagcagtctggtaaaagctggtgtgtcttggctcttaaatctcacagaagtctgatttttaagatttcaaatgttctagagacagaaaaagcttccagctgtttgtgtcagactctcaaactgagctccttatcacatccacagttcaggagcgccttacaaaacaaattgctgtagcaatcacggaagccttgcggcctgctggagtcggggtagtggttgaagcaacgtaagtctgcatctgcctttagtaacgtcataatggtgcactagaagtgatcttgctatttagtgcttctcatattttgtagcaccaggtgatgccacacaactgatatgataactgtagatttccatccctgagcctaaagctcttttaccactttcatttactgttactgatataggaacagaatatgggagaagtattttttgagggtaggatggggcttgtggaggcatagggagttaaaagcacaggtgtagagatttgcataatcaatagccttttttttttttgagatggagcctcactctgtcgcccaggctggagtgcagtggtgcaatctcggctcactgcaacctccacctcccgggttcaagcgattctcctgcctcagcctcccgagtagctgggaccacaggtgtgtgtcaccatgcccggctaatttttgtatatttaatagagatggggtttcatcatgtcggccaggctggtctcgaactcctgacctcatgatccacccgtcacggcctcccaaagtgctaggattacaggcgtgagcccctgcgcccagctcaatcgccattttttaaaaatgctcaagacagggtcttgctctctcacccaggctggagtgcaatggtgtgatcttggctcactgcaacctctgcctcccaggttcaagcgattctcctgcctcagcctcccaaatagctgggattacaggtgcccgccaccacacccagctaattttcgtatttagtagagatgggatttcaccatgttggccaggctggggatctcaaactcctgacctcaagtgatctgcccacctcagcctcccaaaatactgagattactggcgtgagccaccacgccaatagccatttttatgtcttctcttgattttatgtcttctcttgatttcttctttagctctctgttgctccaagccgagtttttctaatattttgtcacacatttaaaaaataaagccaagaattggtacatttctttaagttaggatgagttaagagaattgcagctgttgtgtggacaaagttcatatgtgttctgtgacgtggtgtgaactctgttctatgtctggtatctaatgtcaccaggttgctcagacaggatctctggtcaccattatctgaattctgcctggtgacatcagtatacttgagcatttatctgaacacctaggctagcatagtgctgtcttggtcctgaaggcagagcaagtgagaattctgactttcttttgatctagaagttaagtaactctgtagaccttttatattactttcaccccagaagaaaattccatttttcccctttttggatgctttaaggatcaactactgataaaaataaaagttgcaagacaacttcaagaacaaaaagtttaggttgctgcaaagataattgcagtttttgccattatgttcaatagcaagaaccgcagttacttttgcatgaacctaatagataacatttgtgtaagaagggatatttcgatatacttggtaactgtgagctgagatttaatctttaggcctgcttttaaaaaccaaaccagcagctgtctactcctttaaacaacctgtgttgccttattttgtagacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgttcttgtgaaagttgtttctttttcaaccaccactataaatatttaaataacttgattattttggctgtattctgtttcagcaaagacatcataagggcttctcccagccatcaaagctatttgaatactaatctccattatagtacgaagtaaccccaggttctgacagtttctccttggtatttggttggagtcttaccgtcctcactgtcttgaggtaatgggaggaggaggtctgggataagagtcaggaatctgagtggccctcatgtccctgttgtcttaatgcttagtaggtaacttcagccccctgggaactggcactgtttcctacgtgggagctgttggggaaggaagagtaggctggggcagggagtggaaaagggtttccttccctcttctaggaagagcctgcccagggcaaaacttccagttagtgcaaggggttttgtgctgctcttctgtcccatgcccaacaacctcctttccctcttgctaatggtctcctccccattccgtgctgcccacaggcagaggccgcccctgccctcactggtggccagcatgtccaagtactggggcctgctgctccttgtgggaccctgtggaccgttgggtagcaaatcttatcaaagtaggaatgcttactggcataaaacattcctagaaccaccactcataggtgtcaataaaacgatgagctgctcagctaagcccgagttgctgcttctgagttttgtcaccgaagattgattggccaagttccttttcacttagtggaagagcagttgcagacatgaaaggttttcaagaagcctttctgtcaaaacagagcacctggattcatcatcacaggcatgggtcctcctgctgatggagagaagaagaagtctcaagagatcaaggggaagtgtgagtacctgactcctcaccctcccagaggcccttgccttcttttaatttttgttacagaaaatgaaacatgcacatcagtagagagatgagcacatgaacccctgtgtactaatcacccagcttcaagaagtctcaactcaatggcgccatcttgttttcctctatacccatctgaccagattattgcaaagcaaatcccaggcattatttcatccataaatatttcagattatctaaataaagtggaatcaggtaaagaaatatatgatcaaatacatccattatcacactaaaaattagtgtcaattcaaatatctagattttcccctactgttgtgtagtttttagtagtttatttgaatcaaggtacaaacgagatccacacattgcaacaggttgatttaagtctcttaagaatcttatatgttctctttccactccctcctctgttttccttaaaatttatctggtcacttgttttggagaagccccgtgtttattccaggaactgtctggttgctggaatgtctgtggctgtccaaatgaggtcaaactccagctaaacagggaaaagaagggttctttgccacaacacttctccacgtccctaaacccctactcctgggcagcctagcttggtctggttctgtctggcttttaactggaacatagctctccttggctttgtaacttagagccattccccaggtacagaatagaattcattgcttttttctgagtgtgtcctttttgggcaaggcttccattttaaaacatgctgcctttggcttcagcttggtggattccttggctgccaagattttggttaaggtggaaaggttattacagaagtgaaaacaatgaatctcacagtaattggcatcactttgagggcctacccatggggaattccattgggttggacagtaggagtacttgggtttcttccccccggctcctcgacctcatcaattacattttcatgacatcctgagtatgaatatcaggctctggccgacaaagggtggtgaaggaagacacactgcgtcttgcatttaagcagctccctttattccctcccta

SEQ ID NO: 11768 - DNA, 77618 bp, Human
  misc_feature (1)...(77618): n = A,T,C or G
agtgaggaagagctgtaatatatagtttttggcatattaagtctttctcactaactgtaaagttatatttttgtgggattttcaaggttattttcctggcattgtgctttctctccattatctgaagtttcgcctttcctggcattgtgctttctctccattatctgaagtttctcctttgacaagaagcagaaagaatgatagaagtagagatttggtatatttttctctcaatctcatcttcttactactcacacatgcagaatctggaacaagccccatatctaagagtaataagaagatgactcccactttaggataagaaaatggatactcaaggagcttgcctaaggtcatagccttgacacaaaagcagaaccagatctcaaggccatgccttctgagtctgaatctggcactctttctttctgttcccaccaatcactatatttatttgaaggtaatctttttatttatttatttatttttactttttatttttatttatttttttttttttgagatggagtttcgttcttcttgcccaggctggagtgcaatggcgcgatctcggctcactgcaacctccgcctcccaagttcaagctattctcctgccttagcctcccgagtagctgggattataggcatgcgccaccacgcccagctaattttgtatttttagtagagacggagtttctccatgttggtcaggctggtctcaaactcctgacctcaggtgatctgcccgccttggcctcccaaagtgctgggattacaggcgtgagccaccactcctggccaaggtaatcttttaaatattaaaaaatctacctgccaattatacgtattcatgaacaaaattaaatatgcctcaaaagctgaattaatactaacaattataacacaagcttagccaatggctattgtgttacctataatgtttcatgtgctttaaacacatgatatcatttaatccacatatagatcctattattcccattttatagatcaagaaactgagaattaaagaaaaaaatttatgcaacagcacacaactagtaagtgggagatgcaatatttgcacccagatccatgtcattccttagccagggttcttaacctgtgtactgtactacctcctgtatggaaaagatttccatataactggcaagaggctacatttaattgctattttcttgaggatttcctaattatctcatcgattttaacttcagtggttaagttcttcctttgtgaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagtgcttgtaatcccagctactcagaaggctgaggcatgaaaattgcttgaacctgggaggtggaggctgcagtgagccgagattgcatcactgcactccaacctgggtgacagagagactgcctcaaaaaaaaaaaagatggaaattttagaatttccctagatagaggggattttgaagcaacagaagtagatgaaattaccaagaaaaaatatacaagtagaggagatatttacacaagtagaagtagcaggcacggggatggagaagtcagaaaaacaatgcagttattcattttatatatatatatatatatatgagatagggtcttgctctgtcacttaggctggagtgcagtagtgagatcccagcatactgcaaccttgacctcctgggctcaagtgatcctcccctctcagcctcctgagtagctgatactacaggtgcatgccaccacactcagctaatttttaaattttttgtagagatagggtcttactatattgcccaggctgtgtcaacttcctgggctcaagcaatcctcctgcctcagcctcccaaactactgggattataggcatgagccactgcacctagcctgaaattattcattagtgtggaaatccagggtagacatatttatgagggaggcatggtcagtagcgcaaaacattactaagaggtcatggaggctgagtaccaagaatggaccattatacatagaaattaggtcttcgtttggtgactttttttttttttgagatggagtctcgctctgtcaccaggctggagtgcagtggcatgatctcaactcactgcaacctctgcctcccaggttcaagcagttctcctgcctcagccccccgagtagctgggactacaggcgcccgccaccacacccagctaatttttgtatttttagtagagacggggtttcaccatgttggccaggatggtctcgatctcttgacctcatgatctgcccacctcagcctcccaaagtgctgggattacaggcgtgagccaccgcgcccagccgttttgtgactttcaagagtgaagttgtactagaatgctcaagatagaagcctggttgcaaatggtcaaaagagatgtaagcaggtaggaaatcgaagacatgtgctttgcaaaaatacaaccatccaggaatggtgagagaaggacatagtttgtgaggttaacaggattatgtaacattttgggaattttgtttgattttgtttgtaagttatggtaagaccagagaatgtttctttggagtctgagcggagaacagatgaaagttgtaaaataaatgggggataagtgatggacaagaccaagtaagaggttagagagattgggattgaaaatttagttaatttctcccaacctcagcagggagaaaatgacagtcagctcagaattcaatgaaaagcccatctctgtttcagagtgggggaagaaattatggatgattctaatttttctttcagcttagctgtattttccaatttttctagaatgtaaaaattatttgaacattaaattttatttttctgaaagagcacatgagatagctgtctcatttgtccagtagtgctgactgggtgtgacagagttttttacctccctcacagcttcctctggggtcaacccccctgcccctatgcgccatcttcgtcacacctctctgggctgctcagtcctgatctgatagtcatgaaggagagcaagcaacgtttacctttgtagaagttagaaaagtgagacatctttctgctatgtttgaacacagtacagtgttctgtgagtacaatgtacaatgaggaaggcgaggtagatcatgtaaatgctgaaagctccatatgtgcttgatgactgggaagaaagaacaataaaatttaagaggaaaatacttgcctgtgtactgctttaaaagctgtggcctaagtatagcaaagaagtctcttcatatttgctaatactcattaattgcttattaagtatactcacttaagaattcacttttattaagtaccttcagtcttctcatcagttttgcactaagacgcgtacgctactgttcagtatagtgtttatatggatgctaaattggtacagatttctcctttaaaaagcatgaaatagataattaacttccatttttatgaatatttatcacagtagattaacttgaaacatgtagctttttcagtgtgcggcaataaaacggtatagtgattttgtgttttagtttgtaaatgtattacctgtacctagtgttatttgacaagtatctttacaaaattagatattagtcccatgctccttgaatttgtcacctgctcatcaagcaggccaagaatatatttgggtgagaagagatagactatcctaggctaatccttatggtaacaatggtacctggaaaaatgtcggaaaacaatttcccttggttttgtgtttgttgcacaatcaaaatgcagctgatgggatctgttgagttagtgctgactggtggtagcttcttctgggatccttctgccagctcctggactgagcactgtcccatctttcagttgctggaatgtcaccagcacagttagaaccctggtggtgcagggcacagcagcaaggcccacggggaaggaatgcccagcttgggcagagccaagcaagggtgactgtagcaaccttgttaccccaagcttaactgttcctctgtgacccttactggtatcactttgggccacttatctgcctggcacatgtcaaaactacctattaatgtccaagggccagacttgctgcagaatccaaagtttatattgataaggctgccacaaaataaattcagttcttctgtatcagccatgttacattctggctctgattatcaaaggtagaccttaaattgccttccgttccatgccactcttgtcctagctttccaactacaccctcccacactctgtatccagcctccccaccctgccagaaggtagtggtgtttctcattttatgactgtattaatgatagagctaagctggctgtcagtcatgatgcttcactccacatggattagtagtaacataactatgacagaacttagaatttgttgtaattcagtggtattttataaacacagccctggcctaggactgactaaacactaaatactatatctgcatttttctattaagattgcaatggccaggcacagtggcttaaacgtctgtaatcccagcactttgggaggctgaggtgggtggatcacgaagtcaggagatcaaggccatcctgactaacacggtgaaaccccgtctctactaaaaatagaaaaaattagctgggcgtggtggcacatgcctgtagtcccagctacttgggaggctgaggcaggagaatcgcttgaactcgggaggcggaggttgcaatgagccaagatcgcgccactgcactccagcctggtgacagagcaagactccatctcaaaaaaaaaaaaaaaaagattgcactaagtacattttcttctaggctgatttctaaaacattattccaggaagatatatgatttttgttaactttaggaacttttataaaactataatgacttttttggactaaattatatgtcagttttgatcatttgtgttattaatgtttcattatttgctttcaataaaattgtcttactattcattctcccttcaaccataggtatggaacaggatgtttcttactatgtaatacaggccataaggttggttttttaaattaaaaaattgatttaaaagtctaagttcatctaaataatgcttgaacataatttactattaaacaacttttagtctttagcttttacttaatctttatcagggtttaatttagagctcaatacaaaatttgaatcgttctaataagaaccattttagactctttgaattttatatgtgtgtttttaattgtgctggtgggaaatctagactgagacctcatcaaattcttaatgcaaatctaatttgaaacaaggaataaactttttatacagcttaaatgtgttcttaattctgatcgttttgactgtaaggatttattttaaaaattggtttattgattgcattattttgtacctatgttattttaactttaaaaaaaagttctcatgttatcttttcattttccactactgaaatcttttttttttctttcttacagtgtgtattttctgatcatggccttctcaccacagtggcttacaaacttggcagagacaaaccagtatattatgctttggaagtaagttctttttaatcaatatggataatatgacaaacattcaaagctaataaaaattacagtgttttctaacacttttctggtaaatcttaatacagaggactcaaaaagttctgctttcttggcatttgattgagttgaaggaacctgaaactgatctgggtgtcaggactcacaggagaccttgattagattggttcctcagttcttatgccaattaatcatgtcaccttaggcatattacttgagagctctacaatgtaaggttttttttttttttatctctaaagtttaatcggattaacgtgctctctaacatttctttcatcttgaaaattctttgattttataaataaaatgctccagtgttccaaagagaaccctgggcacaaataggcagaacaactctcttcacttgtctcctcataaaaataaattttgtgtaacattttgatatagaaaagaaagtgaggagatttatgccacttatcactggaaacatttgtttcaaacatttttgtatgttatagtaggaatatgccagcctaagcctataggatatggtaagttagtgttagaaatatttatttataaagtcaaagaaataatattctttttgtaaaattagatacatttcttataagcatttctatataattaattttgaaatggctaccttataatgcacaagtatacacttgatctgcagactcattgaggctcattttttggagtgcctgataataatttggtcacaagttaaagacttctagttagagttaaaacattttattagtcattatgcctagcacatgaggaatattagtttatttctatttttctcccttccccaccccataaacactataatatttctccccagctccttttctatggatggaagcatttgtgaaaacttagtctgtatattaaatgtatcttaacacttctcagaacttaaaatcctacaagccctctccctctctactttccctctgtggagagtgcatagcacaacactaggcacatagaatatgcacttgataagtgttacctataatataataagaatatgattctgctttttttcttcttgcatgggaaacaatcagtgctttagaatacaggtgccttagacctgggacaggcctcagggacaggggtcactcggtcttaactcccctcccaatgtgaaaaaccttctcctgtctcctttaccagtagccatccaacttctatctgaagacagcacccaaagttgcttcttaataacacctctagcattggacctgcattggttgtcaaaagtgttccaacattagaggctgcggtcagtttctctgggtcttcctcctccagggtaaactgacccaatgccttgatctcacatggtttctggatgctttatagttctgagctcccttcattgggtgcattgcaattcatgtcgtccagaatggaatataacattctacatctaatctgacctgtactcaatcaataggatgatttgtgcctctcctaccataagcactacttttgctcctctagcctgagagttcattaatttagactaatatttattaaattaatatttattaattaaaataattaatattaatttagacttcatattattggccctgggagcatatgctaaaaaacctagctcgttttcaaatgaatcattgtcaaaccaagtctgctctgttctgtatttgtgtagtttttttgttaaatctaaattcaggtctttgtttcttcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttattctaccgcctccatcaccaattgtgttattttgtttaaagctttcatttcccccattttgttcaacatgtaataattactgttgttttctttgcagtccacagtaaatcatatttattgacttatttttcttagtttgtgtccagtatcatttctttggtctcacaccttttttattcccacctacttttttcctttttttcttcttctttttttttttgctgaggggcatccttctatagttcttttagttttagtgtgggatagtaagcctattctttttaggtttgtctttgttttgccctcactctgaggatgagtataaaagcctatattaacaattgtttttcccacatcccttctggccattttcgatgttgatgagacctctgctgtcaatatgtggttcatttgtagataatctggtttattgtctgggagtttctaacattatctctttatcattgatgttctgtagttttactatgatatgcctgtgtttggatttatttttatttatcctgttaggtacttggatccaagtctgtcttcagatctggaaagttctcagcaattatctcttcaaatattgctcctctaccattacctccatcctcttctggaattgctattggatgaatattggaacctttcaacccatcatccatgtctcttaactgcccttttatatttttttaatctctttgtttctctgtgctgcgtccctggtgagtttctcagtatctaccttccatttccaaatcctctctttaaaacaaacaagacaaatcataaaagccttttttgtattgtgaaatataagacacatagagaaaaatgcattaaatatcaatgtacaacttgaaaaattattataaaggctcatgtaacttgttcatagaacgccgccaatcccaagaacctctatttgccccacgatcacaacttcctccctctccctgagataaacatcagcctgacttttatcataatcacttccttacttttctttgtagttctaacacttaaatgtgcagccctgaacaccagagtttagttttgcatgtgtttaatatttgatatattaaaaatataaaagaaaagagagagagagcatgtgcatgcatatctgagtcacttagtatgtatttttttgtattttttgatctggcttctttcactcaacattatgtttgtgagattcatccacagtattatacatagctgtttttttcattgcttcttattgctatatgaaattattgaagtttagtatttattcagctgttgatgacattcgagttgttttcagtatttggctattatgaaaaatgctgctatgaacatttttgtatatgcctcctgatgtaaatgtattcacctttctgtaggagtagaatttctaggccatagattatgtgtatcttcactttgagtagatagtgcaaaccatttttcacagtagatgtgtcaagttacactcctaccagcaatatgggggaatgctagtttactcatcctctctatctagtctagagtttaccccatctagtacatttttcatcttatttaatattttcatttctatagtttttatttggttatttttcacatccacctgattttgtttcagttctcttttttttttattcttagtttcatgtttgtttgtttttaaaatggaagtcatttcctaatttatctccgaatacttaaaacatatgtattttaaaatctgtgttaggccggaatgaactctagtccagctattaagtttgttggatttcttttttcttttctttttttttttttttttttttttttgagatggagtctcgctctgtcgcccaggctggaattcagtggcctgatctcggctcactgcaagctctgtctcccaggttcacgccattctcctgcctcagcctcccgagtagctgggactacagatgcccaccaccatgcccggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgctcagagtctcacagggctgcagtcaagatgttgactgaggctctgctgtcatctgaggtttaatctgcttccaggttcattcaggttattggcaaaattcagttccttgtggttgtggaactgaggacttcagtttcttgctacctgtcagatggaggccaccctcagctcctagggctacctgcagttccctgctatctgagggacccccagtggttctctgcttccttaaagtcaggaagggagggaatatctccagcaagacaggcacagtaaatcatgtaatggaagcacgtacacatcaccacacatatcccatcacttttgacatgtactgttgggtagaagaaagtcacagatatcaccacgctcaagaggcgaggattatgcaagggtatgcacatcaggaggcagggatcatgggagccaccttaattaaaagtctatctgccacaagcatataaacattgtttatgaacttttataatgttctttcttgaaaagtatactttctgagcaataaatgcttttaattttagttccccaacttgttactgaagtattaatgaaatctgttacatttcaaaaataatgttgctccaattcaactcttccctttctctatgcaattaaaaatgctatagagttagacactgcatttgtaatctaatatatacaaattaactacattataaatcatatacgtacagatacatagcactgtagtatacacaaaactgtgtttgctatgcctgatgaatgattgtaagcaatttagggtaatctttactttacctgatttttctccatactcaccaattttcaccctaattgccttgtaagctacaattctactgcatcctgaaatatcctgctttatttttatactgtttgtggcagtggcattcatgtcaaggagcttttgaagaaaaatgtatttgcctgctatgacattacatcagatctacttgattatttttaattcaatcttcctatagcctgtttattagcctttcactttccaggctacatgtctagttttaaaataatttattcctcttgccctgttataatttaatttattattctttacaccctctcactttcattgcatctcccttagtgtacaactattaagcttgcatgcatcttttccagggaatcataacctagaacaagggctgattcaaatttgtagatgatatactaaagtattggatctttatacttagggtgtaatttatggtaacttaactgataacaagtagacagtcaccttcttttatcattttaggttttggctgctatactcttttcctgtccagctttgaaacattattaccatcttccattttatttcctgcctctgaattcagaagaccacatgtcttttgtgaattagagatgtctctcatttttatttctttaaaagctaaatcataccatgtattatatcctgacagcaaaattatttacttttttcagataagtgtttttatctaccttttattgtgttatattgaatctagtttttcaatcacaacaaaacacttctgtgtattcctgatgacagaatttaaaacagttatctcctggagccttaacagtgactatgtattttttttcttttgttttaatctaaataatactctgattctcaactaattacctctaatcaaaaccttgattttccttttgctaaaatcatattgctttctcttaaaaatatggtgtaagcatgtaacatcctatctttttcaatggaaatgaggtatatcagcacgtggtttcctagagtataaagtcccaccagctgtgccacaaaatcactttactagactcctagcacagtggcttctaaaaattcgcagtttaactgtacttgcctaaaacaattatgtatgcatttcttggttagatgctatttaaggacagtgtctttgagagtataaggaggagggacacctgtttttgtttttctttttcaattaggtctagaattatactgcccatggcagccatggccacatgcagctattgagcactggaaatgtggctagtctgaattgagatgtgctgtaagtgtaaagtatataccagatttcaaagatagtacaaaaaaaaatctcaataatttaatattgatttcatgttgaaattttttttaatacattgggttaaataaaatattaattttaccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttcttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaattcagttaatagaactgaggacaggtccctacatttaatattacctgacgtttggtttggagtgactctgtggaagtaatttacattaataatctatatgaatgaactatcagagctaaaaaaaatttcttggtattcctaatggttcgtgctgatacttctttttttttttgccttcaggatctttttataatagctttattgagatatagttcatattccacacaatttacccttttcaaatatacagttcaatggtttatagtaatactatatttacagatttttacaaccatcaccacaatctaactttagaacattgtcaccaccccaaaaagaaaccccataaccaccccctatcccccagcccaggcaaccactaatctactttctgtctctatggatttgtctgttctggacatttcatatgaatgggatcgtacaatatatcgtcttctgtgcctggcttctttcactttgcataatgttttcaatgctcatccatgttgtagcatgtattaagacatcattccttttcatagtccaataatactccattgtgtagacatactgcgttttatctattcatcagtcagtgatatttggctgatacttttttaacattaaagaaattaatgaagtcaatatttacatttagtaagaaccttcacatatattctcatattgagcctcacagtaatttgtttaggtaagtgttgtcatagtcatcattttataggtgaagaaatggaggctcagaaagcctaagtaacttaggcaagttacttagatgaacttgctaagattaacttactaagttacttagattagttactaagattacacagcaattaagtactagaactgggactcaaagccagtttatccaactctgaaatatgtttttattgttattgccacagctctaggtgattttgttttaaagaaaaattacttactagctagcttctttgctttttgttttcttgatttactatactgttagatatgggaaacagacttgaaaaaacttttaatgtggcctctcccaataattttatgaacaatatggcaatatatttctaagtgataacatacctcagtagcttagcaacagacagaaaattgttcaagaagcaaactgatcaaagatcaatgtccacctatggggacaaatccaagggtgtgctggaaagctcacttcttttcctcatcccgtgaaaaacttttattagtgacttagataaaactatgtttgtattagaagacctagtttacatatttgtcggagtctcaaaatggaaactgaattctgtccatctgattgtgtcatacacagaatatgctcaataaaaaccttggatagtgataaaatatattctgtcttgaattcctttttttctttagggttctgtagctatagctggtgctgttattcgctggctaagagacaatcttggaattataaagacctcagaagaaattggtgagtgtgttctaacaaaaggttagaaaatctgaaaaatgacacatttcagtattttatctctgcaaagtaaatacttatgctttgccccaaatgtgatccataaattatatggatccctattatgagtttgacttatgcaaaagactatcttgtgaagatttataaaacaaggaattgacataattagtggtggttgttaataaactggcaatgtagggcataaaaattacccaagtgtaaaattgaacactggagattgccagaacctgcagatagagaagttgagttaaatttatctgatgagaaagagctttaactcttagattagagtgagcattaaaactctggtacctataatttaagtattaatacggctgttttcagtctatagataattagtttgaacttacctactcactctttcatccacttgcttaactttgcctgaaggtgagacaatcagaaatacatttctgattagggacacactagaggccactttttcatctcctagtcagcaaccttaaaaatagtggaaatgagctaaaataccttaaataaatgaatctggttccttgatttcttgagctaggctacattttagtggggggtatttaatgtgagagaaactcatttctgttgatcctagcatactactgtagttagcaacattttgctctaccaatgaattggaaaccaaaacccctgtcctaatttttctaatttttaaaataggtatgcttatataataatacacaatatttgtgtgatttttgttttgttttgtttttaatgttagaaaaacttgctaaagaagtaggtacttcttatggctgctacttcgtcccagcattttcggggttatatgcaccttattgggagcccagcgcaagagggtaagtattgaaaatatggagtgcttttggggatcttgatttatttaccaaagtcgttaataacttattagtttcttatctattttcaaataattataatgtgttgagaaaaccttttctttttggagaatataatttcagaaactttaagctccaagaagttatgaatcagctgacaataacccctgccatatccgtattcatgttatcttttatcttcatgatgtctgtaagttgtatagtgaagggacatcatcataatgaatactgattcagttttatgatgccatcatcttttcaaatgtgtcatgaattttttcatacatgaatgcagaattgtgaaatataaggactttctgagttacttaatgattatgtccaattttctcttcctggacatttctgtctaccaaatttgaccttttcatatttgagatatttcaaattgattggtttatatcattctaatctgaaaatctttgtgcgtatttttaggataatctgtggactcactcagttcaccaataaatgccatattgcttttgctgcattagaagctgtttgtttccaaactcgagaggtaacaaatatgggcctgttttcttgtacttagttcacttttatcactcttaagttatatgttaacacccgagatttattcagtactgaaaatgtagttaatcaaatattaaggctgcctaaatactaatctaaatataagcagggttttccccctttttccagctgtcattaccttctaagttcctgttccctgtcaggcactgggaattttatggttgtggggaggctgagtggcacacattaggcaaaggaaacagcacaaacataggcatcaaggcagaaaaacagggtgcaaaatagagttgtatagcttagctgaatatcaaggtgaatgcagaggtgtagtgagagaaaaggttggctgtgaccagatcaaagagggcttagaagaccagaataagaagtctcaatttattccataggctcttggaagctcttgagagtttctgagtggaggattgccattttcagagatgttactatgaaatagatttataacattaattgcactggtttatttaagattttggatgccatgaatcgagactgtggaattccactcagtcatttgcaggtagatggaggaatgaccagcaacaaaattcttatgcagctacaagcagacattctgtatataccagtaggttagtaagtcttcattcctttaaactcccagagtaatgtttcttgtggaataactagttctttgggcatatgtaaccacaaagatattgatggaactctctctcctcagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataactttttagaaacctatgcataaaatagcatcagctgggaatggtaatttgtgcctatagccccagctacccaggaggatctcttggcttgggcccaggagttcgagtccagcctaggcaacataatgagacccctgtctctaaaaaaacaaaaggaaaaaaaaagcatcaaagtggattttgaggtattgggaataagctttcaaatgcatttttgtttggttttctgggagaatataccagtgtttctcaattttattcattcttttaacatataagaaaatgaattataatactagtaattttatagtcagattataccatgtaccttgatttagaaatgtatttcaccatctgatattctgtcatttttaacttttgcaatactggataaaatatgaagttcaaaaaatttttctacttttcaaaaaaaatcaactttataatatgcaaataatgtccagagcgggtatatggcctctaaatgccaatctcactcttaaagcaaggaagttctgtgccaagagagccatctccattcttaggggagccatctttgctggtgttgaaggccttagcctggggttgatcagtcatgccctattgtcctccctctcaccagccctcactcctccccataaacgaatgggcacctaggcatagatagtacattttgccagcaaacagttgtttatagccaaccacaggccagagactgtactgatgtggggatatagagatgaataaggccttatcttcttatcttcttttgcccttcagaagattagagtatattgggagcagaagacaaaaccataaaaatttggtagctgacatcctggggtgtgtgtgaagagagagggggggatagaaatggggcactggaaagctttctgaagtgagtgattcttgagccttctctcctgggtgttgcaggcctcaggtgctatggaaagtctgggaggcttgagagaaaggtagccccacatggggttcagcacccttagaagtgtacaacatcaagctcatttttgtttagactttctattgtggatttccacctttaaaaaatcttgctttaagatgctggggttggggggcatggggctgtctcagaggaatgcaattcaaatcttatgagaaatcagtatttgttaaatcctgtgactgaaataaaaacgtctcctgcggggcgtggtggctcacgcctgtaatcccagcactttgggaagccgaggcgggcggatcacgaggtcaggagatcaagaccatacctggctagcacggtgaaaccccatctctactagaaatacaaaaaattagctgggcgtggtggtgggcgcctgtagtcccagctaccggggaggctgaggcaggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttgaaaggagtttcgctcttgttgcccaggctgggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataactatataagttatatgataatagcaatatagatagaatcctattttgataaacttgagaggatattagaattgctacctgtatcttaacctatgggaagaatatcaggcttgcttaagtttcaaagcaatttgccaattttgaagcaatcataattattttcttgtttgtgactatatttgaatgctttgtaaacaatttttaacatacttttcatatgtgtttaaaatgtattgtcaggtgcattttgttacgcaccaaattctattaaaaaaataaaactgaactaatattttagcaaacatagggttttaaattcatcttaggacactaatataactcttctctcatggccaaaagagaactataatttgaacttaggtggaattaaatagatcatttaatatatttgggggaagaatcaagaaagctaaaattaacagcctcccaaaaagttatccataggctcactctggctttgccagtggaaggctaatgttagtctatatgtattatgttcttggctgtgtggcatgctatctgtattgtttgttaactgtcataaaccttcaatattgattatatttttgatttgaagtaataactctttgctagcttttatgaatatactatttttatagcttattttgttttgctatcttgtgattcttaacacaaatattgtaattatgtgtctctcttttggtttgcttgactggaattctcttctgcttggatgaccacaggtgaccctagtatcttctgtagtctgcccttgggcttttttatagtgagtagcatggtaatgttaatcggagcaaggtacatctcaggttagttactctttaaattagacaactctattagttagctttaatgttttcgtgtataacttagcagaaatttttcagtgtttttcattctttctgtgtctaggaagctggaaaatcaataaaaggtctaattagttagaccaattaatctttgggggcagttagaagtaagaactgtgactctgcttaccctttttaaatttttaatgtgatgacttctttaagagggactacattctgctgtcagctgcagcaataagcaaaagtgaaaatactaatatttaaatgaaaggactttcagactgactgctgaaagttaaagtatacttttgacattaattaaattgtctttcaaatgtatataaattatttttcataatcctgaaaatttgctaagcaagtcttaacttttcaattctggcaagtttcagccagagcatgtccacagagttcctgtaaaaccctaaaaccagggaagatttatagttactcttattttagttaaaagaatatcttttatgaactgaagttttaaaaatgattccttaaatgaaggggttgaaatgaaaacagaattatttttccacattaatttatactgaataatctttttttaataaaagtaaaatggctcagcatgttatggaatatattgcataatcttattaatttataatagccatttgtggaagctgctcctggtgatagctcaatttttcttaaaattactggcttaaatggaaatgatgcttcttattcctgtatgttccccatgaaagtgaaacttaaaaaaaaaattcatgattagggtttcatgaaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaggatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattgtagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattatctctgcttagtgtcttattataactgaaagaaggtttatcattacaaatgccttccaatgaaaccaagaatttctcaaaatatttaatgtcacatattataagaagttacctaatcctgcttcttaacgtcaatttttaaaaatatcttaaaattactttgttttgcagtaaacagtgaagaaaagattgcctcctaattatttttttcaacgagtgctgaatgggaaaacatttatatcttactataaaaggttctgttttgtttggaattaatggtagctttattgactgttctgattgtgctgtttctgaattattgaatctgctaggttttattcatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctactaaaaaaaaaaaaagatgtttcaggacatgtgaaacttggctgttagcgcttgatagggcacactctgaagagttaaccaacagccaaagaagtaatttctgtaatgatgaacactttaatcattctattagaagaaactacactgtcccatctcagcatttgcaaaaaataatgttggtaaggtcagcagccattatcaacagggccttgcatggctaactttgaccaccatttttctctcaacctgataggcaacacctcaatcctttgttctccaactaatcagtaaaataagtaatgcatctctgcttctgtaatgatatcttagaatttttagtatgtttcttttgaagtgcccaaagcccaattctttgggatatcttttgggtatctggtatcatgtgggagtgaagaaagaaagtttttggagaaaccaacaaatgaaagctgtgatagcacagaagctaatggcattgacagtggagtaggtagtatttaatctgtagtgtttacaacatagtagatagaagtacaaaaatttttttaactataactctttaatagcttgttttatctagtaatatttaaataatgaagtttccttgatcctttgcttttgcaacctaacaactttaataataagttcacacaataaacaaattagtagaaaactgagtgaatttgtaaatcaatctgatttctactttgtgtatactttataggtacatatcttaattctggccttataattaaatataacctgtgccaaatatcgtagacaaaaaaaactctcacaggtatttcctgagatttccctgtcatcaaatttaatgaaaatgacccattaaattaaatttgaggaccataaagataaatattctgagaaggagaagttaggttaaaaacaagtttctcaactaggccaatacctttaattgccagttttcattctatttcaaataactagttctacctgacagcataacagttgagaggatgacaatattttattttaaaaagcagcttcagcctctttcaattttcctgtttagtattaaaatttagtttcttttattccttattattgaacttgataatatctatctcataggtttcttattattgtatgactagtttacaagtggatttcataaatatgaaatcatttaagtaatcaccacaatatccaacaaagagaaacttgttaaataaattctggtacagccatacaatgaaaatgtgtagctttagaaaagaatgaggacactgtctagaaagatatggtatttgggataagtgaaaaagcaaggtgcggagtagcatgtaagtgtgctacccttctattagagagagagacagaaactagaatgtttgcctatgctggaaggacagaaaagctgttaatagtgcttatccactgggacagaaagggttgataattaggcatttgggagaaaggggtgggaaaaaatttcactatacatatgtgtgtgtgtgtgtgtatgtatatgtgtgtgtgtatgtgtgtatatgtgtgtgtgtgtatatatatatatatatatatatatatatttttttttttttttttttttgaaatggagtcccattcttgcccaggctggagtgcagtagcgtgatctgggctcactgcaacctccacctcccaggttcaagcaattctcctgcctcagcctcccgagtagctgagactacaggtgtacgccaccacacccagctaatttttgtatttttagtagagacgggggtctcaccatgttggccaggtgggtcttgaactcctgaccttgtgatccgcctcccgtcccccccccttgtccttccaaagtgctgagatgacaggcgtgagctgccgtgcccagtctgtccacttcatttctttgataaaactgcttggaaatgagaatattactcctcttataaaaatgggaaaaagaaagagattagaaagaagaaagtcacccatagtcctaaaatgatccctgtggttattttgatttttccccagactttaagggaatatttcatagaacttgagtgttcataaactatataaaaatttcaacatgcaaactagtcagggctgtcatgtatgtagacacaagtgaactgaaagtataaaataggcatagagatgataaataccaagtttagtggtggttacctctgaaagaggaggatggggtcagggaaagggactttgctgaaacctggaaagttgtgtttctaaaaaaattaagagttaaaacaaatgtagcaataccttaagatttggcactgcttagcggtgggtacacatgtctttattctatcctctacatttctgtatgctccatatatttcataataaaaatataaggtgtgttgctcctgattgtgtgtatctgaattcgttagtcactgtctgtctatcagtgtagttttgttagtactgacagccttcccaattaaaagggttgaaattttattgatcttctggcagaattatttcaagcacctcctacaaagcatcaatatacagaagaaataatgtgtgtattagaaattacatcctggccaggcgcagtggctcacgcctgtaaccccagcactttgggaggctaaggtgggcggatcacttgagatcaggagtttgaaaccagcctggccaacatggtgaaaccccatctctactaaaaatacaaaaattggctgggcatggtggcacacgcctgtaatcccagctacttgggaggctgaggcaggagaatcgcttgaacccgggaggtggaggttgtggtgagccaagatggcgccactgcactccagcctgggtgacagggtgagactccatctctaacaacaacaacaacaacaaaacacacaaacaaaaaagaaattacatccttccttagccattcacttgttatgaacagaatttagaagactcaaaaaagaaatgcccatgtgttttctatatagtaccttccatgaattttaatagataactgcatagctgtaagaccaccatatttgtaattatgtgttaaggctagaaagtttctagacagaaaagtcttgactctacatttaactgtaatgtccaagggaaaataattgtgatcatcaaattagattttaagttacgcagaagacctgttttattgtattccgggttctaattcattacagtccaaagaaagtactaaataataaaatggaatgacatttgtttcctttataatatgtgtttaaaataccacaaaaacgtggttaaaacggtagggtgatgaggtgattaaaacctgctattgaaggaaaacttgactctaaaatggaacaattctctaatttcacctatgctgggtttttcccccattatggtttgatactttaattctccttgcccacactcagggagacgttactgctagttagttgcattatctaatcgattttaaaggaagagacataactaatgaataaaactaagttattaggattcttccgtgacttttcaatgttttctatgtctccatcccacaggttcagttaattctctaactctatatgttaaatagatgtgtatcctgcaaggatatacactcacccccaacacagacacacacacacagagagacagtacattttttttccttttgagacgtagtctcactctgtcgcccaggctggagtgcagtgtcgcgatctcagctcactgcactccacctcccgggttcaaacgattctcctgcctcagcctccggagtagctgggactacaggtgcacgcagccatgcctggtatttttgtagttttagtagagacggggtttcactatcttggccaggcttgtctcgacctcctgacttcgtgatccatccgccccagcctcccaaaatgctgggattacaggtatgagctactgtgtccggccagagtacatatttttgttcaggataatcagaaatgagtataagagagattcttaatgttttctattaagcaggctcatttagaataaacaaaaccagagctattatcttctatggattaagactggaataataaaaattattggaaggagattttttgtcaggtctcccatatatacaggtgttcatcagagacaccatgttccccttctctccctctcagagagagacacccatggatggcaggcgtgggcagggccgtgcctgtcgtacacagggctttgtatatgctgaagcctgcagctgtttattattgactcctaattagctccaacaactgtgtttggctaattgaattgcactccctgctagccacctgagccttcccaaaagaagattgcccttcaaaactaaggaaagaaaatattcacaccattatccagccccagattcttggcttgagccaagcacctatgtagctcaagccaaggatttctgtgcccagctcgaagaactggtgaagctacaagtgttaacataggtgtcttacatttagatcatagtggacaggacttcaatggttgtgtttttttattattattattattaggttgtattttagacaccataatgccaattttaagtgattttaatgtggagagatgctgaaccatttctgctgaaatgtctcagatatccaatcaacatttattaaggaattgtaccatacaagattcccctatttttcaaccagagaatcagaagcttagggaaaaaaaaaattcccttgttttccaactccatcacttgtagtctaaactattttaagttttatttattttcttgagatggggtgttgctctgttgcccagcctagagtgtagtggcacaatcacggttcactgcagtctcgacctcccagactcaagccatcctccaggattagcctcctcagtagctgggaccacaggcacgtgccaccacacccagctaatttttaaaaaaaattttgtggagatcggggagggctcacgatattgccaaggctggccttgtactcctgggctcaagagatcctcccacctcggcctcccaaaatgctgggactacaggtgtgagccaccacactcagcctaaactcttttatcagcttgctaaaggccatgtaaatagaataggctctagtgacccagttatcttttgaaaagctggtctcctgtaagaaacaaattcggccgctaggtgacgctactttccacagtcgggcttctctgtcttagacatttcttcctatcagcagaagttgctactgtactggtttttggtaatcatagtaaagtgaaagcattgtagtgactgtgggagatgtacagaatgctttcatgataagatcgtaaaaaccagaggcttaactgaatccaacaatctgtttacgctcttgcatctttgattttccttagacttttagctcatcataaaagtcaggtttatagacatttctctataatttaacacttaatacttcaaatatctctgctaattacacatatactctgctaaatttattcaatcataaatatattcttagttatagcctattctattaaaaaagcgtttttttaaaaaaaaaacttctgtttatacttgagtcttggaatgacatactagaatcaaccaattccaaggcaaaattcttcctccattattttctcaatatgaaccaaattttttttactcttatttttttgcttttgcctttcaccgaatgattctagaaaggtatacagaaaaaaaatctttttatataacaatctataaacatgaccaaatcaagacaaaatcgtgttaaattgtcccttatgttgatagcatcattatcatgtcaataccaggcaaatctttaactctattatcattgtcattagctttttacatgttgagatttacaaagttattaagaaagtattctttattactacaatccatcagcattttgatcatacgttgtaagtgccatagcatccaagtataataaaactgccaggcacagtggctcacacttgtaaactcagcactttggaggccaaggtgggaggatcacttgaggccaggagtttgagaccagcctggacaacacagtgagacctcatctctacacaaaaataattttaaaaagaaaaattggccaggcatggtggtacatgccggtggtcctagccgacattccacatacagttttaagacacaaagtatatacttctaaaaaaacccacaatagattcctatcaacaataataagctacatacaggattaaatttatttaatcatataatctataagccagtaatttttttttttttttttgacagggtcttattctgtcacccaggctggagagcagtggcgtgatcatggctcactgcagcctctaccttcctgggctcaggtgatcctcctagctcccgagtacgagtacctgggactcatacttgcacctgcacccagctaatttttgtattttttgtagagacagggttttgccatgtttcccaagctggtctcaaactcctgggctcaagagacccacccaccttggcctaccaaagtgttgggattacaggcgtgatccaccatccccggcctaaaccaacaattttaacaccataatcccgtgggcatcttttggataaggtttatttcaaatggaattgttttatttaaaataagaaattttaaaaaatttaatatgttactctaaaaaaacaaactattttggaactgagtaatccaaatctaaaagaagtaaaggcattttgctttgcattgtactattagtgaaaaatttagttgtagatttatagatgctataattacacaacaatgaaagtacaggcaaggaaagtaggcaaataaattgtcttgctcacaaaactatttttggagctaactctcttatagaaaatcatcaaaaagggttttatccaaaatgtttcagtaggatgttaacttgaaataaagtgaatggccttagggttatgctattccttcttctcctctcaggtttctaggttaagaaataatgaattttgtttctaaatgttgctttagcagagctaattgtagccccttgggtgaagggattggagaaaggaaaattcagtttttttaccctgcttcagtaatcagttgactttggtatacccaagtggacttggccattttaactgtgtatgcttaaagatttttctgaagtcaaaaggaaaaaaaatacaattctgccatcaaatatttgatgactacagcaaaatatatttacattgttaacacatttttcataaatatcttctcctcaaaataacaaataacaagaattatagtaatgttttaggcattaaaatttcagtttaaggtatttgtggggttttttttttttttttttttgagacggagtctcgctctgctgcccaggctggagtgcagtggtgcaatctcggctcactgcaagctccgcctcccgggttcatgccattctcctgcctcagcctcccgagtagctgggactacaggcacccgccaccatgcctggctactttttttgtatttttagtagagacagggtttcaccgtgttagccaggatggtatcaatttcctgacctcgtgatctgcccgcctcagcctcccaaactgctgggattacaggcgtgagccaccacacccagccggtatttgtggtttttaataaatagtgagctgggtgtatcagttatctattgctatgtaagagaccacctcacaacttagtggcttgaaacaacaaccattttattggtcactattctgtagagcatcgatttgatctgttctactgagggcagttctgttggtcttgcttagattattcctggacaagtaatccaagtcaaatggcacattggttggaggctggatggccttggttgacctcactcatacatctgggagtcagctggggctatcagccagaacccctcagttttccacattgattatccagcaggatagctcagacatcttcccatggtggctggattccaagagggcaagagtggaagttgtaaggcctcgtgaggccttggcttggaaagtcccgcaatgtcacttccgctgctttttttttttttgagacagggtctcactctgtcacccaggatagatgcagtggcatgatcacagcagtggcacattgcagcctctacctcctgggctcaggcaatcctcccatctcagcctcccgagtagctggggtcacaggcatgtgcctccatgttcggctaacttttgtattttttgtagagatggggttttgccatgttgctcaggttggtcctgaactcctggactcaagcaatctgcctgcctcagcctcccaaagtgctgggactacaggcatgagccaccacagcaagcctacttccacggctttctatattggtcaaagcaaatcataagactgcctagattcaagggaagggaaaacagacccccccaacttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagaccagtctggccaacatggcaaaaccccatctcgactaaaaatacaaaaattagccaggcttggtggcacatgcctgtaatcccagctacttgggaggctgaggcaagataattgcttgaacccagggggcggaggttgcagtgagccaagattgcaccactgcactccagcctgggtgacaaagcgagactccatctcaaaaaaatagaattgtattgaagagctgaaaagatagtagtgaactcctagggcaagttttaattttggggtgatagcctgtaatcagagagataagcttctgagcaccaaagatgaacaggcttcacacttgagatccagatccagaagtccaggaccaagatgcattcaaaatatagggactcttatagaagtttctccagcattacagaaggatccaaaaagactacaactccagtataaggactggatctattccctaactcccctgtccctggggactacagagatggttgccttggctatgagcagagctagagaagaaaaaaataaagggaaacgtatccctcagaagttgttgccacatacctgcccttatgcaagtttgtaccccagggacccatagccccaatgaacagggtccatcaagccctgaacttggttgttgcaatctggattggaagtgctcccaagtggctgactgaatcaaatcacaaagtctctttaacctaggcctttggaggccaccaaaaataattgtccaaaggcaatgaaaggcatggggtcagagacagtactgatataggagttaagaagaaagtacttaggtggatagtgagggtatggtaatgggagtcctcagtaaggtattccttttaatgaaaagcagcccccaaatcattttattttctaacaaagagcagcctgtaaaatcgagctgcagatagagacaagcaagcctgaattttgcacgggtgaatgccggtagttgtgacaataggaaaaggcatgatcaagatggcagctccaccttcccttctttttgccagccatgtaaggagcagacaagatggtgccggccaagtggcaagcccatttgcataataagatgaggtggggcgactggctttccccacgcacaatgtaaatgtcacacctggtccaaccaatctgtgggccctatgtaaatcagacactgcctactcaagcctgcctataaaatctgctgcagtccactgcaggccggcttttcactttcagacgcctctctctcgcaagagagagctgctctcctctctcctttcttctgcctattagactttctgctccttaacctacccacatgtgtctgtgtccttaatcttcttggcgcaagatgacgaaccccgggtatttaccctagacaatgatgctgcttcagtactagaaagcaaggcatcatgaatgtgaaccagctgatacaacagcagaaggagattttaacaatttcagatattatcggacaagtttccagaaataaatggcaaacttgaaaacattcacaagacagaaagctagaaaattgacatggcaggtttgaaaaagaaatgaaccgaacttctagagatggaaaactcaataaccaaacttaagaacgcagtggatattgtgaaccctaaatatctgagacaggtcacaaccaatttagaaagtttattttgtcaaagttaaggaagtgcccgtgatacagcctcgggaggccgtgacaacatgtgcccaaagtggttggagcacagcttggttttatacattttacagagacatgagacatcaatcaatatatgtaagatgtacattgatttggtctggaaaggcgggacaactcaggccagggggagggcttcctggtcataagtagctaagagacaaacagttgcattcttttgagtttctgattagcctttcattgaatggacaatttacatgtgaggggagggtagaggaacggtcactaatgccttagtctggcttagtgaaataatagggcagaggaaggggatctcaggagcctcagagggatcccatctgtcctttgtctacaaggaatttccttgtgggtgaattgtgagggaggtctgtagcttttttttttttttttttcatctttgtagctatgttatttagaaataaaatgggaggcaggtttgcctgacgcagttcccagcttgagttttcccttggtttagcgatttgggggtactgaaatttattttcctttcacaatatattgaacagattggacacatcttattaatctcccagtttaattagtaaacagtttttgttttgtttttttaaggtggagtctcactctgtcgcccaggctggagtgcagtggtgcaatctccgctcactgcagcctccaactcctgggttcaagtgattctcatgcctcagcctcccgagtaggtgggcctgtgggcgcacaccaccaagcccaacaaatttttgtatttttagtagagatggggtttcaccatgttggccaggccggtcgtgaactcctgacttccgacttcaagtgatccaccagcctcggcctcccaaagtgctgggattacaggcatgagccaccgctcccggccattaattagcaaactggaaagcagatcgggacaaattacccagcattgagcaaagaaagaaaagaaggggaaaaaaatctctgccagcccaactgggagttctggagtggagattgccagttaaagaggtcccacactgggcagaagtggccaggcccaagtttcactgagcagtctttgaaagtgctggatgtttgataaacgtctacaacttttatttaaagataaggatggaaggtgatccttcctctgtgaataataattaaaaaccagacaagaaaataatctctttatatacttggggtaaagggggcacagtgagtgatacatttgataactcagtttaatgaacaaactttttagccacctgtcctggcaatatacacatgtagaaataatagataaattaaaaggtttgtatatgttttataaataaaataaaggagaaggcatctcagataaatttaaccatcatttagggaaaaaattggaaataaaaggtcaaataaatcatcttctgcgccttaaaactttttaaaaccacattttaaatgtgaggtgggggagggagaggagggggaacaggggaagataggagaaagaggagagagggagaaagaagcaaattaaaaaacaaatggccaggcatggtggatgctagcactttgggaagccaaggcaagaggattgcttgagcccaggagttcaaaaccagcctacgtaatatagtgagacctcatctctacaaaaaattaaaaaattagctgggcatggtggtgtacacctgtggtcccagctacttgggaggctgaggctggaggatcacttgagcccagaaggttgaggcttcagtgagatgtgatcatgccattgcactccagcctgggcaacagagtgagaccccatatcgaaaaaagaaaaagaaaacaagcaaaccaaccaacccaggaactcagtgtggccagtagattgaaaagacaagtcattattgaaaaaacccttattagctcactgtcaaagtcaatatgataaattattgtgcaaaaatactccatccctctcctctacttctgtggaaggactctatttcaccacatcttaacttcaaacttggctacatgttgggccagtggaatgttaacagatgtgccacaagcagaggcttcaaaaatgcctgtgcagttgagtgtgtcttctggtgcccctgcatcatcacgagaagtgccttgcctaaccctctgaatcaaggatgatgagagacacatggagctaatgaaaatccagcttaaaccatcagaccccccagctgacccacagacacgtaagcaaaatcaatgtttattgctgtataccatagaaacgttgcattttgtcattacttaccaatagctgactgatacaataattatatctgttctaaatgttctaaagaaaggacattttttaaaaatgaaaagcttacataagcaaatgtatagtggtccatgaaatactttgaatcaagtagaagacattggacagaccaaaatacaattcaaagttttttctcattagaatcacaaaagccacaagaagtgatactgcagtggctggagaacctgctagggaatcaatgcatcaaagccatggaatgactgagcatcagtcaattctatgctttggtcttgactactgagaacacaaataatgttaacatagctagacaccaggtcaagaacactaggtcaaatcattgttgggcatatgctaatgtattgactacataaatgtcaataaatcactgggattgtagaaaatcctcctacaagttttgaagtcattcactgttaaaacaataaaaacatatgtggcagattgtttcagtaattatctcaaatttggtcacagctttctatatccgtgtccttaagtagtccacttgtacaatgattgtgggcttcactatgtgacttttgcccaatggaacaacagtaaatgagatgcaaatgaaagcagggaaactgacagcactctggggctaactagtctttggagctctgataccatcatgtaaaagagagcaggtgtattagtctgttctcatgctgctaatagagacatatccaaaacagggtaatttataaaggtaagaggtttaatggattcacatttccacatggctgggtgggggggcctcacaatcatggtggaaggcaaaggagaagcaaaggcatgtcttacatggcagcaggcagaagagagcatgtgtaaggaaactgccctttgtaaaactatcagatctcatgagacttactcactaccatgagaacagcatgggggaaactggcctcatgattcaattatcttcacctggccccacccttgacatgtgggaattattacaattctaggtgagatttgggtggggacacagccaaaccatatcagcaggctagcctactggaagatgagcagatcgtgtggagcagactacccatctgagcacagcccaaactggcaagcctcagaattgtgagcaaatagattattgttgttttaaaccattacatcttggggggtgattatacagtaaaagctacctgatacactgtgtgagtgacctcatgtgaatgcctttgcaattcttatccaaaagaaagtgcagcttgtttttacctttaagaagttggtagaaaccttaataaagataatattgaaatctggggattgaaatctgtgattgaaatctggtgattgcaaaatgtgattgaaatctggggagatatgtgagtcaactttgacaccttcctcagcctgcatctacccatcaccaaagtctgttgttcttatctcctatacatctgaactccttctctccatgtccactggcaccatcctagtccaggctctcagctggagtagtaaccagggattcctcttaacccatctccctgcagccaccctggccccactttgaagatctgttctccatgcaacagtcagaacaatcattttaaaagcaaatctgaccatgccgtctcccccaacttaagatccttcattcactctcatttatcttaggataaaaaccgctctatttcctgggacctacagcccttcccaggatatgctgctccccatctccagcctccagcccttccttcagttctgctgaagggtggtggctcctcctgccacagagcctttttgtgtgctgttgcttttgccttggattctgcacctcttgctccccactctccttcccaccttctcatctcatctcaggcatcacttactcagggaagccttttctggcccccaggtccaggttatattcttctcctttatttgtacttttatctcattttttttgattggatatacttacgtttgtataatcataagattgatgtctgtattcccaactacagtataaactctagaaagcaaagaatgctgaattttgctcacccgtagagttctaatatcaggcattgtacctgtcaagcctagtgcctgacacataactgacactcagtatgtatttgttgatggaatggatggtttgatatgcgagttgcaattgtagtacttggcatacaaaacatactcaatagatatttgctgaatgaatacggaatgaatgaataagcctggaatgaggaggggctggaaaataagaaaccatatcttacatgacatgtagcattgcttcttgcacatagtaagccaaataagtattttcagaatgaacaactaactaggaaattttgaagggataaataggaatatggacagcaagagaacaagaatttgtttcctttatacttgaaataatcctgaattaagtggcctcctttgtgtagatacgaaactaatctgcaaacaaaaagtaaatttaaatgggtacctctctggatgtagagctggaaacagtggtgagtttctataggacaataccttgggatcataattacctaacatttctatacagtctacaggatgaattttctaggtttgtacgacactaacatcttcccagtagagaaatgagcacaaactatagtcaacttttcctaaacataaataaaaatcaaaatagaacatacatattagcctgtccccctaattgccccccttattaaccttgtttaaagcctcatcagctctcaaatgtacacagatgtttaaaaagtcacccaagctgcagaaaatctgcccacaaagtttgaagtaacccacaggtgatacaatgaaaccctctgctatagattgctgcaatgatgggccccaattttgtcagacctctctgtatccatgcctttgattggtttccacgtgcacaagtgcactgaatcagggcttgaccatgtgatttgctttgcccacagaatcatgagcaacaaaatgattgttttttttaaggctttatgtttggggttcattttgctactcagcaaaaactaactgccccaatgttgccactgtagcagagttttctacacatgaatctgatatgtcattccattacttaaaagccttcaagaaccatcatctcttaggaaccagggactagccaaggaggtctctctcagaagaaaagtcaagattcattcaggaatttggtaaggggtgtgtatgtgtgtgtgtgtgtgtgtgtgcgcgtgcgcacgtccacgcgtgcatgtgtttggggcagagaatggctcagtgtccattaaattacatatgtttctgtagaatctaatctagtggcaagttttaaccttattttgaaaactcaaagacttttggggatttttcttttctttttgccatacacgacattgacagagttctaagtcttagggaaagataaatgtttgtagtcattctctccttgaatttttttttttttgatgcatacttagcatcttagtgcaatactctgtttaggaagcaacccccttcacattgttaaatagtgataaataggtccagatgttttactttaaaaggacattttagttaatgttccttgaggagaagcaatagtaaccaatgttgcccatttgtctggtcattttgggctccagatggctgcatcaatgcttcaggaaataggaatgttttattgagctgggagattaaatatatgtggagccacttgtaccactttgggaggagttttcagtttaagcctacagcatttctggtaaaactcacatgaagtgtgacaaagtaatcagaaccgcttgctattgcaacagggaactgttattgtcttttccacagctgagaatttatagaactgtccctcagcctactagcagaaaagcactttggagtattaccaactggatttgcaaaggatgtagtttcaggacaaagaagaaatatatacaatgtgtgtctccgagatcattaattaaatatcctatccaaagtccttaaaaatgggattacccagctgaaatgccagtaggatgccagtaggggattgctttgaagttactgttggtttaaagacttgaaatagatgtctcgtaaaatttgcctgattagttgtaagtgattgctgtggcaatgatatatgattgtaaacatcactccacactaacaccttaacaggggggggttttttttttttttttttttttttttttttttttgagacggagtttcgctctttcaccaaggctggagtgcagtagtgtgatctcggctcactgcaacctctgcctcccaggttcaagcaattctcctgcctcagcctcccgtgtagctgggactacaggcactggccaccacgcgcggctaatttttgtatttttggtagagacggggtttcaccatattggccaggttggtctcgaactcctgacctggtgatccgcccacctcggccttccaaagtgctgggattacaggcctgtgccaccgcgcctggcccacttcaaccatttttaaatagcttctatcagtagttgatcaagtgacagaaatccaaattgaactagctatagtagattgcaaactatcaaaattcttttcctcccttcccaaggtgtagtctatttctccaacctttgcacctggattgaccatgtggctggctttggccaatgggacactaaaaaatgtgatgcaatcagaagcttgaaaagtgcttgcacattgaggcttgccctctctagcagcaaacagaatcctgcaattgccgcggggagaaggcgaactggcctactgaaaacaagaaataacgtggctcccccacctccacagcaccccagccaatagacaaccacctgtcggcccataagtgaggtcatcctctggacaacccagctgccagctgaccacaaatgcatgagttagcgcaggtgagatcaactaaggcagcccagcgcagagtcctctagctgacccacattatcaggagataataaatgctggttttacgccactgtcgtaaaggagggagtgacgcagtaaaagctacctacttagctgctttttttttttaaaagcttaaaacaaagaaaatttgttgcacgaccctgtgtgttctgagactgagctaagtagaagaaagattggatgtacttgggcctcaggaacaaccagaactaagtatatggatgtcagcacaaaataaaagatgaagatattttaaaggctcatatctggtaagcaattaaaaagtcaaatgttgaccaaaacaggagttcaaatccactgtttttttttttttttttttttttaccctttgaagtgcttcctcccactttttttccccatgctccccgctgccgccattttaccctccgtttctttctttctttctttttttttttttttgagacaaagccttgctggagcgcaggggcgcgatctcggctcaccacaacctctgcctccctggttcaagcgattcccctgcctcaagcgattcccctgcctcagcctccagagtagctgggattacaggcgccggtcaccacgcccggccaattttttgtagttttagtagagacggggtttcaccatgttggccaggctggtcttgaatcctggcctcaagtgattctcccgccttggcctcccaaagtgctgggattacaggcgtgagccaccccgcgcccggcctaccctctgtttctatgtattgaattttttttttttaattccacacataaataagatcatgcagtatatatatatatttttttttctatgtctggtttatttcatttatcataatgttctccaggttcatccatgttgtcacaaatggtaggatttccttctttttaaaggctgaaccatattgtaccaaaatactcctttatatcacaatttcattatccattcatctatcaacagacatttgttttcatatttggctgttgtgaatagtgctgcaatgaacatgagattgcagctgtcccttcgccatattggtttcaattccttttgatatatacccaggagtgcagaagtgggattcctgggttatatgttacttctttttttgtttgtttgttttgagacagggtcttgctctgtcgcccacattgtagggcagtggcacaatcacggctcactgtggccttgaccttctgggctcaagtggtcctcagcctcacaagagtagctgggaccgcaggtgcgccccaccatgcctggctaactttttaactttttttagagatggagtctcccgccgggtgcagtggctcacgcctgtaatcccagcactttgggaggtcaaggtgggaagatcacttgaggtaaggagttaaagaccagcctggtcaacatgttgaaaccctgtctctactaaaaatacaaaaaaaaaaaaaaaaaaaaaaaaaattcgctgggcgtggtggcaggcccctgtaatcccaagtactcaggaggctgagacaggagaatcgattgaacccgggaggcagaggttgcagtgagcagagattgtacttaagcttgggagacaagagtgaaaactctgtctcaaaaaaaaaaaaaaaaaaaaaaagagagagagagatggagtctccctgtgttgcccaggctggtctcgaattcctggccacaagagatcctctcacctcagccttcgaaagtgctgtcattacaagtgtgagccaccgtgccttggccagttctacttttaatttatttagaaacctccctattgttttccacagtggctgcactaatctaccttcccatcaacagtgtattagtgttcccttttctctgtacccttgttaacatttgtaatttcttgtgtttttttttgataaaatccatcctaacagatgtgagatgatctcataattttggtttacatttccctgataattagcatactggctatttttatgtcctcttggacaaatgtttactgaggtcctttgcccatttttaaaccagtttatcttttttttttttttttttttgctattgagttaggtgagctctttatatattttggttgataaccccttattatatgtagcttgcaaatattttctcccaacctataaattgccttctcattttgttaactgtttcctttgctgttcagaagccttttttgtttgatgtgatcccacttctttagtttttttgttgcctgtgcttttgatgtcataaccaaaaaaatcattgctatgacccatgtcaaactcttttcctgtgtgttgagttttatggtttcaggttttatgtttgggtttttaatacattttgggttgggtgggttttttcatgcgtgtatggcataagggtccagtttcattcttttacacgtggatatccagttttccttgtgttacttaatgaaaagactattgtttccccatggtgtcatctttgtgcccttatcaaaagttagttgaccatatattctgggtttactgctgggtgtttctattctgttccattgatctatgtgtctgtttatgccagtgctataatgttttggttacaatagctttgtgtagtagattttgaaatcaggtagtgtgatacctccagcattgttctttttgctcagggttgctttggctgtttggggtcttcatggttccctatgaattttataatttctatttttgtgaaaaagacattggaattttgataggaatacaaattaaaagctcaactccttctatctaattcaacgcaaattgcattgaatctatagattgttttgggtagtacagacatcttaactatttttccaatctgaaaaatattctatttatttgtgtcttcaattttttttctttttgaggcagagtcttgctctgtttcccaggctggaaggtagtgacacaatcatgactcactgaagccaccaactcctgggtttaagcatttaagcaggtgtgactacaggcacgcaccatcacacctggctagtggtttttatttaattttttttttttagaaacaggtcttactatgtttcccaggctggtctcaaacttctggcttcaagtgatcctcccacgtcagcctccaaaagtggtgggattacaggcatgagccaccatgcctggcctctttcaatgttttatagttctctctgtacagacctttgacctttggtttaatatattcccaactattttttaatgctattgtaagtgggattgtcttcttgatttcttttacagatagttcattgttagtgtatagagaatcactgctgatttttctttgttgttgagtttttctttttcttttttttctttttcttttttttttttttgagacgacgtcttgctctgtcgcccaggctggagtgcagtggcacaatctcagctcactgcagcctcccctcccaggttcaagtgattctcttgcctcagcttcctgagtagctgggattacaggcacacgccaccacacctggctaatttttgtatttttagtagagacggggtttcaccatgttggtcaggctggtctcgaactcttgacctcatgatctgcccgcctctgccccccaaagtgctgggattacaggcatgagccaccatgcccagcctgttattgagtttttaaaaataagtactctgcaactttaccaaactcatttattggttctaaccattctttagagtctttggggttttctatatataaaatgatgttgtcttcaaacagggacaatttaacttcctttccaatttgaatgccttttatttcttgactaggacttccagtcaagaaaagtagaacagaagtgacaagaatgggcatcattgtcttgttcctgatttatttatttattttacagaaaaagctttcaacttttccacattcagtatgctagctatggacttctcatatatggtctttgttatgttgaggtacattccttcttttatatattggcaaattatagttgtatatatttatagagtacaaactgatggtatgatttaaaaaaaaatacaatgtggaataattaagtcaagctaacctacccatcacctcaaatttttgacgttttttgtgatgagaacatttgagatttactcttagtgtcagtgaaatgttcagtactcagttgttagctataatcaccacactgtgcagtagctctcaaaaaaaatcaaacttatttctcctacctgattgaggctttttaccctttgacctcatctccccattccgccagcccccagcctctggtaacctgtccctcccctcctagttcaaaaattgtcttcttggctaaatatgtttaagtcattgcccagcatattgtaaaagtactaattatgtatattcatatatttaaaatattcttgtaagcatatttatgcttacaaacaggaaagcactactttctttccaaataacattttagaaaattataatgatgaggatagctattggctaatatactaccttctgtggtcaaaattccagagcactatttaaagtacttcacaaatatttatcctgttttctggtgagaacatttaaatcctctttttttttttaatttttatttattttttattgatcattcttgggtatttcttgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacctctttctacacagacatggcaaccatccgatttctcaatcttttccccacctttcccccctttctattccacaaaactgccattgtcatcatggcccgttctcaatgagctgttgagtacacctcccagacggggtggtggccgggcagaggggctcctcacttcccagtaggggcggccgggcagaggcgcccctcacctcccggacggggcggctggctgggcagggggctgacccccccccacctccctcccggacggggcagctgctgggtggaggggctcctcacttctcagacggggcggccgggcagagacgctcctcacctcccagacggggtcgcagccgggcagagacgctcctcacttcctagatgggatggcggccgggcagagacgctcctcactttccagactgggcagccgggcagaggggctcctcacatcccagacgatgggcggccaggcagagatgctcctcacttcctagtacaggatggcggccgggcagagacgctcctcactttccagactgggcagccaggcagaggggctcctcacatccgagacgatgggcggccaggcagagacgctcctcacttcccagacggggtggtggccgggcagaggctgcaatctcggcactttgggaggccaaggcaggcggctgggaggtggaggttgtagcgagccgagatcacaccactgcaccccagcctgggcaccattgagcactgagtgaacgagactccgtctgcaatcccggcacctcgggaggccgaggctggcggatcactcgcggttaggagctggagaccagcccagccaacacagcgaaaccctgtttccaccaaaaaaatacgaaaaacaggcgtggcggcgcgcgcctgcaatcgcaggcactcggcagactgaggcaggagaatcaggcagggaggttgcagtgagccgagatggcagcagtacagtccagctttggctcggcatcagagggagactgtggaaagagagggagagggagagctaaatcctcttaaaaacatgttatttagggtattgcaaaggatagatcaaaccaccttaaagggggagaaatgtggagcagaagtttctcatgtaacctatcagctttagagctagattcatggccacagaggcatcagtgatctttctcacagcagacggaatcggagagaatcctccccagaaaatggtatctgacctgaaaactctgggtgcccatctctactgtgttctggccaatgaagaaggaagacttcctttccaactgcaatccagaaaggtctggggaagaactttggcccaaccggagccatgtgcccacccctcagacttagtgtgacaatgggatgaagagactacagttagcagttccagaagcacatggatgaagtgaggtaggagcagcctcctaaagatcattttgttaagatagatagcaaatattctccgattaaagcctataatccagttgtgagccaagctatctaaacacagcagaatacaatgcaaagccttaccaaagactcctttttaaatggccattgtaagttccagttttctaagaagttataacaaactcttatgtacttaataacagacccccaatatatagagcaaaaattgacagaaatatgaggatagacaaacccataattacagtgggaggtactaacctacttgcacagtttactgtatcaagaaaataagaagatggctggctaaacacagccaggtagaacagctgccaccaagggaccaggacaactggtatactcctagctgatcttcagagagaaagcactgagactggaaggagggaagatacagaagctgggctgaagtgggaggaagctggagctactgcacactgggattcatacctggcccccaacgactctggagaaatgggtgagttgaacaggcaaggagaaacctgatctcgccctgggcctctggaatcccggcaggaggaggccactcgaccaccacggaaacttgagttggccgggaaatctgcttagagaagtagtaggggcagcacttcagctggtgtggagcccagagggtttggcaggggagcatctgtagtggagcatggccagtgaagtccatcctcctaggctcaacttgattctgtaggagactttagccctaggagaactgtcagatctcaactctgtaggatggtcttgcttatcagatggggctggtcctacctgagtaccacttggtgcaggcctcatgtgcactgggggcccacatcatagctcctgcactggcagactatgcttgaccagtagggagggcgtcagggccatgcaccagcccagccaaccccacattgctttgccagtgcagttcctgtgtgcaggggcagatcttgccttccctgccccaccagcatgtgtgtgcacatgcaccctgccctgccactgctgatggagtgagtgcactccaatcctttcctcctactgtatcaccattgcagtgggagccttgatgggcacagagcccaccagtgccgtcccccgccagcacccaacccctgcactgacactgccacccgcttgaaactaggcacagagaacagtggaccctccccaaccttgagcggctacctctgcctgtgtgaacatgcacagagaaagcacatagtcctgcacgtgccagtaccccaacaccatgctaacaccaccactatctcaacctgtgcacatggttgccagcgggggttcttccacccgctggagccatgttagttccactgcagctgcaaatgcccacacagaggctggtagtctggcacctgctagcaccctgctgcagctaacaagtgtgcacacagctccgctgctgctggcatgtatgaacgggaatggatcccactgccaccaccctatgaaacgctttggttggcaccatccatcagagtgttgtgacagtggtctgggagtacctcagccccacaacccagaacagtgggttcctaacttcgaggtgccagagaacaaagttggggcccaaaaccagtaccccagagttagagcatgcagtctaggagttgggagctgaacctatggcccctaaaatcttctagaaatgaagccagttgactgaattcaccttataccacaatcaaaccgtcagggttatcaagagctataccacctctccagcaagggttcttaaccagactgagatggctgaaatgacagaaatagaattcaaaatatggataagaacaaagatcattgagatgcaggagtacatgggaacccagtccaagaatcacagtaaaacagtacaggagctgacagagaacatggccagaacataaaagtacataacctaatagagctgaaaaacacaaaaattttataatgcaattgcaagtattttttttttcttcttcttgagacggtcttgctctgtcatccaggctggagtgcagcggggtgatcttggctaattgcaacctctgcctcccaggctcaagcgattcttgtgcctcagcctcctgagtagctgtgattacaggtatgcaccaccacgcccagctaacttttgtgttagagatggggtttcaccatgttgaccaggttgttcttgaactcctggcctcaagtaatccacctgtctggccgtcccaaagtgctgggattacaagcatgagccaccacgcccggccaacacaattgcaagtattaacagcagaatagaccaagtgaaggaaagaatctcagagcttaaagactggctttctgaaataagacagtcaagaatagagaagagaatgacaaggaacaaacaaaacctctgaaaatatgggattataaaaagagaccaaatgtaccacgcgtttgtgtctctgaaagagagggggagagtgtaagcaccttggaaaacatatttcaggatatcatccatgatgacttcccagtccagctagagagaccagcattcaaattcaggaaatacagagagctccagtaagatacttcacaagatcatccccaagacacataattatcagattctccaaggtcataataaaagaaaaaatgttcaaggcagctagaaagaaaagccaagtcacccatcagactaacagcagacctctcagaaaccctacaagccagaagagattgggggccaatattcaaaactttttttttgagacagtgtctcacttctgttgcccaggctgcagttcagtggcacaatctcaactcactgcagtctcaaactcctgggctcaggtgatcttcccacctcagcctcctgagtaggtgggactacaggtgtatgctaccatgcccagctaatttttgtatttttagtagagacgggtctcgccatgttgtccaggctggtctcgaactcctggacttcagtgatctgcctatctcggcctcccaaagtattgggatcacaggtgtgggcctggcgtatattcaacattcttgaagaaaaatactaaccaagggctaggtatggctgctcatgcctgtaatcccagcattttgagaggccaaggcagatggatcacttgaggccaggagtttgagaccagcctgggcaacattgtgaaaccccgtctctattaaaaatacaaaaagtagccggggcatggcggcgcattccagtagtcccagctacttgggtggctgaggcacgagaatcacttgaacctgggaggcagaggctgcagtgagccaagatcatgccactgcactctagcctgggtgacagagcaatactctgtctcaaaaataagcggtggggggaggaggtaattaccactgactccacagaaacacaaataaccatcagagaatattatgaacacctttatgcatacaaactaggaaacctggaagaaatggataaattcctggacatatacatccccccaagactgaaccaggaagaaatggaatccctgaacagaccaataataagctcctaaattgaatcagtaataacttaccaaccaaaaaaggcctaggaccagatagattcacagctggattctaccagatgtacaaagaagagctggtaccattcctactgaaattactcctaaaaattgaggaggagggactcctccctaactaattctgtgaggccagcatcatcatgatactaagatctggaagtgacacaagaaaaaaagaaaacctcaggccagtatcctttatgaacatcaatggaaaagtcttcaacaaaatattagcaaactgaatccaggagtacatcaaaaagcttattcacgatcaagtgggctttatctctgggacgcaaggttggttcaacatacacaagtcaatagatgtgattcttcacataaaactaaacacaaaaatcacatgattatcttaatagatgcagaaaaggcttttgttaaaattcaacaccctttcatgttaaaaactctcagtaaactaggtattgaaggaacacacctcaaaataataagagcccagctatgatactgaatgggcaaaagtttgaaacattccccttgaaaactggcataagaaaaggatgccctctcgcaccattcccgttcaacatagtattggcagtcctggccaatgactgagacaagagaaaaaggtaaagggtggccggcgtggcggctcacgcttgtaatcccagcactttgggaggtcgaggcgggtggatcacgaggtcaggagctcgagaccaacctggctaacatggtgaaactccatctctactaaaaatacaaaaaattagccgggtgtggtggcatgcgcctgtagtcccagctacttgggaggctgaggcaggagaattgcttgaacctgggaggtggatgttgcagtgagctgagattgtgccactgtactccagcctgggcaacagagtgagactcagtctcaaaaaaaaaaaaaaaaaaaaaatggcatccaaatcggtaaagagaaagtcaagtatctctgtttgcagacgtgattctatatctagaaaaccccatagtctcagcctgaaagctctttaagctgataagcaacttcagcaaagtctcgggatacaaagtcaatgtacaaaaatcactagcattcctgtacaccaacagcagtcaagctgaaagccaaatcaagtatgcaatcctgttcacaactgccacaaatagaatacctaggaatacagctaaccggggaggtgaaagatctctataaggagaactataaaacactgttcaatgaaatcaaagatgacacaaacaaatggaaaatcattccatgcccatagataagaagaatcaatatcattaatatggctatactgcccaaagcaatttatagattcattgctattttcaaactaccaatggcattcttcacagaactagataaaaaccctattttaaaatttatatggaaccaaaaaagaacccaaatagccaaggcaaccctacgcaaaaagaacaaagctggaggcatcacactacccaacttcagactatattacagggctatagtaaccaaaactgaatggtactggtacaaaaacagacacattgagcaatggaacagaatagagaagtcagataaggccatacatctacaaccatctgatcactgacaaagctgacaaaaacaagcaatggggaaaggactccctgtttaataaatggtgctgggataactgcgaaagattgaaactggaccccctccttataccatatacaaaaaccaactcaagatggattaaagacttaaaacccaaactataaaaaccctggaagacaacctaggaactaccatctggacacaggaactggcaaagatttcatgatgaagacgtcaagagcaattgcaacaaaagcaaaaactcacaaatggtatctaattaaagcaaagagcttctgcacagcaaaagacacagcagagtaaacaaacagcctatagaatgagagaaaatatttgcgaactatgcatctgacaaaggtctaacatccagcatttataaggaacttaaacaaatttacaagagaaaaaccccattataaagtgggcaaaggacatgaacagacacttttcagaagaagacatacatgtggccaacaagcatatgaaagaaagctcaatatcactgatcattagagaaatgcaaattaaaactacaatgagataccatctcatgcctatcagagtggctattattaaaaagtcaaggctgggtgcggtggctcacgcctataatcccagcactttaggaggccaaggcaggtggatcatgaggtcaggagttcgagaccagcctggccaacatggtgaaaccccgtctctactaaaaatacaaaaattagctgggcatggtggtgtgcgcctgtaatcccagctactccagaggctgaggcaggagaatcacttgaacccgggaggtggaggttgcagtgagctgagattgtgccactgcactccagcctgggggactgagcaagactccttctcagggggtgggggaaaagtaaaaaaataacagatacttgtgaggttgcagagaaaaaagattgtttatatgctgctggtgagtgtattagcctgttcttgcattgcaataaggacctacctgagactgggtaatttatgaagaagagaggtttaattgactcacagttccacaggctgtacaggaagcatggctggggaggcctacggaaatttacaatcatggcagaaagcgaaggggaagcaggcacatcttcacatggtggagaaggagagagtgagtgaatgggaagtgtgacatacttttaaacaaccagatcttgtaagaactcgatcacatgaacagtaagggggacgtccaccccatgatctaatcacctcccagcatgccactcctccaacacgtggcgattacaactcaacatgagatttgggcagggatacaaatccaaaccgtatcagtgggagtgtaaattagttcaaccattgtggaaagcagtgtggtgattcctcaaagccctaaaaaacagaactatcatttgaccctgcaatcccattacacagaatagaaatctgtcataaagacacatgcacacgtatgttcactgcagcactattcacaatagcaaagacatggaatctaaatgcctgtgaatggtagactggataaagaaaatgtggtacataaacaccatggaatactatgcagccatagaaaggaatgagatcatgtcctttgcaggaacatagatggagctggaggctgttatctttagcaaactaacgcaggaacagaaaaccaaataccacatgttctcacctttaaatggggctaaattatgagaacacatggacacatagaggggaaaaactgacactgagggcctgagggtggaggctgggaggagggagagcagcagaaaaaataactaataggtactagacttaatacctgggtgatgaaataggcagtacaccaaacccctgtgacacgagtctatctaaataacaaatctgcacatgtaccccaaacctaaaaaataaaatcattgaggatatagacaatctgaaccatgcaattacgtttgatttaatagaaataagcagccaagaacccattccgtcgtgactgatactgaaacagtagtcttagctcactgggttaccttccaaaattcattccaagaagatttacatagacattgacattatagaaagatggcctaaactatcacatagggaagttagaattcacttactacttccgtctctcatcctttttttcctcctcctcttccaatgagttagaaactcgatgcctctgaagtcatcccgttagattaatagcagatctgtaactagggtaatgttctttctatttgtccatattattattaatttttttttaccatgtgtatagtctcagtaatgaagtagaaatctggtaaatggagacaaactacatttatgtgtctcatgtatatctgtaacaattttggtgagaaagaccccatggaaaaaccaatatacttgctaaaattcctactagaaagtcatttggaaattgatcagggcagccacgagctgaataaggagcacatgaaaaattagaatctgctggaagaataaaatatagtctgttcaaaacccaaaacctcttcaaaaaggtggaggccctggggcatctgctgctcattcttgcatagaggaagtactcttgtcaaaaggcaagtaatgtaatgagtcaagtaaaggaaatgtttattatatggattcttaaaaaaagtaaatgggaactatttattacttgtcggtaattgtgagttttatggctgtgacttcttatttgctgccaaacaagcaagtaagtgctgtatctcctagcgactccctccatcaccattcctggtactctgttgtcaaatggcctgtcagttggtttttattctagcatatgtttttagtaagttttcaaagtggggaatagttaaatctatttctccttttcagaagtcttaactttgcttggaagctattaacaagattgaaatccatagaaaaaaaaagattgaagaggaatttgctgcaatgttaacagtagttatctcttagcaatgaaactttagttaattttcctttcctctttgaacttatttttctactgtgaacataaattgcaaaatcagaaggaaaaaagacactaaaatagaaagcatttatggcaaaggtcatttaaagttattccatttctcaaggcaatcatttaatctataaaagcagaagatatttactgccatcatttatccttgtatcctccatagctcctagttttaaaaaaaaaacagccaggtgtagtgattcacacctgtaatcctagcacttttgggaggccgaggcgggtggatcactaagcccaggagttcgagaccagcttgggcaacatggcaaaaccctgtgtctacaaaacatacaaaattagccgggcatggtggcatgtgcctgtagccccagctacttgggaggctgaggtggaagaatcacctgaacccaaggaggtcaaggctgtagtgagctgtgattgagccactgcactccagcctgggcaacagaaagagaccctgtctcaaaaaaaaaaaaaacaaaaaaaaaaaaagttgggggggtctgttttcccttcccttgaatctaggcagtcttatgatttgctttgaccaatataaaaagccgtggaagtaggcttgctgtggtggctcatgcctgtagtcccagcactttgggaggctgaggcaggcaaattgcttgagtccaggagttcaggaccaacctgagcaacatggcaaaaccccatctctacaaaaaatacaaaagttagccgaacatggaggcacatgcctgtgaccccagctactcgggaggctgagatgggaggattgcctgagcccaggaggtagaggctgcaatgtgccactgctgtgatcatgccactgcatctatcctgggtgacagagtgagaccctgtctcaaaaaaaaaaaaagcagcggaagtgacattgcgggactttccaagccaaggcctcacgaggccttacaacttccactcttgccctcttggaatccagccaccatgggaagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtcacctccctccatagaatagcagaggaaggctaggaatactgctttaatggactgtctccccaaatgtcaagccacattaggagcaataaataagtattcttacttgacagtgtcatgaactaaaaatgctgagcgtaatctgaccatcagccagaagttagcagatttaaaatgagaaatacaccgtattgaaaaaagcaaaaacaagaaaacaaaacaatttttgcaccagtaataatggcagtaatagctactggcttttgaatatttattgcatgccaggctgtgttctttttttttttaatactttaagttttagggtacatgtgcacaacgtgcaggtgggaactgaacagtgagaacacatggacacaggaaggggaacatcacacaccagggcctgttgtggggtggggggagcggggagggatagcattaggagatatacctaatgtaaatgatgagttaatgggtgcagcacgccaggctgtgttctaatgaaagtatttaaccctcatataaccctatgatataggtatatttattgtctcctctttacagatggggataataatgcacagacatcctaaggaacttgccccatgatacataagatgggatgaaatttgtatctttcctggcttgtttccatccaagagtaagaagtatattttgagaaatgtatgtagttcacatggatggatttgtgtagttcatagacttaccctaggatgcaatttgaaacctcttcattctgtgatcatttatttattcttatcgtacaaacacctaccataagctttgtttattttaattcagagagtagttcttttcttctatctaagacattcaatctaatgccctgtttgattttattgaggtacagtttctaaacaaaagctttgtatttaactgtcactatggctcatccaattacaccctgttttacctatagccccctcctctttaccccattgtagatcagaacaaaagcttgaaaagtttgaggctaccattacagtttgaaaaatttgtcggaagcagactcaccctaggatgcaatttgaaatctcttcctacattctgtggtcatttatttgttttttcttcttttcttttcttttttttctttttgatatggagtcttactctgttgcccagactagagtgcagtggcgcaatctcggctcactgcaatctctgcctcccgggttcaagtgattctcgtgcctcagcctcctgaatagctgggattataggtacgcaccatcatgcctggctaatttttctattttttgtagagatggggttttgccatgctggccaggctggtctcgaactccttacctcaggtgatccgcccacatcggcctcccaaagtactgggattacaggcatgagccaccacgcccggcccatttatttattcttattgcacaaacactgacctaccataagctttgctggtgattcacagatactatgagtctactcttctagttatctgttgcttcatagcaagttatcccatacttaataccttaaaactaaagccattcattatatttcatgattttttgaatatgaatttggatgagtctcgactggctgattcttttactccatatggcattgacttttagtaagggagagtgggtacatggtagacccattaaatgaagccgtgggattcaggaggataagtcaccatagtatttgcagaaaaagtaaagattcaggagggtggggaaggcatacgtttttcttgaatttgtttcttgaggtagaattcacataccataaatttacctaaagtatacatttcagtggttttagcatattcacagttgtacaattgctaccactatctaagtttagaacattttcttcaccccaaaaagaaaccccttactcatcagtagtcacttttcatacccgctccaaccacagtcaaccactaatcttttttctgtttctataaatttacctgttataaaattttcatataaatggaatcatgcaatatgtggcctttgtgtctggtctctttcagttagcatagtgttttaaaggttcatctgtgttatggtacatatcagaactttattcctttttttttttttttttttgagacagagttttgctcttgttgcccaagctggagtgcagtggcgcaatctcagctcaccacaacctctgcctcctggattgaagcaattctcctgcctcagcctcccgagtagctgggattacagacatgcaccaccatgcctggctaattttgtatttttagtagaggcagggtttctccatgttggtcaggctggtctcaaactcccaacctcaggtgatccgcccgcctcagcctcccaaagtgcggggattacaggcgtgagccaccatgcccagctagaactttattcctttttatgactgaataatattccattgtagagctatgtcacatttgtttagccatttatcagttgactaacattgggtggcttctactttttggctattatgaataatgctgctatgaacattcatatatgagcttttctgtgaacatatgttttcatttttcttgggtggagtggaatttctgggacttactgtaactctgtttatagtatgagaaagtttacaatttacattttgaggaaaagccaaactgttttctaaagtacctgaccattttatattcccatcaaaaacgtgtaagattactgggcacagtggatcacagccgtaatcccaccactttgggaggctgaggcaggtggatctctggagcccaggagttcaagatgagcctgggcaacatggtgaaaccccgtgtctacaaaaaatacaaaaattagctgagcgtggtggtgcgcacctgaggccccagctacttgggaggctgaggtaggaggattgcttgagcccaggaggcagaggttgcagtgagctgagatagagccactgcactccaacccaggcaacagaatgagaccctgtccccacccccccccccccaaaaaaagagagatttctaattttttcacattctcaccaacacgtattatctttccgatttagccattctagtgggtgtgaaatggtatttcattgtggttttgattgggatttccctaatgtgtaataatgttgagcctcttttaatgtgtttgttagccatgtgtgtatcttctttatagaaatgtctattcatctcctttccctatttttaaattggattatttgcctttttattgagttgtgaaggtactttttatattctggataccagtagcttatctgatatctgatatatgccttgtaaatattttctcccattctgtgggctgtcttttcactttcttttttttgttttgttttgttttatttttgagacggagtctcgctctgtcaccaggctggagtgcagtggcgtgatctcggctcattgcaacctctgcctcccaggttcaagcaattctcctgcctcagcctcccgagtagctgggattacaggcacgcatcaccacacctggctaatttttgtatttttagtagagatggggtttcaccatgttggccaggatggtctcaatttcttgacctcgtgatcctcctgcctcggcctcccaaattgctgggattacaggcatgagtcaccgtgcctggcctcttt

SEQ ID NO: 11769 - DNA, 105919 bp, Human
  misc_feature (1)...(105919): n = A,T,C or G
gcaaagataatacttacctcaaggtttgactgtgaaaagtaaatgagattatgtgaattcacagtaatttctgacacatagaaaccatgctaataaaggttagctcttgattacatatataaaaatacatatattatacattatatttaaatttgtatccaactcatattaatatacaccttcaaaacaaaatttccttttcagtcactatgcagaatatcatggaaattctagactgtgggagccaataacagaaccggtagtgtggggtatgcttttgtagtacagggggaggggaggggaaatcctactggtaagaggctagtaaacaagacttttcagatcctttttgcttgggagaaggcctagccttggagggagctgagctgatgagtattcttgggagatcagccaaaggagtttctaacgttattgggtaaggaggaggggttgtcctctctcagtagccttgggcgagagagtccccagagtcccaatgagttcaaatcagccagaaaatcctttaaagtatttatcctatagtcccacagcttggggaaaatctgattaactccatctcaccagatgggctttacagtgaaatgtatagctggtttctaagattcaaataaggtgggaaaacagaggaagaaataacgaaatgtgagtcataacacatccctgtgtgtacaacttggctctgccatcaatttggagcaagccacagctctgtgaggctcagtttccccagcatataaaaggcgaataaaactgtctcctgtccagttggaagaaggtgcttttattccctctcaaaagggtgccagccacaacacctcccactcaacgctggaaactgctcaaagaatttctctcgtatttccctgctgcggtgaccctggagggggtctttatccaccagacttctttttggatattcctcctttctttctagggccaaatattataacttcagagctcttttaaaaaaaaatcagggatctggttcaactcttcccttttaaaaggataaattgagcccagagcacgtcttaacaaggaaccatgtgttttactcacatacaactgcattctttaaaaatcaaggcaaccttttgagagacctagagagattaattccatatcctctctcaccccaccgcttacacggaaagaagcttgggggtaggaaggggattgcgcagatctcgtccagcactctaagcgttaaattcaacccggagtctaacaggctattggccgaataccgggagaagatctggttttcgtagccgcgggccaatgaacacctcgagtgggagggtttgaagatactaaggagttttccccctttttttttccccctcaaccccctcccatcggctatcacccctcccatcccccacgcctccagtttgttaaattaatgcagtaagaaagtctgaagatctgaaggagtcttgaccaagggaagatgagcgagctcagaaaaccgagatgcatctgagacattgggcttcagagccccgcggggtagccagggaccccggtagcccctgaaacttgccctgggctctctgacgcctgcggccccgagcaatgggacaccttttctgcagtgatcacaacttattcggcggggaccgggaaacaggaatagcaaggcgacagcagacccgcacagaggcaggagaacgagattccgagactggattgcgatgcgccagcctggcacactctccgagatttaactgaaggcagcgccgtcaaccgctttcccctcgcccctaaccccctcaggccggcccagagccataaagctctgttctctttacccaagatgctcgcccaatccaacggtccgaggccagcgctctgatctccacagaagatttttttccttgcagggagctggccgtttaaacagaaaaacaggggtttaaaaaaaaaaaaaaaaaaaaggaaatatacccacccccaaacgtgcctccccagcgccgcagggagccaacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcaggtatgcaattttctactgaccacatcgctctgatggaaatggggggaaagagtacggaggctacctctgtccgtggtcccatcattttggggaagaggggtgctgtattccactgcaatcgggtccttccatcccccgtctcccttctcccccctcccaccccccgccacccaccccacccccgcccgcagggtgtctggcttgtgcgtggaggtctgagacagtcgctgttctggcagctgtttgcctgtttcttacggtttgtttgtccttctgtctgctacaccccccactattggtccccagccccactgcatgttggctttcactcggctgaggactttaaagggaagctttaggagttactcagtttaattaggactgcattctccctaaccgcagtgccgaaaacctcagctttcccgtctgggagccaagtgacaactagcggtgacggggaaggttgcactcaaactcgctggacacagatcatttcattttctgtccttttttgctgttgttttctttttctgcgaagagggagggggattactaaggctgagtgcttggaaacaatagtattataacctcagtgtgtaaagccctgaacttgggtgcagagtggatctatttaggaacatactgggaaacatttcccttttgaaactttgactgcctctttccccaacccacctttccaaactctgttagctgtagatcctgaactcatgagcaatcttcatttgctttgtttttaaatttatgcttatatttgactcaacagctgagttatcccatccactgtctctcaggttaaaattttctgcctgaagacttgtctttcttatgttagtagaagtgaaaagtgaaaaatcacctctttaagaagcattgaaatagatagtcctttagtaagtgtgtgaatcataccatcttcagagatggctatgataaattccacttatatgaattgaaaaacattattcttcttccatgacatgcagggatcattaatcttcctcattttagatgcctgcctctcatattttactgtggcattggattaacagtcatttgaaaaacccactccaaattgtttttaaaaataagtggtcaccaaatattaccctctcccaacataaaacagcaaataatttttgttttattacagttcataggaattgctgatttgactaatctgttggctggtttattaaatgacacctcccctcaaatagtaagtttctgtatttcagtctcttttcatgtctcttgagatgaagaaaaggcatccccccttatctgagatacccaatgctaaagcttctaatctcctgttcaaacaattattttgtaggccacagagtcctgaccacagatcagactgcaaatagtcagagagtcagatagaatgaaaaagtacaacaatccagggccttatgaaacgtatcaaaatgtggctactttatgggggaaagggcaggaagtattctatttataatatgagatcctttatcccctgcatatttaatagaactacaaatgtatggaggttgggtactttgtaacatttgtatgcaaattgattctctgcttggtctacaggagacagaactgaaccagagagatttaagagcaaattaatagaaccaagcacatctttctccccacacacactctctctttttttcttgatgagcagtatgcaatgcttgattttcctctccagacattgtctttcacaaaagggagactcagtctaaaaggtctggattgtagtcattttgataaggttatgaatccactgtgttaattcttcaactaagctggtggtggcctaacagaaaacatcattctacatctctttcccctacgtgcgtgaacgcacacatgagctacaatggatgtgggatataattctacgtgtttataaggaaagaagagttataactgtggagagctggaaatgtgggtggcaccactgcactttcaaaatataggaacggctacttcattaggggagtaaatgttgatttttgaaacacaatacagacaataattgaactcaggaaattcagcaatttttcagagagattaaaaaaaggtcacaaggaagcaaagtgagcagattgtatttgttcaattggtattttcatttctaagtcactcacttttaaaattccaggtgaaaatacagaagcattataatgtgaggacttattagaatgtatttgggggtagatggaggctggcaggtctctagcaggttccatgtgaataaacccttcttccccaggggatgggtgctgtgttggaatggccaatccaatcatctcagtcacccaggtactccttagaataaatgatgccagctgctcaccttgttggggaaatcgggggctaggaaaggctctcaataacagacatgctgcatcagcacataaccagcgaaatggcaataacaacagcaaaacaaacaaacaaaaacaaaaatcgagtgaatgaggcggaaatcccatatggtaccaacacagaggaggaactgggtcttagaaagggaaacatggggtcctggaagacaaaaagcattgcatgctcatcaactgtgtcttcataagtaagatcgggtgatttggctaaagttcctgatttgatattttaaaaacctatggttctaaaattcagtaagtggcattctgagagtcaataacctaaatgttttcccttattttcatttgagaatggggccctgtagccagactggtcaaaaataataggcaaatttttttaatggtagaagcacgtttctttcaaatgtcctctcaagccgaagtgaacttggctttgatccccagagcccttacagaggcttatggctgggtcaggcccagtatgaccccaaaattctcttgccttctgagcaactcaaacagacacatgtttctccagctctgcgctgttgacacttttaactggataattctttgttatggaagttgtcctgggcattgtgggatgtttagccgcatccctggtgctagtagcactacctccctgagtcatgaccatcaaaaaatgtctccagaccttgccaaatatacatcctgggcaaaggggagacaaaattgtccaaggtttcaaaccacagtacagaatgaccaaatttttaatcagctgctccaatgtagtaattataacgaggaggaaagtctagcttccttgagaaaatgcccctcatgaaatatataaagcaccctgataaaacaaaaatggacctagcatgtgcttgagaagggaataaaggcagggagataaaccagatctaatccctgggtggttttcccaaaagatgatcagcttttctttaatgtgctacttccctcttccatcccagtagatgcttccttgcactggattttgtactgaatatgccactcaactgctaacaaaggtcatcaaaaccttgaagggaagatgtttctatccacattaggatcaaaaggaaaatgacaaatacattgtttcatatctcagtcctaaagaaaaaacctacccagttgaaaggtgaatgggcttttccttgaggtggcccctgtggcttctccatctccaggcttgtcaagaagggcagatgactgtcttgatttttcccttcttgaaggagagctgtactccaccttgaatcttacctgctgcattttggcactgcagaacgtgcctaggagtttctgacatggcccaaggacttttctccaaggaatgaagttccttgggcaagtttgtattagcatcaaattaagtatttgattaattaagaatacttaatattaagtaccttatattaagtattcttactgtaaataacaaaaagagagtctactccctttttgggcttaggaaccttaaaaaagagaaaagaaaatgttacgatttggctcctgaaggacgggttggacagggaccctaggctggtaaatagagttatgaatcagcacatgacttctgcatatttgccaaactggtaatgacctaagcagaggatatttaggaaattgttttctttagattgtcttatgaaagaggttacggccatgtggtgcagcgggaagagaagttgggctataatttgagaactcctgcctctagagtcagctctgcttccatcccatagcatgggcataacaagtctcttcctctaatggggactcaattttcttaccaatcaactcaaatgactgaatctgacacttctacattctctccaacccctaataagatcttcatcaaaggcaggggcccatacccacaaaggttcaggatgaattgaccagtggtgatgctgccttcatttcttcaccaggaacttgtttatcatgtgcttatgtgtccagtctaaaactaaacactctgcaggcacagatgccagagtccctgtcattgcagaaaggggagacactgctccctttaaaggtacattaaaatccttttttccttcttcagaggacccacagagctcccctccaggcagcctgttcgcgcgtcctgcgacagcatcacatttatgtgggcgtcattaactttatttccttcatcagctggcagaagccagcatgatttttaagatggatggcacagtctccctgcctggccatcttgaaactattctgcaggttcgcattaaacaaagaggctttggcctaaagggaaggagacctaggatccagaatttagctagtggcatgaccttgagagggttctatgacctttctggctctcagtttcctcagctgtaaaatgaagagatttggccaatcacgttctaaaatcacttttagctgtgccagtttaggatatcttctccagatctcttccaatgatagcacagctttggttacagctattgaagtgtatttcaattattataagaaatagccacatcgaggtatagtcaggctcaaaggtctgaaagaactgaggacctcactaagcaattcaccttttggagagttatcccgacccagacatgattattgacagatcctatacatatgtcagtttctgtgggaaatgtttattatgatgagaaaacatgatgcctgaccactatactcacagatctgaaaaacggtgtgagaaagagagaccaaacatttctgtactttttatcaatgattctgtttggctcttttttccctcataaagcctatgtttttgttttttgttttttcaaaaaaaattgtttaccagataccattcatcattaacatatttttcccatctttattaatcaaaggcacaagtaaccgccagaaatactaaataccatgggataagcaatgtcaccacattgagttgacctaagaaaaaacaaaagtaaagatatgtgattctttttagttaatccagagagtcttgtcagaagtaaatatgcaatttgttagagcctttgaaatgtttaaaatgcactctgagtcctcattactatttcatgaatctcctatgtacccagggaccccatattgggaaacattagatttgatttattctatatagctccaagagaagaatcagagtaaattcatagattcatagattttttttaatgtactcttacaaatttggactcaatataagtcagaactttctggtagctctttcaaatgatactgtgggctgcctcagtggtagtgatggtgtctgtcagtggaagtgtgcaagcagagactggacgtccacctcccaggaaagacatagaaggaattcaagcttcttttgcaaattgagatttgtaatttgttgcagaagagtgaatgaaatgcaagtcagagacaatccctcgcaattctatattccctccttttctgatttccaaattgctatccaatctttgtaagctcttcaaatcatgacatgaatacccactaactgggatctttttcttcttaaaaatggattggataactaataaattggacaatgaacatacaaacaccatgcaacaaagaattattaaaaggaaatcaccttggttatgcaaaagcctcgttttaagaaatgagaagggcctcagaatgagccagaaaaaaactaccagaaaatgcacttgtccacggacaaggccacaggcaccggatggtgttcacaggactgacggcctctcagccttgaactccagctgtctccctgaaccaactccctgtaaagcctaacacacaaaatgaaaacactatacagccagccagcaaattcattcagaaagcacattagaagggaacaatgcccagagatgctggggagaggggcttatccacacagtgcctatgctttgtaatgcaagctcttatgaggggtactgaggccccaaagcttttgaaactccttacaaaggatccctttgtgattttctaaagttggtattgtccaagtctcctgaggctaattcaatgcaattagattaccactctctgcctttgaattgggctgtttttcagtgtccgttgctctaaattagtttaccatcttaacagggagctgccgacaatcattaatcccagccatgaaatgggcagcagccctgagcagcatgctctcttgcctcatattctgggcaacccacaggcacatggagaacaagcctctgctccctttctcacaagtacattcccaactcttccacctgttcacccccagagaattgcactttccttcagagtgtcttgagtatcaacagaatcatggaatcttgcggtaggaaggactcttagctctagaattcaatggctgtcaaagttagctgtgaggggcttgtcaaaaagacagattcccaaacatttgttaagaggacagatcttatattaagtattcttactgcaaataacaacaataataataacaaatatataaaagagcaagaggaaacttttgggggtgattgatagtttatggcatagattatggtgatggtttcatgagtatatacttgtctctaaactcatcaagtcctaaatatgtacagcttttgtatgtcaatcacacctcaataaagtggttttaaaaattaaataaaatgaaatacagattatcaaaatcatatcaaactactgaaacagaatctctcagaatggggacccagaaacccataatgtcaacaagagtctttaaatcagtgcttttcaaacttcagtgtccaggatcacctgaggatctgctaagatgcagattctgactcaggaggtctggggtaggcctgagcatctgcatttccaaagcgcacccagaagattgatgctgttgcttccttggaccaaaggtttgcacagcaaggctctagatcattctgactgagaacgcctgacatacatcaacccttttattttgcagatgtagaggggataaataactacctcaagtttatagagtgggtgacagagctctcaaagccatagataatccccaaacttactccactacatatcgtctctagagtccatacaccctaactttgccaccgcactttctttccttcaatcctcccacactctgtcctttctcataaacacaaacacactcacccttccagagggttcttcagggagctatccctatccccaaactggtggcctggtctctgaagtcctggtgcaccaaaagctctcattcacacagctgggaactctatgtgacactagataaagagaaggggcacccgggcaatgagttttaaatcctggccctgggacacagcaatgagagtctgtcaggattgataaaggaggtgaatcaagatggtcagaaggagagggtatgtggtttctttctccaaagataatctcacttaacagtcttcctgtgtacgttgtactctcaactttgcatagctagaggcttgcttaggcctcccagatgttcagagaccactgccacattctaccacctgtctgacctcaggaccatgatcttcctttttctccatccctttaacctgtcagcctttctgcaaatcatgtcagtattttacacaccagagtaactactatgatcttcagccttctgagagctgcgtgtttattgctgtgtgctcagttctgcaacattcgccagctccagaggaatgcggcaaggctgctgcaaccctggctgccaggcagatttgcagtactgtcttataaaaagtacttcacaggttatagcatgttttatatccatgatctcatataagctgcccaatcaccttaaaaattagatataggacaatggttagtatccccattttagagctgagaaaactgaggcttaaagaaaaaaaggtgatttgccttttggtaacagcaggtaaccatgctgttattctcagagtaaaaccaggattcaaatacagatctccttgctcctccctcaccatactgatacatagagatagacagatagatagagatatatttatgcagccactttgagctggtacagctttcagtctaataaccctccccctctaccaatggataaaaggggtggaaagaagcctagaaaaaaagagctggaaatttttcattggcctttggtttgacagagccttgttcttcctactcttggccagataggcatttatttctctgtccttgatcacgtttaactgcacaatgtctgcatacattacctctttaaggaattataatactacaccaaagcctgagatcccctttgataatgacctctaggtccctttcaactgttatcctttttgataattttttattcatatatatatatatatatatgtattacatatacattacatacacacatgtatataaccattgaaatatacaatcatttcatggaatcatattttctatgtaatttactatttgttttgttcacatattaacatgtcttgggaagccttacctgttgaagcatacagttctacttcattcttttaaccactgcagagcattttatgttatggatgtcccattgttttctagccatcccctattgatgaacacttatactttttctaattttcccactgcaatcagtgctgcaataattacagtgtacctacaactttatgaaaacatgtggtatttctccaagtagataataagaactaggaatgaaactgctggggtacagaaaaaatgcatcttatatgttgatagataactgcaaacagatattcctttcttcctgagccttctcttctgccttccctcaggatgccccatctcagccccaactgcaacaactcattaaaaataatcattagcatttattgagtgtttactgaatgctagatactatgctaacaacatcatataccctacctcataattctcaaaaaaaatactattatgttctattataaaagtactatcctatccccattttacaggagacaagactgatacataaagaggttatgtaacttgccaaaggtaagacaactagtaaaaggcagagctaggattcaaaattgggtgtgactatagaaaacactcctttcaccattaccctgccactattactctaagaatgaaccagggaggaggaaggaggagactagactggatgagagagacgaaagatatgaatttgcctctctagaaaatcaagagctaatctcttgcaggtggttctggatagttaaaaagttattaacatgcatctgtaagtagatacgagctctcaatctctatccttgacgtacaagagaaattgcactagctcccacccccattataaagtgtgtggttagagctctgacaaggggtagagatggtcagccactgaacgtcctttctcctttgtcccacctgccttttgaccaagatcatttcattgagaaagctagctaggaatgtgggggagaatttctgactgaatcaggaggtcaagaagaagggcagcatagtctctggcccaagaagagaatttttaaaagtcttggtcccttatactcagaccaaagacatttttagctgtgttctctaacccccagacacacaggagtatacccagtctcccttatcttctgtatgtgccccacctcaagcactaaaggtctcaccgcatgccccagatttaccactcccaaagcagaccttcaaagcaggtttctcttaacatctctaagccagaaaaccacatccagcccagacaaggcaaggggagcagaaagggccagccctccataatagccgtcagcatcacccctgacatggcctgtgggaaactcaggcaatgctgtctcagacatctgttttcaatagctctctgagtgacaccagagacactttccaatgtgtccctacaagccctattgctattagagaaaaagaatacaatagaaataaagtctcctaatatcaactcttaaaatagacctgctggtttgtcattttgttttcctttattttgttttttacactacaaatacatatttgttgtaaaatattaaacagcatagggagatatgtttgaaactaaaatacatgtaaatcttacttcctaggataaatcacttaacggtttgatattatcctcctaaatggttttaataacataataataacaaaaacatgagtgcttccttcgtgcctgacacctttctaagagctggatagaacttaacccatgtaaccttcagaacaatcctataaatcatatactattattcatttcattgtacagatgaggttaaatcattttcctaggatcacccagcttggaagtgtcagtgtgggattggaatccaggaagtgtggcttcagagagcctttagctgctgtgctactgtagtaagctgcttctgttttacaaaaatgggattattctaaacaccatgtttggcaacttctcttttatcactcaggaatatcttgtcagtgtgcatatggatctacctcatgcatttttgcagttgtgctgcccttctcttgaaaatgccaggttttaacataatacgaaactctcagcttgccgcacacagcccccactgctatttacaactcctttacttcacacaaactgaattccaacccaaaatggatttctcattgtccataagcagtacatccataagtctcacctctgtattgtaactcatgttgtgccctatactctccataaatctggaaaacttccccctcactctggtgtaaaagacacaccaaccagctctaggttcaaactcatctgattttgaatcctgcctatgttacttccttgctgtatggtcttggcagtttgctcaatctttctgagcctcaagttcctcatcttaaaaactgagaataacaacttcactgatagatacacgaagtcccacttcaaacacattttcctatcagagcacaatcccttaacaaacggtaatttcctctccttctctctgagatgctatccatgccttaagacccatctctagcatcatttcctccatgaattgtccctggattgcctctatacctagccccagctgggcacggactcttcttcctaaatcctcttggaaatataggcattatccttagcactcagtttgtttaaagggaccttacatacatttgggtgtccctctagctttcctgttggattgtaagcccctcaaagattagagcttaatgaatttcttgatgcatgtgaaaagcaaacaggaagaaaagagaaacatctcctggtgcttttcagagttttcagcttactccactaccccctcatagataatgtcatcccaggggttcatgtatatcaaacactcagtgtttgttaaatcaaattgctttgtccccaaatgcctgctcccatcctccttctattggctctgcagaagcccaggacctgaaagattccaaacaaccaaccctaaagcactgctgtatctcaccatgaccactttctgctccaagaaatgagtcacagtgagaatgtgagctagatatggcagcgcagccctggctccgtagctgttgcagtgagttgctcgctcaacctttcccttgctctctgacagggcatgtccaaactctgggcctctcaaaacatctgagccattgcagataaggttgctcttcaccatcaccaagtcctgcagagaagccccttccataagacaaggaaaactttctaaaataattttaaatatgaagaaagtatggacttacctcagttaaaggtagtttcctcaatgtgacctaaaacatctagtagaaaaaaaaaaaaaaaaaaacagtcttcacaggagccaaataagagactgcatcatgcccagagagagggtgcttgaataaatgtattgaatatggcttggactgtaaaaagctatgcctactgaaaaaaggaggtgatacggcccagaaaaaaatgtaatgctccatgctgcccaaaattggacagcctagatattagagcaagattttccttcccctgcaaattctgctctaactttgtaactagtctcagcttttccatgcctaaaatgagacagaactatgtaaagactacaggtcattccagctgtcattgcctaattcttaaattaagttggcatattgaaggcccagcagttaaaaactctagcttggggccgggcgcggtggctcacgcctgtaattccagcactttgggaggccaaggcaggcagatcacgaggtcaggagatcgagaccatcctggctaacacggtgaaacctcgtctctactaaaaacacaaaaaaaaattagccaggtgcggtggcgggcacctgtagtcccagctactcgggaggctgaggcaggagaatggcgtgaacccgggaggtggagcttgcattgagcagaggtagtgccactgcactccggcctgggcaaaagagtgagactccatctcaaaaaaaaaaaaaaaaaaaaaaactctagcttgggaatcaatcatacatattccgaaatcctagttatactacttgctatgtgtatgccttggagcaagattatttttaaaattgctaagcctcgattttcctcatctgttaaatgggaattataattatcccttcctgacagattatcataagtattaaaagggagagggcatatagttggcattgcatatggcaagcaacaagtgtaaaaagcaggaaaaccactattactataattaaagtaggataggtgcaaagtgttgtgggagcatacaaaagagcctgattaactctgtctggaggtgggagatggtataaattgaagacatttcacatgactcaggataattaaactgggccataaagaatgactaatttaccaggtaggcaaagagtatcaggagagtgaggcaaacaaaggaaaaaggcttgcagaacagtcaagctgaatgatgttgagctcaaggccactgggtaggccaggcatccaccctgttatgttggctcagcccagtcctgctctgccctattctctcccaatgggctttctatcaattagaagcctggctgagagagaataatttgttcattatccaaaaaatatttattaattcctacgataaccaggagttgttctaagttctggggatagatacattgaggaacagagtcatggtccctgctctaacacaccttaacttctagtggggggtacaaacaactaaacaaatagagaaactatagaattgcaggacctagtaagtgctataaacccaataaagcaagagagggtaacacataacagtctactatcaactccaccctcaaggtgcctacactttcatacatctccattatctcccttaagccttatattataggagatgggcaggttggagaggactgtttcttgttatagttgaggaaactgaaaccctgaggggaaaaatgattcatccaaagtcacacagccagttagtatcatgggcaggcaacctcattccatgcagaaaagtcaaaaatggccaggatgaatgattacgaggagtggagagagaagggaaggcaaatagcaaaacagtctgtacagtaggatcccatttttatttttttatatgtattaatgttctcttatggggaaaaattctacaaaaatggactgaaaactgtttatagttgttattgtctcttgagaatgagaccatggggaacttttatttcctgcattaaatattcctgtaatacttgaatgttttacaacaatatatattacttttgaaaagctggaaaatatattttttaataaaagaggatgccagagagtatgggcattcaaccaaacttagagcccaccttaataaaaggcaacctgtaccaggtaggaaagaaagacatttggagtcacccaaaccagtgccgtcttgattgttttctctaagtaaaaatcagcctagaggctgaaactatttcgtgtatttaggagaattttctgaacaaatggaagttgcttttcccacagaagtcattgtgctggaagcaaaatgtcactggaaaatggaaggctagagttatattataaaattgggtgctcagaacaacgtgatggatggtacatactctcatcagggtgactggagccctacccaattcactgtgcaatttcataaaatactcctactcatgacaaaaaaaaaaagttagagatggaaagaattacatgtcccagttgtttcagttcccagggaggaactgtggccagagggaaagggacttgtccaaagtcaacagtaaattaatgtccagcccagacaagaactgagaattccaagtctcttattaccatgacaactttccctaaaatcaaatcagagttacaccaatagtctacaagatacactataatggtacaggataattttctcttattttattttactagggaccagaacttaccaattccattatgatactgataacatttaagactaaaaatcaaattaaaaataaattaaataacagtacataaattgggcaaaacttattatatgacatgcaagtgattttggtttggagaatacagcactctgtcatcacatcttaaacactacctgggagaaaatggaaagtatcagaaggacttcttaaactgtgtcagttctgagcaaggcctaactttactcttaacttccaaacagcttcttctcagggtaagtcatgaccatgggctgcaatttgaattcaaatggttggagaaaagatggtgcctttgggtaaaaagtgcacacattcaggaagcagagcacagctgagatcaggtcaccctttgtgtaatttgctgagtctctatttgagctatattcatagttttcttttctctccttatgttagaatgacatctgtgactctcgacccttctccttatggacagaaatccctctaaataatatttataattaataataccagcgaatatgaataacatatatttagaacctactatatgccagaaacttttcaaaaaacttgatatgtattaactatttcatctttatagctaccctgtgaggaaaatactatgatcatctccagtttgtaaatgaagggactaaggcagtgatcttaccaacctaggacccctttagggcaccttggcaattcaagttcaaagtcttcatatggagaaagacagtggacaaacccctccaaagacatggcggggtaggatggagaaagtagatagagactctgaggaggaaaattgaggggctcaccccaaatcacagccacaatgggaagaacttgacaacacacttccctttcagttcttctacccaaaatcctgattttgttttcatttaacattatgggattaagaagcaacaaacgagaagaaagagtattgagcaagaaataaaatgaacaatttaaaaaaaaaacaagaaaggggagagaaatgtggagataagcagagtaataaagagggaagagcactcaactcaggtctactctgggttccaccaaggactcattctgtgagtctctttctgtcttggaaatgcattcttctcatctgtaaaatgaatgagtacactgtactagaggacttctaagacctccctcaactccatcatcctaggattcagaaacaaatgaaggaaaaggaataaggtagagaaaccagaagggaaaaagaatgtaggagggaagaagcaaaggttaaggaggaatgatgacaggaggaagaaacaagaggatagagaaaggaagatattttccaaagcagttggaatctgcttatcttgttgaaagaaaaggaaggatcctcacatcaagaattccaacaataaaagctttctcttcatgcaactaactccatgtttcctgctggtgggacccatggctgatgttggtaggagcctagactgatgtctacagaacaggggcctgaatggatacctgggaggagacaggatgctgccttgttctcaaagcccaggaaggaaggctgctgagagagccctcagaagggcggcccttcctcctcttcctcacctcttcctccttttcctcatccacatcttcctcctccaggccagattatggacaacaattattagcatattcccaggctatggggaaagtcctggggaaatgactagagaatgtgcccaagggagccacaactgcaacattacagcattgtgcctgctagaaagaatcctgggcatcatcaaaaggagaaaatcccaggcaagaaagagaccttccaaggtcatcttctccatctcttgcctctgagcatcccttccctaattgcccaggggctgcaatccaaaccaaaagatttagcacagaataatactcagtcctatcagctaatcttttcacaactgtctgggccatcccaggccttgagacttttgtagacaaagacagtgcctccgattgattgaactctaatgcatatggcacagtgctgggcatatagtgggctcctcaaacccatctgatatttgatccatagggtgacatgatttattagctgtgtggttctaatctttctcccaataatgtctattctattgcttaacatttcagtttgaatattcttccttttgtttattccactgcccctgttttaaagtccaacctgtcatttgcctaaggggacagaaattagcatgtacctgccactgcagaagtgaagtaaaatactcacctaggaggtgacctctccaagtctaaaatttttcccagtgaagaagtgagtagacagtgtcgccaaataaatgagagccacagatacaaatagaaagattatagataatttttcgcttaatatataaagagcaacttctgtataccagcttcttggctaaacaatttatctgtattttttttttgtaagtcttctaaaattaggccatattcttagtttatagatgaagaaacaggctcagagaagttaagcaactttccagaacacccaagtaagtaataaagtcacagttccagcccactcctcagctgtcatccttacagcatgctactgagcagagaagttcagcctctccttgaatacttccagtgacaagaaactcatcatctactcaggcagcttcttccattgttggatggctctaatggtctaaatattctttcctcacatgtatcaggcagccatcttgctctttaaaagtccgacaggtcttccctagtcacttggaacaagtcagtgggctgtagaaggtactcaaactataaaattagaaagacctggctccattcctaccattccacctattaaccacgttaactctcaaccaagtcacttctgcctctgtgcctgttacttcatctgtacaatagatacacaaatacatacctcatgtagtgttttggagaagaaaaaataaataatatttgcaaagctcgatgtctggaaaataaaaatactcaaaaaaattattttattaagttgggtccctcttcccccaacagcccaatggaccgatcccttctgcctaagtcttctctgagccaaacacccacagagtctttaattattccttacaggtcaatttcaagtttgtttaccagcccaattgttcccttttggacctgctccagcctgttaatgtccctcttaaaatgcaggacctacaactaaatataataaattagccaagatgtgaagtacagcccacatccggtatttcctgcattcctgactctttcagtcttcggatttttctaagttcttaagaattattaggttaaacttaggctggcataagattttagtgcagattatttgaaccttatttttatttgtaataattgctaacatactcagtagtttctctgtgcctggcactgcagttctcacttgatatgtattttcttacttagccaaacaattatagaaagtatccctattattacccttattttactgataaggaaacaaattgaaagtgttaagtgacttgcctaagatcacacagctaataaatcagaacccgctaataaacggcagaatcagatttgagtccaccatgttatcccaccccccatttcgagcatttagggaatgcttgcaaaatgtaagtactttcagggatttaaaaaaatgaatatgacacaggcagaagacatatgcagggcaatttaacagaaaaggaaatgcaaagcacgaagcaatgttgggcttctgaacaatctgtcactaagagctcgctttctcccctccagcacgttccaatgtctacaatttcatgggcaatgtgagtcagtggaggaaaagggaaaaggtggaagcagtcacctctctccttttcaacttttacttactcaccgttgacttcagcccttgcccctagcacactgccttatgaagaattaattttcaatgacagccaagttgctggtcctggggggttggaaggggctcctttactctgctatggcctttctgcctcagaaatatttctagctttgactcagcaattttgcttctaggacatgaacagaggtttgtgaccaagggggtttttccagcataatttataatagctaaaaattgaaaataatataaatgcctatcaattgtgggagagcaaaataaatactaattttaaatgactgcatatgccagccacacactggcatatgcagtcatttaaaattgtgtttctaaagatttaatagcaatagaaaatgctcatttagaatcttcagtcaaaaataaagaggaaacaacactcattatgatctgtagaggaaaaaaacctggaagaaatttagcaatatgttaacagtagatatctagataatgggttttctaggtgggttttcatttttttccttgaacctcattgtattttcccaatgtgcattttttgctttaatcatcagaggaaaatgttatttttttaagagttgaaagaatctggtctgagggcaaccagccagcttgtgaaaaaatagtttttgccactggacagtttccatatgtgcagcagcaattactgctctgttaccatcagatcgtcttaatcctattgactgaaatgccaaagtaatactattaatttactacataacagataaattactaagagcatagtagaactacctgagattgctgtggtactcttctagggtcagagtgggtggcccttctagattccaatataaagcacaaaaagcttctggaagttcatatattcatcccccatcacaaagcctagatctgccaactctctttgaatcaataaaaattgtattgaacatttacactgtgccacacaccaaagtgagcactgtaaaagaatgcttattccttacaacaagcttacgaccaacaactactatcaccctcattttacagatgcagaaacaaagatttagacagaataagtaacttgtccaaggctgcacagctagcaaaagccagagcctgatttgaggccagagtccatgtgcttagccctggagcatgccctttttcagccaaaaaacaagttcttatgctttcttccacattattttaaatagtaatttaaaagttagagcaggagctatctacacgctatggatgaggaagctggtggttacgtgtagtaaaggacttgcccaagatcatacaaggaagaattgcaacagatagaaatcaaacccagaatctctgactccacatccacagcttgtcgcatttccaaggttgcttctctttgcctctgagacacgcaacaagcagcagaaagcagtgggactcaggatcccgtttggtccccctgtgtgttagaaaggggtgacctgctggaggatcttgaaggtacagggtaaaaaggacagaaatcccaagaagagaagaaaacctcagcaacgaccctagagctcctttatcctgaaagggtaaaggggcattggccacagagccttgttgtttcttcatcatccatcactcttccttccatctcgttaagtcccacaaggtgtcaatgatacttttcctgaattctcctaagtaaatattccttctagaagcttatactaaaccacagaagagtagaaacttaaaaccatgcatatttgaattgagtgagctgttttagcagatttgaacagctgctccaaaacttgcgccaaaatttcacctcgattagatttatgtatcagctctgccactaagtcaccttgattaagtcagtcaatctccccaagtctcagttttctcatctgaaaaatagaaaagaaaatgcttgatgtttcataaagttgttgggaagattagaaagcctgtatggaacagttcttaactgtggatggcacctagaaagcatttggtcattggtagtagcctttgctattctcagttaatctctgagtcagttttcttatctataaaatggagatgatagtcttgcaggggtataatatacatttattaatttatagcaggtgatcaatgaatgtcttttttaatgcacaggatgactaggtctcgtaattctacgactctactactcacttcttgcccaagactttggaacctgctgagtgaaacaaagaagttccaccccactgagcatagctgcagctctgactctgtcttagaggattcaagggaatcaacaaaggctatttagagagcattattagagccctggagagtccctaaaactctgtatttacatgcaaatacccacttcagctaaaccctatcaactcacagttaagtgctcactttctgaagaccagtcactccatttattaaaggcagcttcaggttttaatccaaattgccctttctacaatttaaaatcatttcttcctcagtgcctactgaggattgtttattttctgaacatcctcctttgaatcatagtctttggatacttgaagaccacacacatcccagctccactcctatgaaaactctgttttctctggaataaatactatagttttgctgatgcatttcctatgggtccattgcagcttggcttttttttccactctgagattgcactagtatagacttggaagggaaaagtgatatgttttttctaatggctttggacattaaagcacttatttgttctcatataagttttcctctactagtttgagagcccctggaaagcaatggctattgcacattcatcattaatatagttaagagagaagtttgtaaggtcaggtgaacctggataaattatttaatctctatggacctcacttttctcatcagaaaaacagaggtaattacaccccaactcaaagggttattttgaggattaagtattgtaaataaagcttttggtgtaatgcctggtacagtacttcataaccactcaataagggctggctgttattattttatttgtaacctcctctaacacctactataatctctgacaatataataggcacttcctaattattttaagtaaataagtaaatgaaataataaactaatgctatctaaaatgagattatcagcatctaaaagtacctaatgaataaagttgactaacctgagaaatgaaagtttatttccatagcatctgtaaaattactgtgatcctttgccattctaaaggcagatagtattttcaagatgagctaactgagaaaagggtaaaacaaaaggcaagttgactacagaggaagtgtgacagaaatgatgtaataaacagtcaagaaggtattgtccgtaccgtgattggttctggggaatggccaaagagtcaagcagaagataacccagatcagacctggagcgctccagttatgttatggttctaccatctgagactgagcaggcctcctacctttcaatcgagcctcagtgtcatcacctggacatggagatgttgtcacagcgctggtatgaggatcaaatgtagtgatggatttagaagtgccataaaaactgaaagtgttacatgtgtgcaaacgattatcaattacattgttcccaacctatattttccaattcccggagctccaaaattctcagttataattccagagttatggggaaacatttatatcacgaaccagagaggcttctcagagggactctgcaaatcactatcacttggaagagtcaataaattatagtgattaataccatgggcttcagagaccagttgtctcatggggctaccacttacaaactgcataacctcaggtaaattttctgaaaatgaaagtgtcagcttcctcatctataaaatggggataatgatgtcatcttcatggtattgagaagattaaatccagtgaaatatgtaaagtatcatgaatgatagccattactgtcattagctaatatcatgtcttcatctgtttttatcctactgctatgtctcctcaatatctatactcccaggcctttgcaaactcaaatgaccaatgcctgctgattaatgcaatctttttccccaaaactttctgtccaaaagcctgggctccattctctgcaaagacacatttctccagtgagatttatctgattaaaaagaaagctgcattgaaggtaatgagagccatttgctcttctgtccaactcgtgggatgcatgctgattatgtagggccttctaagagctttccctcagtcagagtaaaccccataggcttgttcttcaacactcaagcctctgaagaatccccctggattcttcacactgtaactcatctgagggccacttgatgcccccatgcttaagccaagcattctttcaccgtaggaccagactgcagaataacactgaaggtcagaggcatgggaaaattttcccaagtgagacatatacacacagttagggcaaagtgagatggttgtggtagcattataaataaggacataaggaagcaggaatgtggggtttatgcgcaaacataggtttgacctaggccagtggtccaagacatttcgtgtgaataccactgaaagaaatgactttttctcttatttttctgccttgtattttccctgaagacattaaatattttccccaggggctgactaagagtatcagagccagagtttaggactctttggactccagtcaaatcatatcactgatgccaaataatgctgcacagctaaattaagcttcctctggaatttcgggtatatatcatccatttaacaaatatttactgagctctgactatgtgccaggctctgtacttcatgaaaaccatgtttattaagaggctgaaaagacgtttgtgaaaatcatgttttcagggttttgtctatataacaccttgatggccccaattctgagaaaaaggaaggttacagagctgaaagtttggcttgaaacagaaaagaccaggactgtcatgacttcagccttcacacatgcacctggagtaaggagaaggaagatgagaaaaagaaaacgtcaatataatgtaagcaaatacagtgtggaatgccagaattggacagatcaagtcacaagccacaaaattgattaagcctcagttttctcacctgtaaaatggagacaggcatccctacctctcaggctatttgggggataaaatgagataaaatatgtaatgtgcaattcagagtccacattaggaacagcaggtgctcaattaatgtcatttcttgccaccaaacaagaaaaacaaaaaagctttttaaaaataaagcaggatgctgtaagaggtaaagaccccctcatcgggcaaatagatttgatcatctacaggaaatcccaccctgtagaccaagctccgggatttaggatgttgtagcagggccaggactagagtgaagcaggtgaggcacaaaatttaatgaggtgctcactctctggtccctgcaagtgcagggttggcatttatgcaaccctgggattgagtgcctccttaaattttactaggtacctcattcttctttctctaggtggccctactttgtggggatacatacgataaggcaggagagttagtggatggaaggctatccagaggaaaacatggaaactgatgctacagagtatatgggatccctagaggaccagacttccttagggtcagaggcagaaccagatgagattttaaggtttagtccagctccaagaatccaggattttaccttgctacaagaagaaaatcatgttcaaatacatgtgcttcttattcagataagcgttccctataggaagcagtcataactgtgggaggtaggacaggaagggggaggggtgtcttgttccataagaccctgaggtgaattgggctcagggcatgccaactgtgacattctgttcccaggggtgcttagcagatcatgaagtgacagtgacagtaataaaatgtcaagcactccctggccagcctaagccccttactgcaatcaaataaaatcagaattgcacagctggctgcgggaagccagatgctgacctgatgatccaactcagacaaagctgagggtgaccagcagggcccaggctgcacaacaatccccaagtcccttggggtcagagccggggatgggaaactggctcagcctagaaagccaagagtgccagcccagctcagccccacctcttcccagaagcccaggacacccaccactcctcaccatccaccatttctttttcatttagaaaaagaccagcccacaggcaatggggcaggagaaagctttctcccctgaatacacaatttgaaaatggcaaatattgggtctttctaaaagcacacagaggctacaattaataaaactcagacaatttctgattaatccccgccttcccctcaaatactgccttccaccactgagccaccatagcagtccaattttgccacctaagcagagtggcagcctcttataatttcttaagtacctaaactattctatctactggacagtaaataattagagggcaaaggccagtcaaatcgaatttttaattactactacatgccaggcactgaacaagacagagcctacccacaagtatttcatcctcatttctcatcatttcccattctcttctctccctccctccttcatacacacactaaactcttcttttggttctccaagttgtctatcacttctaaactacacatgctgttccttctacctcaaacactcttcctcctatatttttccaggccaactccatatctaaccttcaagttttatttaaaaagtcattttctccacaaagcctcttggagacttctcatcctctcaccaagtgtagttgggtacctgtccactgtactcgctgaattcctcaattatagtgctgactgtgcctcaaactccttcgtttttacagtgtcctcttcctctttcacctcccacctccctgtcttcaatctgcacctccaagttcctcctccagctgtataggtccttcctttggttactctcagcctcttagtccctcttctgccccctccttgtctttcctcccccttttccatcctgacctcctggacttctctgctcatggtaaactggagagggaattgactggagggatcccctctgctgacccagagtggttcttgggggtgtggtgccatgcaaaatgtagttgaaattgtttctccccagtcttactgcaaccctagctcatctgtaattcagattgacagctttatattgattccctatttcaattgatgttgcaactggagaatgagaatctgaacattgatctggcctttctcccaagtaaaccttgagaaacaggttggccccttggagaaaaaaatcttgagactaggtgaggaagaaccaagacacaaaatcccattcctccaaaaaagtccagacaaatctggatcccgagaccagtgtatgaaaaaaaaaaaagaaggaatattatagactcataaaatgatggctgagggctggaagggctcttagagatcatcttaatttcattgtgtaactggggaaactgaaagccaacaagggaagtgactcactgaaggtcacacagcccctacttcattatatcaccctgcctccaacccctctgttgaactctactcctggagctttgcatggtctctgtcattagaagtaacatctgaggtcctttaagtaccaaaatctcttagtgtgacaaatcccctgaccaaaaggtggtggacagtctagtgcatgctctaatccccacatacatccataaacatccatctatttgtatacataacatacataatacatcatacctagaaacctactcacatcacacaaactcacctacatccatagacactcacaaagaaactaaaatatatttgttcctcatcctgtccaccaaaactagctcttcaggatgtaaggatcttcagattattatgcaagagtgtctaaatagtcctagaataccctatgaatcttcaaagcaatgccagattgctttcagtatttttcatttctgtgtataatagtctaatactttgtatagtcagtgcatctattgcaataagccttctcagtaaggaatagaaaacttggtctcagaagacctcactctctttctgaaaattaccattaatcaaatctgcctaaactgagtctgattcacccattgtattttagtaatctctgaaaaaaaaaaactgcatcatttccaaatactgttataaggttcagaaaattttaacaattgagtgtttcatttctcagattcattcccagctcctctgtccagcagctcatggtctataagcaaatgcttaagttaaccgggaattgtggtactaaaagagctccccgatgcatatctactctacacagatgcacagcacatcagattcaccagggtggagagggggagttttgaataatcctgtgcaaattgtactgtctaaatatagacagaaatgtacaaggattatcaagtggagggaggcatagctactttggcattaatatggagcctttgtatttggaaaagagttgggaacttttggcctagggcacagtgagggagggggaggattttaagtgactgacataataacaataaatcattattgaaccaattctcttccaatctttcttattaactccaggagtctcgttaggtgttaatatgcctctaacgcctgtccaacacttgctgcacttcctttgtaacttagagcaggccttgggctcagaacattggcaagcagcagatcactagaattgtaaactcttctctttttgtcttgttgtcattgtatttgctattatggttctcttccattatggcaagtaatattagttttctatttgtgagtagtgaaatatagtttccttttaaataagtttaagtttaaaagaagtgagacaatttaatgaaaataattaagtgactaatagaggtggtgaacaaacggcaaaaattgtgaaagtgatatcaggaaacagctggtaaataacatatgggagaggctggactagagattttcaaaatatgcatagtgaatcacttgacaaaacagaggattaccgggtagttcacaactatttcttcttcatttttaagtgtggtaaattcagagcagtgtatatacagattgctagaattcagacatgttttgacttgcttggatagaagagggtagaacaagcttcagaaataaatcataataatagcataactatcatgattttatactcttcacaattcacaaagactttcccttacgttgtagcatttggatgagtcaacacttgaaaatgtaagttctaattccttctctctttaaagtgctgtgtgacttggagccagttacttgaccccctggggtcttcattccctccacttcggctcagtgccaaggttttaagtgagccagtggctgggtgaccagactgcaaataccttactgcagacatgcaagttagaataaccagaagactcttcagctttggggagggttctggtattaaatggcatgttatgctaataccaaatggtatgggatgatgtggggagaattcattctcccactgtactgcccaataggattcaggcttatgagagaggcctaagggcgaagagatcgcttgtgctccagcaactgctgggagggagtactatgttcccaaatcttattatcagagaggaggggctggagagagtacgggagcttatgaaagcttcgtaactgccactcctagagaggttctagaagtgaactataacagcagaaaagtcataaatcactagttgcgtgcctgtggtcccctctgcccacaccagagccacacagcagccatgagtccagtgctgaatggacagtggccccaactgtgggccatgggaagcacctgggagggttttccagccatgtgggctccatggtgcagctgaaagcattgtgagacaaggagcagccccagacccactctgaactgcttcaaacacacacacacacacacacacacacacacacacagacacacacacaccatgctgcaagagaaaaacaatgtattgagtgcttgctatgttctaagaacagtcctaggtatttttaactatgctacctcagttattccttacctcatttgacaggtaagaaaactaaagctcagacaagttaagtaactttcccaaggtgacacagctaataaatgactaagacaggatgaattccaaatcatctgttcttttcactcttttgcactattctatattatatttcacagtacatttcaaaaacaaacacatgcaatatacacatcacagacatacatctacagaagcattttacacatccacaccctataccccatgtatatatacagctcacatacacacacatctcacatatacacacacaaaatgcccatattaaatgccacacttgaaatacatacacatgaacacagaaattcacattttgtacatacaaacctatgtgacccaattcactatgcatctgcaaacacctccatgcacactctaatccccatatatatccatacacatccatccatctgtatacataacacatctatacaatcatacctagaaacccatccacatcacacaaactcacctacatcatagacacacacaaagaaactaaagtgcatttgttcctcaccctgtccatcaaaattagttccccaggatatgagtaaggatcttcagattattaagcaacagtgtctaaatagtcctagaataccctccgaatcttcaaagcaataccagatggctttcagtattttccattactgtgtataattgtctaattatttttaaattgttaatccatgtataaatatttatgaacactttttactagccaggatatttgattaattaaagtagcacattattcattcattcattcactgtgcaattactgagcaccaattatgtatgagacaccatggtagacacagtggggaatgaaagaacaaacaaacaaataataaataaaaccaccatgattcctgctcttaaaacacaaacacagataactacatcagcacctggtgagtgagtttatggggtgtagtggggtggaggagcaagaagacaagatggctctgaggcgtctaatcctagagagtggaagtatattgacgtcatctggggaaactgatctggaggagcaagtctaggaaggaagctgtagtgttcagtttgggagatgaatttgagacactggcagaacattgagataaatgcatcccacaaatgtttgcaaatgaggaagggggttttaaggaagaggccagggtggtgacagatttgagagtcatccattattaactgattgcttaaatagttacaactgatgagaccagaaaagaagctgagaggaagaacaagacaggttgggtacaaatccttggggaacattatgcgctgcatgactaggtgacagaaggttccaccttacacacacacacacacgcacacacacatacattcatatctctatgcatttcctccaacatcccagccccacaagcacatgtcagtgctgcttatggctcctaactatctcctggatataatttcagtactaggaaagctcagttgcccaaagcaacccaaaattagtgttcttcaacctttgagcctctaacattgactcttattgaaatctatatgctttaagagtttggtgtggcaattcctcaaagatctagaaccagaaataccatttgacccagcaatcccattactgaatatatacccaaaggattataaatcattctactataaagatacatgcacatgtatgtttattgcagcactgtttacaatagcaaagacttggaaccaacacaaatgtccatcaatgatagactggataaagaaaatgtggcacatatacaccatggaatactatgcagccataaaaaagaatgagttcatgtcctttgcagggacatggatgaagctggaagccatcattctcagcaaagtaacacaggaacagaaaaccaaacactgcatgttctcactcataagtgggagttgaacaataagaacatgtggacacagggaggggaacatcacacaacagggcctgtcgggtagtggggggcaaggcgagggagagcattaggacaaatatctaatgcaagaggggcttaaaacctagatgacaagttgataggtgcagcaaaccaccatggcacatgtatacctatgtaacaaacctgcacattctgcacatgtatcccagaactaaaatgaaagaaagaaagaaagaaagaaagaaagaaagaaagaaagaaagaaagaaagaaagaaagaaagaaagaaagaaagaaagttgggcagagggagggtcatgttcttaatacatgagtaattcatactgtggtgtgaatggggccttaaagccactttgttgaatgggtgtggggtgggagaggggtgacagaaacagtgtaatgcatccctgtttgacttctaatcacctaactctcgatacagtgaaataagccactactgatttactctgggtcctatgtcagtcccttctgctaactgggcctcaatttcccaagtgagattttgtgaagtatatgtttcttgagacagtgatcccataagtacaagcatataagcttgtcaaagcttctgaggagacttgaggtaaaaatgcctgataaaatttgtgttccagaatgcatctgactttagcaactttttaaaaaactgtgactctgattctgaaaataaaccttgaggaaatggcaaattattttatctctaacatcctttctgtccgtgtggctccatggacctgtgagagtgcagttgcccaacacaaggttaggtctaccaaaagactaaccctccaatcttctctcccagggacacccagctgccaagtgtgattactcaaaatcccagagatgaagccttaaaaatgtccgtgacttctcagcatcaatcagacacttggctgcctgccaggatcccatgccggctgatatttgggctgggtaaacaatttaacctgggccttacctcattaaggacccatattacccatattactccagctaagaacactcttgtggttctacagaggttggacaaggctgggatctgatcacagcatgagaaagagccatcattaaccttttgctctcctctcttcctccttagccttgctgcttctaaggaggctgaagctgctcgctccgcacccaagcctatgtcaccctcggatttcctggataagctaatggggagaacctccggatatgatgccaggatcaggcccaattttaaaggtagagaaaatattccttccagacccacagggaaatgctttcccagattaaagcagcaagcagcatggtaatgcacgcagatggtaaatacgcagtgtgaatcccatgactctttcctctacccaaggcagacattcttaatcaattcagtcttctctcccaccaagcccagacaaagcctcagaggatgcaatttaacagcacctctggtttccaggagtccaaaagtgaattaaaaactatttgctacttcttgtatgatgggaagaaggataaacatggaacgtggagaaatgggttcaagtttgggctcaggcacaaacttactctctgagcttagatgatgagtctctccctttctttgggcctctgtttcttcatctgtatagtaatgggcttggcaactttggcagcttttaaacatacgcttcacggagctttcaggcttccagcaggtgcccccaaaggagaagcagagggcatgatgagcaagcccaccctgctcctccccaaacagctccacttttattttcaataatgggctcccaactaaaattcttcagctgaaagtttcccacgggctaacaaataattttgaaaaattttggtctaaatcagagtcataatttcaaatgcctaccagggttgggtagataacttaaatcagtgaggcaaaccaagagtaagacagtagggagtggtagagactatgaagaaatagaggtacaggctcctctacaggggcagcctcttcttagccccagcctgtagttgccctgcagaaatgtaggccccatgtttccagagcatcaagtattccaagaagagccagataccgagatctatgtgagacttcctaattcctaaaacatgtaaattcaaataaaacatgtttgtgacccacatatgccctgtgggttgccaatttacaaactctactccagatgacctgaaaaggttcttttacctctcataaccctatgggaacttagtgtctataaccaagagactagttccctttgtttactgacgcctcaggaggttgcagccatctcaaactgccgagcagagccctgcaggtgcagtcttaaggacctccttcggagcctatgcactctgaccttcctcccagcatccttgcaaaaatcttattccaaggacctgcagccagcctcctagacaagccttgatttcaggtgcccttcctcactgttcctttggctcaagttcaagactaaacaaggcatgtgacagctggtaacagcttcctaatatttgctcactttgccccctgctctcaagtccccttctcagagtgcttgctccgcacagctctgcaaatagaaaatgttctgagagatgcacccaggtctctgtttgggcccactctccccatttaccttgaggctccttcactccccctgcaccttgttcctgaggccatagcttccagcattgttaacataacccccaggataggtaagtcaataacaaggttgctgtcccagcacactcagctcaagccttcaccagggtcacaacctctaatacctagaggggcaagacaactatagtatatgaatgaagcagggtggagataagaaaataaaaccagagaacatagggcttatctaagggcagccacttctcagctcttgttgatggctgttaggcaggaatgcagaccctgttcagccaggccatccaagacaagacttaagtctgaggttttatctgaaatcttgcaaattgacaactaaatcacctcttttaaaaacactgttggccaaatcaaacacttccaggaactggttagggcccttggcaaccaggttgcatcctctgtccctctctgcttttaggaattccagtccaccacgccccttggtgggctctctcagaactccatcctgagtggaggggccatggtcttgctctgagaaacgaggaactcattcgtttgttgaatgtgggtgcatccagggtttatgtgttagttattctttgtgcataccactgtacttgacacatagaaaagccccagtaaaccttcataaatgaatgaataaataaatgaccccacaaatatgctagggcttagagcagttaagtgactttttcaagtcatgctgtcaaaaccagagactttaacccagttactctaacttaattctttgtctaataatagtgatttatttatttgttcatttatttatttacttactcagcagtgggcatttttaagaaataaaattttatcctgaccactgaatcaaggtccgtccaaccttcccactctgagaagcttactcggaacacttgggcccaatatctacagaactagttcatcttttaggcccgtcccaaccctgcaactagccttaactccctcgacccccacctgactgagaatgaggtgcagcttcctggagccccaccgcaggagctgagaagttttctctgccctcctttgtactgaggcctgaaaaattgctgagaggattttcttgccctgagccctttgatgcctttcctgcttccaccgacacaaatcagattccctaaaaccccatacaaaccatagagctcctgaaaaggccattgaggatcagggcccctatgactccaacatgatagaaagaggtctgcattgtttaaaacctctacggagggatccatcactcagcagctgccttaggtgctagaaattttccctgctcctgaccctcgtgaaaacacaggtagccaggaatggcaagcacagtctgcagagtacaatggcaaagaaactgtgaggtagaagtaaagggcactaaaacagcattccagtcctccctctacttacctgacaggcatgaccccaaatgagtcacttactgtatctcagcctctgtttctgcatctgtaaaatgatccagcaggactaggccattccagctctgttattctgtgtcttctttatgactttgtgtattataatggctcctaggattaggggcacagcccaatgcaaatacatacaaaaaagcaaaattaaactttaacatttagtgaaatatatacattatcctgctgccaaaggcagctaaattgtaattttctcaaagataatttaatttcagatttatttcaatgaaccgcaccttcccataggatccttttggccagtgtcctctcgcacacataaatcagaaactaatttatatgggagtcacagtgccagacacttgcagggactgggtgggaactctgtgcacatcatttcaaggcataggcagtaactccttggggtatcttaatggcatgaggcaacaacaaaaaaaacctggtctgagtctaaataaaggagaaaaatcctgaccattcaagttttttccacctgagctttatttaggtggaagtgacaaggaggcagacttccactcaacacaaggacaaaaaaatttagcagacagagctatccaactatggaaagggctgcttaagacaaaatgagtttcccactgctggaagtattcaggcactcagccttgaatgggtagctggtctacagcagtggtccccaaacctggctgtgcatgagactcacccaggtagctctctgaacactagactcttgggctaacctccagagatttggttttacttagtgtggggttgggccaaagaatctgtagtttaacaggttcccagatgattcttctgcagataaccctgtctgcacttcagtttgggaagaaattgatgaggtgacctttaagaaaccttccagccctaaaatcttacaaccctgaaatgtaaatggatagcttccataaaggaattccaaaccactgaagctgagaatgaccgcctagatcaagagctacttactctctctccagattgatgaggaaattgaggcccaggacagagaaaaggcatggccgaggtaaacaaccagtgagtgctggagttatgtccaaaacccagaaatcctgataatcccttgaaggaaaaacctagtttctcatcccaagactgagtcccctcctatatgccaagacttctgatcctagcttagtttgagcaaaatgcttgggctactttttcaagagggacagaatgcaatgggtgccagagggcataaggacatatctactttcttctttccacaatcagaaaactttggttcaagtcctggttctaccacttgttagttgaatgagcctaggtgagttactaaaactcttggtgctacctttgtcaagtaggaacaagaattctgccctgtctacctcagtacctcataggaatcaagaaagtggacctgaaaagcaaatcacaaattgcaaattacaatctttatgtgaagggctgtgaccatttatccaagtcctattcaccttcaaagtcatctccaggccaccacctttctgaggtctttcgtgccttattctccagaacttctctcacctggactcctgctgcttttaccactcttacccatggtcttgcatttctctttggttattttatgtcagccctttttgtcagcttatttggaaacccagtgctgaaaattctggactctgccactgtctgtgtgatcgtgagcatgccccttccttcctctaaacctgtttcctacagaatagccattaagatgagcacccttggagttagacaaatctgaactcaaactctgactcacccatttactagttatgtaggcatgaacaaatagcttctctgagcctctgttttctctcctgtaaaatgaaggtaataaccataccttctcctggagttgttgaaatgatgaaatgaaatgatgttaataatactctcagcacagcaggaacccccgtaatgtttagtaaatggcaactgctataattaatactataaagtgaagagattgggcttcaatgagacaacatctcctctaggaatgagacagcaaaccagtgaataatcctccatttctttcctacgctttgcagtaggattcaaaagacttgctcagaaagtatttaacaaagtctgtggacttcccctgaggttccttctggattcctcagctggtaattcccatcaatgcctttcagacaatcattcttggttcataagttgaaggcaaggagcttgctgttccttgtaattcccaagatggcctccaaatgttgtagacataaatatatttcagccactaatttgtggctgaaaggcagccaatgggacttggggaaggaatttcaaccatatggcggctgatgaatcatcctgtgttaatgaaagtacatctcagctcagcctctggtattctgtacctggtgctcacttggggaccaggaagtctggcatagagatgttaaatggtggctgggaatcccaggtgcttgggggtggggtggagagcaagcaaggatctcctccaccaaaggcgatccattccagaagtcagtgttctgggaatgagtcctaccctgtgggttcttccatggccttggggctaagcaggaatctctcttgattggcaggtcccccagtgaacgtgagctgcaacattttcatcaacagctttggttccattgctgagacaaccatggtgagtaagtcaaaacacaagctgttagttcctgctggagatatctctccatgaaatatttatcctctgcattggtctccaccaaggaagtggggaatcagctgggtttttctcaagtctccagtggtataccatgaggctcggatgtctttactgtcacattaaatgttttgagtgaatacataatatctgaaaatagccaaagacctagcagggcaagcacctgccaaacacccaggattacaaaaacaaaattatacaacaagtcaaatttttagagtaaaagaaaatgtgaagacctgtttttaagtttaacattcaactgcagaatggcagaagactgctggttatacaagctgaaatgggtatattgggttaattgtatatttcctctactgttgaatacatttaaaacttttcacagtaaaaaagtttagaatgaatctattacactagaagaaatgcctaggaaaaaaaataccaaaattgtaagaatgattatctctgaattaaaaagttatgaataatttttattttcttcctacagtatttatatatttttcaaatttctgcaaggggtgaatattatattagtaattatgaataagtgtaatgatattttaaaacttttctcagactttttgtttttgttttttcaacagaaaaatcaattgtacttatgttaaggaagtgatctagcttgtgaaaaaaaataatcagggcagcctaaagttaactctaatctatccatttcggaacatccacccgcccctaatctagttcaggcttccatcatggctggcttacatgactgcaaagggttctcgttggcttccaacttgcccccttccagtctactttatcccacactagcctttccaaaacacaaatctaaccacgtcactgctcctatttaaacccttcctatggctccccatcaccctcagcattaaacccaagttcttttgcaaagctgaggaggctccctgtgattcaccctgcttcatttcctccctctcccactgcatactctagctgcaccgattgcttacagctctccagccaggtcgtctctcgctctctgctttacaggcttctggtggtggctgctaggccactgcccagagcacccactccagcctcctttcccttgccaattcctattctcctttaagactcagcttagaattatttccatagaaagcctccccactgtaacatgcacgtacgtgtgtgtgagttcacgtgtgcccttcacccaaggctgggatgggtcccttctgtccattctcataatacattttacagtttccacaacagcacttgtcacttacaattaccactgtaccaacctgcttatgtgtccctcctgtcactatactgtaagttccttgggggctggtatcttgtttcatttcctgtgggaaccccagcagctagcacagtgattcaataacagatactcaacagttttttaaataaataaaccaaatcaattatattgcttatcaattaaaaccagtatttggtcctaagcatttatggagattacatccaacctttcagtcccaggctggcagaaatcactgagttcagtaggtgaggtggcctgtcttgatatggtcacgaagactgttcccacattcaaaggacaactggtgaaactccctaaagtaacaggcctcttatctccaaatggagatggtcccacttgttagctaggaacaaacatgggtgcttttcactggatatccaggtcaaataaatagccaagtttttttcacctttgaatgtatgtcttacaagcactcttaatgagcccctctgcttttcttcccctcctctgagatcagaagcatattgacatttgtattaatcataatctgtacagtgagtgttgacacttccactctttttcctcaatggtaaatggttatcaagccaagtcagggagtggaccacctggttctgtaaaggaactggttatttgaggacaggtgcacatatcagcactcgtttcctgataatgaccaaacagagacttaattccttcatacagattcctaaaaaagaaagatatagccttacttcccatggtgattaaaagcccagctctggagtcacatacactgagctcactctgtctacgaggagcttatttgcttcacatctttaagcctcagtttcttcatctgtaaaatcccaatggtaattaacatactgatatcattaagttattatgtgaagtgtgtagagaaaaaatgggtttttttgttttgttttgttttgttttgttttgttttgttttgttttgagacagagtttcaccctgttgcccaggctggagtgcagtggcacgatctcggctcactgcaaactccgcctcctgggttcaagcaattcttgtgcctcagcctcccgagtagctgggattacagacatgcaccaccaggcccagctaatttttgtatttttgatagagatggggtttcgccatgtcagccaggctggtctcgaactcctggcctcatgtgatccacccacctcggcctcccaaagtgttgggattacagacgtgagccactgcacccaacctagaaaaatgtttatcattgtccatgctttgtaaatgttcaccaagcattttttatgatggtgatgatgatggagactcttgacactgcagccccaacattatcattgatgatttgctgtgtaatcttgagcaatccttagacttctttgagccttggtttattcctcctctcctctccactcccacctccacaaccctcaccccccatttcccaccccacatcttctgactacctttccagacttcacttctgctgcattttgctttctacagaaatggtgtagcagagtaattagacacagtcttcaaagcccagacaaaatctgaggctcagctctgtgatcttggccaaggtatttaagttggctttctcatctgttaaaaatagggatgccagtagcatccaccttgtggcctgctgtgagtattaagagataaagcatggaaagtgcaaagcacagtgcctgacacaaagggcagttgcaatgatgccaactattgttacatgccatttatcattttcagcacattttcacattcatgctctcacgtgattccttcaccacgtgtgtagtcttacaaccactctgtaaaataggcatgctatgttccccagtttacagctgaagaaacggaggtttgtacagatcatatcacaaagctacttggtgactgtgcaaggattaagatccagttctcataaccgtagataaatgtttgttctgtgccacactgctataactccaaagagcacagactaaaaaaattggaggaccaggacctacaaagtacacgtaagcaacagtctaagtgcatcaaaagtggaaatccaacccaatatcatgccatgcccagctcccctcaagagaaaatagtaagtaatgataatggagataacaaaggaccccagaggagatggtctcctggagtagaaagaaataatcttccgacaggaaatgaaggatcagttatgatgtactgccttgagggtagaccacaaatgacatagttttctccctatttattaaaattaatccaaagtagggcaggaggtgctatttccaagcatgcatatttcataatatagtatttcttatatatatctcataatatatcttactagatctcacttaacatcaccaataggttcttagaacctgcaactttcaacaaaatgactacaacataaccaattttatttctcatcaacattataacaaaacaacattatttgataaactgctatatgtcatttcacttaaagtctgttcccaataacctgtcaatgatgttaaatgaagacttatgtactatgattttttcctcactggcttcttaattatttgtgtgtttaacttaattatttgtgtgtttacagatgatataggggaaaaaactctcagatctaaaaaaaaaaaaaaacttaagaaattgcctagtctggctctctattttctggagagagaatctggttgttagaatggtaaggtcacttgagcaaggtcacacagcaagaaataggtgtggtagaaacacaggtctgatgctctctgcagtgctcaaagattcccctcccttcagcttcttttccctctggattccacctaccaaaacttttggacgactctcccattcaagcctcttttcttgtcactcaaagtggctttgggaaactgctattagtataataacaagaaaagcaacttattcttgaagaacttattatatgctactacataccaggcagtgaacagagcacttctgtatctatcacctaatttaggcttgataacaacccccataaagtgggaaagtttatctccagtttacagatgagaaagctgaggatcagaaaattaggttattttcctaaggacacacagctaataagtagcaagggtagaacttgaactcagtgcgtggtctcctaagccaaatgtaaacatttaattcctgaatgtttgggactacccagcccttccttgtctcctttcattacagagaattagagcaaaagggaacttcagcttgaacagacatagaaactggaggccagagagaggattgcacttgcccatggacacacacacacacagctaattagtggcatagtcagcccaggctccctgacttccagcctgggttctgcctctccaaccacacaaacagctagttgtgcaccatgggtccaaggtaatatggacatagtccgggtttcagaaactttccaggctgtgtttgttctccagaaaaagcaggagtgcatagcagctctataaacagctggagtccccaggcctaactgcctacctcccaggacctggctttattcaccggagctaacagacctgagagcagagaggcagccagcaaagcaacaggggtctctatccagtcctgacaaggagagggctgagactgcctgtcctttatctgaccttttctgggactctctttgagtctgtgcagcaagaggaaggtaaaagttgaaacagaaatgtacaagggaggccacatgcagtggcttatacctgtaatctcagcactttgggaggccaaggtgcgcagattgcttgagcccgggagttcgagaccagcctgggcaaatggtgaaatcctgtctctactaaaaaaaaaaaaaaaaaaaaaaattgcagggcatggtggcacatgcttgtagttccagctactcctggagcaggggctgaggcaggaagatcacctgagccttaggaggtcaaggctgcagtgagctgtgatcatgccactgcactcaagactgggcaacagggtgaggctctgtctcaaaaaaaaaaaaaaggaaaaacaaaaagaaagaaacgcacaaaggaaaagaggaaagggaatcctgatctagagcagcccctctggtattctacaaagagctaaaactcagatgaaaacctctagcttgtctggacaaatgtgtgtaagtgtgtgcactggagcatctatggatctgtgtagtatgtatgtggaggtatatactgagggatcgtggaattgtgcagtggcatacataggcatgtgtatatgtgatgctaatttgaacatgtgtagacatgtaacttcaaagagaaatgtgtatgatctataggtatggatataagtatgtgtatttctatgtttatatttgtacatgtggaaatctgtacatatgaatacacatgtatctgtgagtttgcatacatgtaggagatgtgaaagtacttaagaacgaatgtgcatggagtgtattattttctttgggtatttgtatgtggatatttgtgaatatataaagagatatttaagtatgtatccgcatttgagtaggcatgtttacatgtgtgtacatgcatgtgcatgtgaatgtgaatgtgtgtgcatatgaatacaagtgaataagtaaaagagtatttaaatgtaccagtatgggagtatgactatacatgtgtgcacattaagggacttgtatattgctggaatttgtgtagaactgtatataaacatgagagagagagacagagtgagagagagagagagtgtgtgttgacatcctttgggcatgaatcccagtatttccattattagaacatgtgttccagcctctcttgccaaggggcaggctagcttggcacaagacaggtgcactgtggccaggacccctgctgattgatgacagcctatgcaactacagtccacaagtttggccttatttgacgttaaggggcaatggacagagatctgaaccaggagtcaggagaccagggtttgagttctcactctgccaccattaatacttctgagatacacttcccccaggtacctggccctaagaatggtgtataggatcacacagagtaataggtatgcaagtctttggtaaatgctatagaaatataaaagattatttactactaactagtcagccaaagcaaagactttgcattagtccattttcacactgctaataaagacatacccaaaactgggcaatttacaaaagaaaaggtttaaatggacttacagttctacatggctagggaagtcttacaatcatggtggaaggcaaggaagagcaagtcacatcttacgtggatggcagcaggcaaagagagagcttgtgcaggaaaattctcccttatagtaaacatcagatctcgtgagacttactcactatcacaagaacagcttgggaaagacctgcccccaacgattcaattatctcccaccaggtcccatccataacacatggaaattcaagatgagatttcagtggggacacagccaaatcatatcattctgctcctggcccctcccaaatctcatgtcctcatatttcgaaaccaatcatgccttcccaacagtcccccaaaggcttaattcatttcagcactaattcaaaagtccacagtccaaagtctcttccaagacaaggcaagtcccttccatctatgagcctgtaaaatcaaaagcaagttagctggccaggcacagtggttcatgcctgtaatcccaacactttgggaggccgaggtgggcggatcactttaggtcaggagttcaagaccaggctagccaatatggtgaaacctcatctctactaaaaatacaaaaattatccagacttagtgcaagcctgtagtcccagctacttggaggctgaggctgcagaattgcttgaacccaggaggcggaagttgcagtgagccgagatggtgccactgcactccagcctgggcaagagagtgggactctgtcttaaaaaaatacgtaaataaataaaataaaatctgaaaaaaaaaaaaaggaagttagttacttcctagatacaatgggggtacaggtattggataaatacagccattctaaatgggagacattggccaaaacaaaggggctacaggccccatgcgagtctgaaatccagtaggacagtcaagtcttaaagatccaaaatgatctcttttgactccacgtctcatatgcaggtcacactgatgcaaggggtgggttcccatggtcttgggcagctatgcccctgtggctttgcagggtagagcctccctcctggctgctttcataggctagcgttgagtgtctgtggcttttccaggctcacagtgcaagttgtcagtggatctaccattctggggtctggagtgtggtggccgtcttctcacagctccactaggaggtgcccaagtagggactctgtgtgggggcttcaaccccacatttcccttctgcactgccctagcagaggttctccatgagggccccacccctgcagcagacttttgcttgggcatccaggggtttccatacaccttctgaaatctaggcagaggttaccaaacttcaattcttgacttctgtgcgcccgcaggctcaatgccacgtggaagctgccaaggcttggggcttccaccttctgaagaaacaacctgaattgtactttggcaccttttagtcatggctggagtggctgggacacagggcaccaagtctctagaccgcacacagcacagggaccctgggcttggcccacgaaacgattttctccaaagcctttgggcctgtgatgggagtggctgctgtgaagacctctgacatgctccggagacattttccccattgtcttggggattaacatttggctcctcattacttatgcaaatttcttcagctggcttcaatttctcctcagaaaatgggtttttcttttctagcacattgtcaggctgcaaattttccaaatttttatgctctgcttcccttataaaaccgagtgcctttaacagcaaccacataacttcttgaatgctttgctgcttagttccaccagaaccctaaatcatctctctgcagttcaaagttccacaaatctctggggcaggggcaaaatgctgccagtctctttgctaaaacataacaagcgtcacctttgctccagttcccaactagttcctcatctccatctgagaccacctcagcctagattttattgtccatattgctatcagcattctaggcaaagccattcaacaagtctctaggaagttccaaactttcccacattttcctgtcctcttctgagccctccaaaccgtcccaacctctgcctgttacctaatttcacatttttgggtatcttttcagcagtgcccaaagtcacttccacattttcaagtatgttctcagcattgccccactttactggtaccaatttactgtattagtccattttcatgctgctgataaagatatgcctgagactgggcatttacaaaagaaagatctttattggacttacagttgcatgtggctggggaggcctcacaatcatggcagaaagtgaaaggcatgtctcacatggcagcagacaagagaagaacttgtgcagggaaactcctctttttaaaactatcagatcttgtgagcttattcactatcacgagaacagcatgggaaagacccgcccccatgattcaattacttcccaccaggtccctcccataacacatggggattcaagatgagatttgggtggggacaccaatacccaaacataaggaaatgcccttctgggttttggagttttttgttgttgttgttgtgtttttgtttttgtttttgttatttgcttgtttttatttttactggtatctcttcattcatttgttctttccactccatttattaattaatgtcttacatgtgctaaatttggcattaggctctagagatagagttctgttttagtcctataagctaggctttcctgcattaacaaatccccaaaatctcaacatcttcagacaacaatgattcatttatcactcatctaaagtctgctgcagatctaagggctctccgggactgctttcccccaggtagtagctcagcattgcatttccgtatcaacacacaatttcacatttgccacacaagagaacaatacactgaagggttgaacactgttgtattagtgtgtgctaccataacaaagtaccacagattggatgccttcaacaacagaaaattattttgtcacagttctggaggttagaagtccaagttccaggtgccaccagagttggtctctagtgagggcccttttcctggcttgtagacagcttcttttcactgtgtcctcaaatggcttctctctgtgcaaagagagacagagagagagagagagagatctggcacctctttctctccttattaggacacaaatcctactgaattagggccccaccctcatgacctcatttaacctttatcacctccttaaagactccatcttcaaatatagtcactctgggggttagggcttcaacatataaattttggagggacacattcagtccataacaactgccaagtaaatgtgttccacctaggagtgacttctgcttgcatgtcactatccaagggaagtcacatggcactgcccaaagagaagtataatcctcctatggtaccagaagtaaacaggaaccagacatcagtgagtaggaggtctctgctttcaaggagtctattttaaggaaaacaagataataccacagtaggatgggtgagattacagagctatgcaaggatgctgtggaacacagaagttaataataattctctgtaaattattaataataattctctgaatatgtacgtgtcaggcactgttgtgtgctttcgagttatttttcttttttctttttttctaaactgatcagcaccaaattgactgattttactaaagcagcaatctggtcatggtactccccatgctcaaaccttccaggagagaacagtttcaagggatgaaccaaaggatgaaagggtttcaaaaaaactgttgtgtgttcaatagtgccaaaagaggaaagaaaagtcaagtagaaaagaaagtgtcatccagtagtttcagcaacggggtataggggaagggagggcacatatgtagaattagggaatgtaatttcaggggcatgaagaaagcaaaggataaattgaaacaaagacagcatgaagataaacctttcaaaaagctctactgtgaaaagaatgtgaggtgttagtattggtgtttgtcatttactgagcacttttctgaaagccaggtaattttggttagtgaattatgggaattatttcatgtacaacaatcccattttatagataaggaaactgaggcttagagaagcttgattcacccaaatttttccagccaataaatggcacagccagttatcatccccaggctgcctgactcctgaggccctgttcttggcctactccatttgctgagcataaagaaagagggaagtgggaagtggcagagccaagggcaccagggccacgtaagggtatcacctcatcctggtcttctgcagaacggtttggtcaataagaagctcagtaggatttgtgcagtcttgtctatggtcataccaccctgaacacacccaatctcatctaatctctgaagctaagcagggtcaggcctggttagtacttggatgggaggatttgtccagtcctataagaacttgtgtcacaagaacgaccttggtcatccatcattttgggtatttgcaaataaggcctcaagatacaagaaaacagctaccacacaaggagatcaaaagccccttatagccaggtgtggttgttcatggctctaattctagcactctgggaggctgaggtaaaaggatcacttgaagctaagagttcaagaccagcctaggcaacaaagtgaaaccccatctctacaaaaaaattaaaatatcagctgggcatggtggcatgcacctgtaggcccagctattcaggaggctgaggagagaggagatcacttgagcccaggagtttaaggatgcagtgagctatgattgtgccactgtactccaacctgggcaacaaagcaagaccccaactttttttttttaagccctttatacccaaacataaatattaacacattggctagggagcagtcatttagtcacaagtcaaagtcaacctatcctgggatcagttgatcaaatgaagcagacattttaaatcacaaaaataaaacttaaatccatctacttttttcccactttgttgctctcagctcctagttaaaattggcataatctctctcctgcttgacaaaatggcctcctaactggtctccttccttcccctcctcatgctccctatcacttcccatagtttctagaaggatcattttaaactgcaaatcggatcacagaattatcctacttccaatcctgcaacaacttgcaaaggttcttaccacattctgttccctctgcccagaaagatctttgcatgcctggctccttctcacccttcaggtctcagctcagacattgcttcagggagtccttctccacccccctacctaaaaatatccctctcttccagttactctctatcacatcaccatgttctattatcctcagagcaatatctaaaatttaaaagttcacttgtttgtttgttgccttattggctttttcagctggagtggggaccttgtttccctcaatcacctctatatttccagtgcccaccacactgcttaaatcacaagagctagtcagtatttgtggaaaggttctctaagcacacccccatctgttgtcagaatccctgccataaacatcatatccaagtactttttgcttgcacacctccagtgatggggaacctactacctcccaattttagattcaaggggtcatgtggaggtttgttacatggatatattgcataatgttggtatttgggtttctattgaacccgtcacccaaatagtgaacataataaccaataagtaatttatttattggtctttcatctcaaggtggaactcagcgcactgaggagagcaccctgatggtaaagggactgcccatttcatctttgggcagctctgaaatctccatttacccacagctttagtcctgacctagtgccacacagaatcaaccaaatcaactgacaacccttcacataattgagatcggctctccctgtcccttccccagcctggcttcctcaaccattctctctagttttcagtcccttcaccaccagggtgctctcctcaaagtgcatccagcacttgatttccatcttgagatgaaaggtgaagaaataaactacctatagggcactatgttcactatttagttgatgggttcaaaagaagcccaagctccagcattacgcaatatacccatgtaacaaatctgcacatataccccctgaatctaaaataacaatttttaaaaagaaaaagaaatagacccagcctgacaaggagtgttccgagcagagcaaagtggggccatacttattctgggttagtgaatttcaaagcattgtttttaatagcagtcccaccttagttcaatttttaaggtaaacctttttttttttttttttgagacaaagtgtcactctgtcacccaggttggagtgcagtggcgtgatctcaatctcggctcactgcaacctccacctcccaggttcaagccattcttttgcctcagcctcctgagtagctgggattacaggtgtgcgccaccacacccggctaatttttgtatttttagtagagatggggtttcaccatattggccaggctggtctcaaattcctgacctcaagctatccacaccgtcagcctcccaaagtgctgggattataggcatgagccaccgcgcctggctgtaaggtaaatctgatgtagcactttaataaacaaatttcttaaatgggtggttctggttgaactggagaggaaaccaagaatctcattctcttgacctctctctcaacctctgcctcccccaggaagcccttggaaaaccttctctaggccctaaaatccatttctacccattccacctcaaagacctttccatttcgggaaccatgtcacagtgttcacttgcagtatgcttacggacagcagcaccctggaacatttttttaaagtgcattagtaatacatgaaaacaagcttttgtaattagttcaataaaaaagaaaaagagaatgagaaataagaatgcccctgctttgccctcccctccaattccctttgtcctatcctgaggtaataaaatttagtggacaccatactagtcccctttccttgattgttcatacatttaggtacatatacatgtctttatataagtaggattgtgcaatacaatttgctttttccactccaccacagcttgacgcctctctcgacatggctacatatagatctaccttactgtttttaactctctacacaatcccaaatttcgaaacatgggaaaacaaatatattatttattattagattaaatgtatgacaaaattatactatgtttccaggctttatagcctcctggtaaaattccatggtatggagacatcatcatttcacagtatttaaccacttttctcttgacatgcttttaggttttttcagctttacactattacaaacaaggctacaatgagcattcttgtgcataaccctctgtgtgcatttctttaggatatattccagaagtagaattgctttaatgaaagaatagtcacttttttaaaagtattttgcccaattcccttcccaaaaaagcttcaataatttacattccctacaatagtgtttatttctcttcatccttgccaacccaaggtattatcaagcttttttattttcaccaaatgggattttcaaaatggtacttcattgtcattttcaatttgcacttcagactcctagtgaatctgagcatcttttaatatgttgactgggcattttgaataatattataggtttctttttttatatgcatctcctaaatccatttggagtttaattttatacgaagaatttggtggtggcttaactctatttttctctgattgagtttctattattccaacaccatttcttaaacagtcactgtttttctactaatttgaaatgctatctttttcataaactaaatccccatgtatgcatttctagtctctagtctcagtttattgctccattgctctgtttctataccaatatcacactgctttaatttctatgactcattatatttctatgtctggtagagaaagccgtctgttgttcttcatttacaagtttttcttaacgctttcagccctttctttcttccatgtgaactttagaatcagtttattgaggcctataaaaatcgtctcacggccgggcgcggtggttcacgcctgtaatcccggcactttgggaggccgaggcaggcagatcacgaagtcaggaggttgagaccatcctggttaacacagtgaaaccccgtctctactaaaaatacataaaaaaaattagccgggcgtggtggcgggcgcctgtagtcccagctactcgggaggctgaggcaggagaatggcatgaacccaggaggcggagcttgcagtgagccgagatcgtgccactgcactccagcctgggcgacagagcgagactctatctcaaaaaaaaagaaaaaaaaaaaagcctctcaggttttgattaggattgcattaagtttaaagattaatttgggaataaagtacatctttacaatattttataagtatagtacatctctccaattatacaggtattcctttatgcctttcagtaaagtttttgatttttttaaatatatacaactcacatatttcatgttaggtttattcacagatattttgtgggggtggttgctattatggatgagatcttttgttgttgttcctttttccattacacttttgtctctctacacagcttatgttaggtcccttcttatcttcttgggtctgggggatccaagagaaagtctattcagcgttatccaattagatatggtgccacactcaacaaagctttagtaaacaaaagactaagagagggccaaggagaaagccctcagaaatgccattagagtctatcacaagcagaccatggggtgatgagcagtcttggtaccatctgctggatgattctctcccagtacaccaggggaggtgtcacagcaatgaacttatgactgcccagagcgtgactcttcatcagatcaaattccagaaggctgactcatgaccgtcaaacccacgaatgactgaagtggggaaatcaaactgccaaattgttccaatttacagtaagactttctattgtaataataagaatgccatgtccaccaggagtgtgctcccttgccaagcaaaagttgcttttaacataactggaattggagaaaagagaggtagacagtcttgagggaagtttcatccaggccagagagagttctaagaaaccatccttgcgtcaccacacagaagccctccttctaatggcaagaaagttggtgtttccacaaatatagtgatgcagtatgctagattaccaattgccaaattcctcctacttgaacggccctttcttatgctacagaatgaatgtcccacatatgtttacaaaacagtccccaaaacaagatgtaatacaataaattagggttcttctcattacattacaagcacatgcccatcctaagtcattgagattacacatagatcattcagattgatgccaggcctcagatttgaacatgcaaatccctccattgcatattcatctccgttgtttgttttttaactctcagagggtgatcttagtttccatatttccaagtttgttagtggcatgtctcaccattgtgccctgcactgccaacactatcagctttcctctttccaggttaacatccacccttccttccttccatttgcaccctttggcaaccagttataaatctacttcattgctcaatgtcccaatccaaaattcttcgcctgatactgattataaggttatttatgcaccaacctgtctgtcacatgggctcagtgggtccccagtatactacgtctactatatttccttgatctacccaatagatagtctaacatattgtatttaatatttaataaaaagtttaaatatatgtttaaaatatttaataattttaataaatatttacttttaaaatattttaaatagatgttttaaaataaaataaattgaacttggtttaaaattttttttaaatgggaagatacagcctataattgtcaaaagagtgtgaaattgggaaccagaagtcctggattcatatctctgttcctagcacctactagctatgtgatcttgggcaagaaacttaacctccatttaaccactctaaattttggtttcctctccagtgaaataagtataataatgcccagtatgctaggttgatgaaaaggttttttttgttgttgttgttttgtttttgtttttgtttttgttttttgaggtggagtctcgctctgtcgccccagctggagtgcagtagcacaatctcagctcactgcaaccaccaccttccaggttcaagcagttctgccccctcagcctcacaggtagctgggattaccagtgcttgccaccaagtacaggctaatttttgtatttttagtagagacggggtttcgccatgttggccaggctggtctcaaactcctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttgagaccagcctggccaacatggtgaaaccgtgtctctactaacaatacaaaaattagccaggcatggtggtagatgcctataatcccagctactcagggggctagggcaggagaatccgttgaacctgggaggtggaggttgcagtgagcagagatcgcaccactgcactccagcctgagtgacagaacaagactccatctcagaaaaaaaaaaaaaatttagcaaatgtcagacatccaatacacccaataaacagaactgctattcacattcttatgtaattattaaattcacattgatctttagtgatcccctaaagacaaacaaagatgctaagctccactggtccaaaccatctacagttctttacaacaaatgtagctctgattgtgtgatatctaaatgagaatgcaccaggcagcatggtgacttaggagaaattcaagacacaaagcatctggggccaagcaggcaatagacagggatctgggcagtccacaagcactggacttgagtatagagcagacagcagatcaaatccatggctcgaggcagaaataaagcactagcagactgctaaatctagggcagaagctttctgtcctttgcccttttcaatacttcctgttagttgtgggcatctaaaaacccacaggtacgtcatagcagccagaggcagtacctaatgacactgaggtgtcatcaaactgtcactcaattcatatctgggatatcatgggtagtgtagtctactggttaaacgcttgggctctgacattaacgtcctgggttcaaatcccagctttgtcacttactagttatgcagtgtcatgagtgtaacattaacctctctgtaccttgatttccctgcaaaatgagaataacaataaaacctacctcacagggttattgtgaagataaaaaataacacacataaaggtcttaacacagtttcttgcatgtggtgaagtctcagaatattagtattatttgcattgttattattaattctgaatttaccagtaactagcagcaggaacttgagcttttagggctttagttttcacaactgtccaacaggattcctgcatgcaggttccaccttagtcaattgaattgctgtgtgcccctgagggagactccctttctgtaaaatgagagagttgagacagaagtctccagggttctttctagctgtaatatttgatgatgaaaatcatgatgataagaatgatgattctctcatctagctccaatctccattcctgctatcttagtttagaacctttattacctcccaactggattgtcacaacagccttaaagcaggtctttctgtacctgttttctcctgcttccaattgtctacagtggttcctgccatactgatcttcctgaaatcaaactgtgacattaccccactgcttaagtcttcaatggtgctaaattggctagcaaataaaatccaaataccttggtttggcagttaaggatatccacagtcaaattaattcattttgcagccttatcacagcagagtagttaagagcctgaactttatgtaatcagacaaaccaggtttgaacaccagccccactctttcctaactgtgtaaatccagaaaaagcacttaatctccctgcactttcttcatctataaaattaggttgaaaatgcccaagtcataggattgttttaaagataaaataagctgacatgtatggcatgcttaagacataatgcctgttgtatagtagggcctcaataaggggcaattattattatttatgctgctaatggttgagctaaactgaactgtttgaatgcccctgcctacacacctctgcttgtgctattccttctacatgagattccttttacccccaattatacatattctaattccaaatactctgaggctgcagccctagtcttaatgtcttacccttatctcaaagatgtgagacatataggcttagagcatatcgctggccttgttccaggtgaaaccagatactgttcacacctcagaacaatcctagatctagagatgctaacttctggaggatggaacaaactgaaaggggccacctcaaatgctaccttctcctgaaaagcttttccagatttgcccaacttggctggaaatcatctctaatggcaatttgttaaaagtatttatttatttatatttatttatgtatttatttttgagacagggtcttgctctgttacccaggccggagtgcagtggcacaatcatggctcactacagcctcaacctcatgggctcaattgatcctcccacctcagcctcccaagtagctgggactacagtcgtgcaccaccaggcccagctaatttttttatttttactttttttgtacagatggagttttccacattgcccaggcttgtctcaaactcctgggctcaagcaatctgcccattttggcctcccaaagtgctgggattacaggcgtgagccaccgcatgcagcctgttagaacttcttatgaccctctcactttcaattttgtgtggtagatatttgtgtccatgccttatcttgcttactagataaactgaattctttaagtatacaaatgaagaccctgtgcctccaccgtcaactgtactcccaatcagcctcataaatgttaatagagttggattgagtttcgagatgagatatccccttgggagctggaatgataagactttaaaaggtataagaatctggttcttttgtttacctcttgatgcaatgtctcttggttctgactgcaatgggcccacctcttgcattccacatacccttcccaccaacaatcttgcacaagctcttagttctatcctactaaaacacttcatgcttcctacttcatcacaatactgagtttagaggagtttattaggagaggttagaatctgaaatgaggcacagtgggggtagaggtgggggacagatccaacttcaggtggtgcataggaagccctcaataaatgtctgtggaatgaatgaatgaacaaatgaatgagttaatgctctaccttggtctcataagcagggcagctagttgcccagttaccagaaattagatcatcaaggaatctgagaggcaggatgggtgagttgatgctgaacactgttgaatcagagctctggaaatccctcctgcttcaggtttgtgggctacccttgagagtttgagacctagaagccagctctcagaggtggaacctcaggttctagggtggagaattcaattgctgctcctccagtccctgaacttgaacatggccccccgcatgtcgaacaccaaccagcatacgtatagctatggccaaataagcaaaacagcctttagctttcggcctattacaccaattacattgatctcttctgaactgcatttctcactgctgtttgccaacttaagggaggaaatcaatggcagcaacttgtttgggtagcggctgctagggcaggcgctgccagtaggagtcaagctgcctgaggacaccaaggtacattctccgtctctcgctctaacttttcattagtcatttcataatgagagactcattatgaaatacaaagagatggattttattttgtttttcttcttttagatgatgtacgtctaaaacataaattttttactgacaacttgcattgcttctgaaataacagtaaaacatttttaaatattagtaataaaatgcaaatgtaataatgtccatctttacttaaaattcttcaaacgctccacattattattaggaaaaagttcaaatttctcagtacagcttgcaagaccctgcatgtgtcctcccactcctctattcattcacttgctattctttccaaagtgccacactcttgctttacctctaggccttcacatatgcacttccaactgcccaaaatgctttccctctttggctcaaccgtatttggtctcaccttaaatatcacttctacctggagactttcctgatcaccacccccaagtccagatgggaacctgtcttctatattccctagcaccctgcgtttaacccctatcagagccctttcctcagtatggtgtaaacattacactggaggctctggagctgaataaatatatctttcttgttctcagtggattcctcagtgcctagaatagtatctggcacttaagagagctcagttaaatgttgctggaaaaaataaaactaacaacaattagctgttagatttggaaaagttcttagagaccatctagcctaacttcttttaacagtgagactcagagaagcagagccaagttctaattccagattctttactgaattgttgtgtgatcttaggaaatacctttcccctctgggtctcagtctttccagatataaaataagaaaagtccattctgttccagctttttctgactttacctcctcttccttcttataggtactaggtagctcataggtgcactgactgagtgactaggtgagatggtgcagtgaaaatataaggtctggttcatccactaagattgctcccaatcaagctgaggacataagacatacacagtgaagaagtgctcaattaaacattccaggtgattcggtcttgctaggagatcaaaaaggaagaggtcagggaagcctggggcatcaagtctcctgcaggagataagccttaagctgagaaggcagaatttgcctgagcaatgaggctgacggaaagtgtccctcacacaggattggctgtccacaccatgtgacgtaaatcacaagtgctcactagaggctcaggctgatgctgattgcagtcctagctctgccactcactggccctgctcctgggacacatttctcagcctttccaaacctgttttcttaccctcactatgggaatctgaatgtctagcttgcagggattttgtgaggataaaatgtatgtgacagtatctagaacggcgcctgctgcctaacagaccattttaagaaatgccactttcttttcttcctgctagccacataaacggacttgacatgtcactggcaagaacatcaaaagtgcagctggggcttggggactgaaggctttttctgcccaaccattcatagtctgttcactctgatgtgacttgcccaatgcctcatcataacacacacacacacacacatgcacacttcacgcaaaatccaagggagaaggagaaggagagactatttccaatcccctgatcagatgggaccagaatgggagttatccattaccatcaacaggacaaagagccaacactcaggccaggcctgaagttcttccaccaccatgggacttataagatgtgagattatgaggccaaatgtcactttctatggggctggagggagaggctgcaattaaattatagaacaatcctataaaatatcttggaacattttatgaagctattgatatttctataggcaaacagactgaggcatgagctgtaggaggaattgagcaggggtgagggtgagagtggggaggaaggttgtttgttttagtttatccctgctgataacagatcaagactgatgaggatttataagcagcattccaaaagaaaatattgcatgacctcatttatccagcaccctcgggaatagcaggtcctcatgtatggagattattccttggaggaaagcatttaaagttggacttgaactgaggatattaatcatttggggaactatagaccctttgggagatccaacatagagagctatgcccttcctgcttgggaaacacaaatataccctaaactctacttgtgtcatgatattcatgaactccaggtttacaatgtctctgtaacaaaatttaaaactttcctttttgttttgtttatttgtttgtgacagggtctcactctgtcacccaggctggagtgcagtgtcatgatcatggttcactgcagcctggacctccctgggttcaggtgatcctcctacctcagcctcctgagtagctgggactacaggctactgtacaggccatcacatgtgccatcacaccctgctaccttctgtactttctggtagaaatgaggtatcatcatgttggccaggctagtctcaaactcctgggctcaagaaatcctcccaccttggcctcccaacatgctgggattacaggcatgagccatcgctcctgaccaaaaactttcttaatggaaatatttcttaactgcctgacccagttttctgctattgagatctacccataccataatagctcctcacgttgtgaatagaaactgaatggactctttcagttcctctaggatcagctgaggcaactgagcaaactctcagctagaagtcagaacacttgggttctaaaatcagctctggccctacattttcagagtgacattgagccagtctcaattctccctggacttcagtctctttatctagacaaaaaaaatgtgggaggtggggatggagttttgactagaacagctattcctaacctatattctatagaagatactcaccatgcacaaatataagaattccatggccaaaataaaccatattctattcccttcttgagatgcacacaactcatcagcatattaaggtctctgagaagtcctgcaataaagaagcctattgtatttcatccggtctaacatttccctaattgatttggctcctgaatttttctttcagtggaataactacactgcagtaccatcagagaaacattaactaagcattgagtttagaagctagtaagatgtcagattagtagattgcaaaaattttctcccattctgtaggttgcctgttcactctgatggtagtttcgtttgctgtgcagaagctctttagtttaattagatcccatttgtcaattttgttgccattgcttttggtgttttagacatgaagtccttgaccatgcctatggcctgaatggtattgcctaggtttccttctagggttttaatggttttaggtctaacatttaagtctttaatccatcttgaattaatttttgtataaggtgtaaggaagggatccagtttcggctttctatatatggctagccagttttcccagcaccatttattaaatagggaatcctttccccattgcttgtttttctcaggtttgtcaaagatcagatggttgtagatgtgtggtattatttctgagggctctgttctgttccattggtctatatctctgttttggtaccagtacaatgttgttttggttactgtcgtcttatagtatagtttgaagtcaggtagcgtgatgcctccagctttgttcttttggcttaggattgacttggcaatgtgggctcttctttggttccatatgaacattaaagtagttttttccagttctttgaagaaagtcattggtagcttgatgggaatggcattgaatctataaattaccttgggcagtatggtcattttcacgatattgattcttcctatccatgagcacggaatgttcttccatttgtttgtgtcctcttttatttcgttgagcagtggtatgtagttctccttgaagaggtccttcacatcccttgtaagttggattcctaggtattttattctctttgaagcaattgtgaatgggagttcactcatgatttggctctctgtttgtctgacaaagggctaatatcaagaatctacaaagaactcaaacaaatttacaagcaaaaaaacaaacaaccccatcaaaaagtgggtgaaggatatgaacagacaattctcaaaagaagacatttatgcagccaacagacacatgaaaaaatgctcatcatcactggccatcagagaaatgcaaatcaaaaccacaatgagataccatctcacaccagttagaatgacaatcaataaaaagtcaggaaacaacaggtgctggagaggatgtggagaaataggaacacttttacactgttggtgggactgtaaattagttcaaccattgtggaagacagtgtggcgattcctcaaggatctagaactagaaataccatttgacccagccatcccattactgggtatatacccaaaggattataaatcatgctgctataaagacacatgcacacgtatgtttattgtggcattattcacaatagcaaagacttggaaccaacccaaatgtccatcaatgatagactggattaagaaaatgtggcacatatacaccatggaatactatgcagccataaaaaaggatgagtgcatgtcctttatagggacacggataaagctggaaaccatcattctcagcaaactattgcaaggacaaaaaaccaaacaccgcatgttctcactcataggtgggaactgaacaatgagaacacttggacacagaaaggggaacatcacacaccagggcctgtcgtggggtgaggggagaggggagggatagcactaggagatatacctaatgtaaatgacgagttaatgggtgcagcacaccaacatggcacatgtatacatatgtaacaaacctgcacgttgtgcacatgtaccctagaacttaaagtataataaataaaaaaaaacaagaagctagtaagatgtgactccatgacatctagtaaacctttccaaacaaatcaacatatgtcacagtaagttatagaaggctggtattaaaagcgaatgggatgaaccctaggaccagcaggaacactacagaattcttccgcccatccctccttcacttcttgagaattaattgttctctttaggcagaatagtttgaatgctcagacatcagctttgattttttcctttcattccttcaatttgtctagaccagtgactctcaaatcttagtgtgcctaagaagtactgtagtattggggttgagggtaaaagggggacttcaatttatctgcaatgtattttttctcttatttaaaaaaaatgaagcaaacatgacaaaatattaacaggatgatgaaaacaagtgttcattacatccatctttgaatttttctttagtttaatttttttcaaaataaagaataacatttacataatctcagttcagggttgaatatacctcatggggcatttagaggattttcaggagtaattatgactcccatggttttgcctgatacacaccttttatgtctcacccccatataagatgcaaccacacttaataacatcctccagaaaaggttttactggccaaaagcacccaggtcctccaaaagttgatgtccttgggcctaacattgccttcaccttgttatttcctggctgtaggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcaggtgagttctgaccaggttcacccactccctgctcagaacatgtcttgccccactaccttctgggcatagactctaaaagaggggccaaacagaggtgaacaggccctggcaacccaacacctttgcagaataggtagacccagctctgtaacttatactcggcaagtaagaataaaatacaatggggcattttattcaggagccaatgatttattataaccaaggagactaagaaagccatcctagagaaagtggggttgaagttactcagcatttcaatcaaacaagataggaaagagtattcaagcatgattaccaataatagcaggaactaaggcataaagcctagaaaatcacagcaacttcaaagtaaatgagcctgccaggtggatggtgttgctcacggtcaaggccagggatactcccttctataaaatctatcccccaaactttgcactgggtctaggggtttagatttccttctccagatgtggagtatccttgagatattggctaggggcaaagccttcagagtctactgccacccctccacaccaagtccctgatctcctctcctaaggcataaggaaaatgaccaatgtccaagaggtgaaaaaatgtccttacacatgtaataataacagctaccattcatgagaattcactaactatgccaggtacttttcatgtgttatatccagccctcctaataaccccatgaagcaggttttaccaggcccatttttcagattagacaaatgagaatcagaaaaatttaagtaacctgccaaagtttccagtttgttagtagcagagcctagattctaatctatattagtgtgaatctgatgccctctcaaagtcctatagcagtgcatggcattcaataggcactcaaatatttgatcaatatatgaatatgtttttatttcaaagagcttaaaaaagggcgctggtcctaaatgtcttctcctcctgctccagtccttcagggaaacacgttttttttttcctttgggtgatgagccttaactgtccaggcctgtgggagaggctgtacagatcctaaccctcaggtttgactgaactcggtctttcctgaaagcaggctgggtaggggagggagcttaggaacctcatcatcaagagcaggcttggaggaacccgaggcttacatggccttcctcgctcaggagcccaccttcccatcccctcaagtaaacatccagactggaagagtgacaggcttaggaaatggccatccaggcccagctggctgcggggatggtaaggtcagcctgcttggattttgctgctgccagactaatttcctatctctaggaagctaagtcctggtacagcatgataggacaaaccagcagaaagtgacatttccaaggtcattcgacttcaggaaattaacccagtgtgacagctgccccactttggagcttttatctgcagaaattcaactgcattcactttctcttcactttttccctccttccactcccttcttttgcctcttcttcctcagcctctcccttccatttttccccttttgcttcaaccttgtgcttaaaggggcccacatccagagctgtgggtgtgagctggaggaaggaagttcacaaagggctgtgtacctcatcacatgcagccaaagtgccagttcaggtccactagaacaccaccaattaggtatcttagggtattggggttggctttgcaggagagcagtgctgccagcaaacacctgagtcaaccccaccatgggactcagaatccaaaggccaggacacatggttttgaatcctggctgatgtatcagcttgctgtgtgactttagatgactctcaacctatccctctctgcaccctgggtttctcacctgtcacatgagggagttgccttgatgatctaaggctctttgggctctgaaagcctttcttctccatcccctgcagcaggcactcagatgttggaaaagcctttcaagctggagtcttgtattccagcttgagctgcaggcctcaaattctgttgagaggactccctctggttctgagtctgtggcctctgtcagggttgaacaaccaaaataaacagctagcccagaatcctgaggagcccacccctttccagtcgaccccagcatgagcctactgatgtagtcaactgtgtctggacacccagaaggcagagggcctctttgaaataacctttgatgagccctgtgtgtgaagaaggtagccaagaaccacttgcaacacctgctgcaggtgcacatgggtgctgctcaacttaaaatttgagctctgtccctacctgagggctatgcagaagagtaaggaacaggggcagcccctggcctccaggcaacttgctaaagacaggtctccagaggccagaaagactccaaaaaacccagaagttccctgactgtgtcacttgaggcaacctatttttacctctctaaacctccatttttcaatcaggaacttggaaatacacacataattatttaataaacatgagttgtccacacccaccgccacccaaaggtgctgcatcccagcagccatcgggggctttgtctaggctgggcaaagttggctgggagaccagatggccaccaggtcactgaggtggggtgggaaannnnnnnnnnnnnnnnnnnnnnnnnnnnnnnnnnnnnnnnnnnnnnnnnnnnnnnnnnnagcctggaggacagagcctgccgccaggcccgggcccccagctcatctgcacctccaaggccagagggcctgcaggtccccaaagcagctgactgcactctgcttcccaccatgcttcctgccagaactccttgtggattttttatccttcagttttgctaaattcctttatttgtgttaacagtttgtatgtgtgtgtatgtaatttgcagggctttctatatatgaaaatcatgtcacggccgggcatggtggctcatgcctgtaatcccagcacttttggagactgatgtgggaggactgcttgagcctgggagttcgagactagcctgggcaacatggcgagaccccggtctctacaaaaaaaaatttaaaaattagcaggcatggtggcagatgcctatggtcgcatctactctggaggctgaggcaggagaattgcttgagcccagaaagtcaagactgcagtgagccattattgcatcattgcgctccagcctgggccacaaagagagatctcatctctcaaaaataaataaataaacaaaaaaacaaacacaagttccctgaccttctttccctatcctgggcaactgattttctaacaataactagaatagaggcacagcctccctgatgtgcagatcctgcatcattcaaaatcccttctcttcccagaatcaccctgacactggcctgccccatggacttgaagaatttccccatggatgtccagacatgtatcatgcaactggaaagctgtgagtgtcttgcatgagtcctctagaaagaaccaggctcctttttacccatgggataggcagaaattcccacacagctgctcctaaccactagaccccaggagattactgtaataacccaaaatattcaatgaaggactttgcttttagaaaatgcattagaaatataacttcccttacattgcctaactgaggcccatgttttggagccagcagcattctccaaagggtcattgttccatgtctatggtaaatgtgaacggaggagaaatggcttgaataagtcatggtccttgaacccacaagatgttcactccagcaggggaggtaaacaactgactgcacaaataactctactaaagggcggcaagtgattggtgtgttgttagaagtacaaagcactgtggcctcgtggcagaaagcgtgcttccttctaatggagaaggaaagaggttattggagtagactttatggaggactgggattttaacagattggatagcagactcctttgattgcaaacagagaaaccaatctgactaacttaaaaatacagaaaccaaggcagagcacttaggcaacaggaactaatggaccatttccttggagcactacccgtgaggggaatcagcacaaaccaattctgaacctcttgttacttcactcaatagttgctgaagtgctggggcacagtctggcctagcttgagtcaccttttcacactttcccccgtctaccccagccagtggttagtcccaccaagagagcgtgcaatagagttgttccacagaggagtatctgctgtgagcaaaagaggaggctggcaaggatggtgtgcaggtgaaaatagcagatgtccactgcatttcaccatgggagtgagagggggaacaataggacaaactaatgcagaaggttgggaagagaggtggaagggctctgatgtagatataaataattaaccagttttttacctcttttgagaggaaaaaaaaggaacctggtctcacaagttccatcaagtgtctgatgtctctctcagtctctaaccctaaccaatcctgacatgcttcaaacaagtgcttctgagtggtgactgctccttcttctgatcccatcccagttggatatacgatgaatgacctcatctttgagtggcaggaacagggagccgtgcaggtagcagatggactaactctgccccagtttatcttgaaggaagagaaggacttgagatactgcaccaagcactacaacacaggtaggtacaagggccaccctcctcagatcccaccccccaaccaggaccagaggtcatttcagacacattcaatcattgatccaacagatcttatgaagattacctagtggttaagagaataggttttgaaacaaaaatgtggctctgacattttcttcctgtgagtcctggagtgagtaacttaagcttgggccatacctaattacgagggaagctggtaaatacagtcattattccaggtagcagaatggatcctatttctaaggcagaagtaaagaactgatattgggaagacacctagtagtctctgtcacagatgaactggcatttccaatagagcaaaagtagagagaatgctcacaatagacctcagcaagagggagctgagaggtgtcactgaaggttagtaaatagctagaaagggttcacttgcctgtgagctatgagaggtcagagaagccacgatggtgtagcttagctctctatttcccatgcttttgttggaagattgaatatctggatgactggggccagatcaagactggctttgcgtatcctgtctcaggctgagaacaagctcataaaagcatggaagaagaaagtcagtcaattggtataacagctggaaggatgggtaggaagctggggtctgaacccagatgcacagagtagagaggcatggcaagccagcaagaggaggaggtgaaagagagagattgagagaaaccatcgtaggctctggtgtaagtagaaagcccagtgaaggtacaggcagcctgggctgcagtctgtcttgggtagctgcctctttctgagtcacctcagagatgtttcagaacctccaaagatactctctttgttccttgagccataatggtattcccatagcagccatgaaagcaatgactcccaagtcaaatcaccacaactgaccctcacataccaagtcttttactctttatacagcattttcttttctttttagctttcttaaggtataactgaccaataacaattgcatatatcgaaggtatgcaacgtgatgttctgatatacatatgcattgtgaaataattaccacactcaagctaagtaacatatccatcaactcacatacttctcattgtgtgtgtgtgtatgtgtgtgtgtctagtaagaacactttaagatctaccctcttaaagacctaaatttaagattaagctaaaatgataaaacttctagaagacatgaggacaaatcttcctaatcttagatttggcaatagattcctagatataacaccaaaaacacaagcaataatgaaaaaacaatagatagatttgacttcataaatattaaaagtgcatcaaaagacactatcaagatagtgaagataaagaacccacagaatgggagaaaatacttgcaaatcataaatctgatggggtcaaatattcaaaatatatttaaaaactcttaaaatgtaagaaaaagaaaaaaaaggccaggcatggtggctcatgcctgtaatcccagcactttgggaggtcaaggcgggtggatgacttgaggccaggagttttagaccagcctaaccaacatggtgaaaccctgtctctactgaaaatacaaaaaaaaaaaaaaattagttgggcatggtggcacatacctgtaatcccagctactttggagactgagacaggagatcccttgaacccaggagacagaggctgcagtgagctgagatcacgccactgcactccagcctggatgacagagcaagactctatctcaaaaaagaaaaaaaaataagtaaaaaggagatctatcctcttagcaaatttcaagcacacaggacagcactgttaattctagtcacattgctgtacattagatctccagaacttattcatcttgcacaactgaaattctgtaccctttgaccaacatctcccaatttcccccatccctcagcctctagcaaccaccatgctacttttggcttctgtaagtatgactattttagattccacatataagtgagatcatacaatatatgtctttctgtgtctggcttatttcacttaatataaaaatgtcctccatcttcattcacattgtcataaatggcagaatttccttcttttttaaggctgaataatgtttcattttctttatctattcatccattgagaaatatatcatggtccagcaatcccacttctagatacatatccaaaggaaatgaaatcagtacctcaaagacatatctgcactcccatgttcactgcagtaatattcacaatagccaagatatggaaacaacctaaatgtacacagcatattctgattcatttcacttgctcttcaccattttcatttaagttagagctgaactctgtgctagaccctatggatgcaagaagaaaagactgacaagtccctgcctacagcttacagtccagggaactccaggaaattcgctattgtgcttcagtagacaggaactaagatcccaccataagactggccccatcccagttccagggatacacagacagggagcagacaagctgcctagtctagtgcagaagacagatagaaagagagactgacttgcccattcactcactgtattatatcttgaaggctctcatgatcatgtgaacagggctcagggaacacagaaaaagagcagcattctgtctgggagaatcttcacatttacactgccatggaggagaaggaagatttatttggctggttgtgggaaggaacaagggcattctgggcaaagggatgagcaagatcaaaagctcagaaacatgaaagttcagggcatgctcaaggcaagggatggcatatagggagtcatgattagggtgaagaaagatggggaaggggatagaaagactggttagagcttgattataaagggcaggctaaagagtttaaactttttcctgtaggtaatgggaactgccttgtatgaggaaagaaggatgagaccaaaggttttacaagaggaaataacaggaacaagtcatgttttgggaagataactggcagaaaggtagagaaagttctacttagtcaggcccattcttagcaagaaaatattgatgatgatgatgatgatgatgatggtaacagtgatgttggcaattgacaattctgaacatttacaatgtatgaggactgctaagtttttcataagcatcatctcattttatcctcacattaatcatataagtaactatatgatggaggtattattgttattatccccagtttactatacataaggaaacagatacagaacaattcaaatacttgtctaaggacacaggtagtgtgagactgaaccaggactctagccgaggttgttctaatcctaaagccttttgtcctattcaccaggctacactgccttctcactgcaatttcttgcaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtaagtcccattgcccaagagcacagaacacctggacaaataaggacagcacctacttccttgctctgcctaaaacatggggagcaaaggaattattcactacttatttatctactatactttgcaggatcctgcagatctttgcaggttctacacttttctgatccatcaaaccttccaccagactcaacattatgttcaatacgagttgccagacaccacattctgctccactgtctaccaacaccagacacacattctgcttcatttactattaacactcaacttcacattctcctccattcacttttagggctaagtacaatattctgctcttttcaccattaatagtaaatactgtgtgtcagggatctccaacactaatctcatatctagagatttgatagaaagattcataggactcagcataaagttgtatttgcagctaagatttatttattttttaattttttgaattaaaaaaagacctttatattccaccctttgagttgcaattgggacaattgggagagggggaagagttggagtgggatgaagaactaggaggggctcgacggctggaggtcttgtccacttagtttttgtactggaagggctcattgccggtttcattgagaagacacgtgttgatgagggcttctgtcaccgaaaagggttcgcagtggcagaggggcaacagtcttcaaagtaacccttcttctcctggccaacagtccagggaatgtgtatgttggcactacgattggctacaccagcagaaaagtcgttgatgttggaggtttcatggaatccagctaggtgttgggctttgtccaggcctcccttgggatcataagcgtggatgtggtactggtgccactgcttagtttctcgatggcctcctcagtgtacttcagaccattctcctcccacatggccttggtgctgaagttggtatggcagcctgaacacttcctgttcccaggaatgggcttgggatcaaaggttgctatcactccaaagtcttcacatacatgatgcaaaatgaaacagcccacccagaaatgatctcccatgctgattctttcacagggtccggtttgaaattcccactgggcaggcatgacctcagcattagtacccaccatcttggctccagcatacaagcaggcctggtaatgggcctccacgatgtccctgccatgggctttgcctgctcccacactgcagtaatatggaccctggggtcctgggaagccattggaaggccaaccaaagtggtacccatctgtccccatgagggtatattcctgctccatgccaaaccagggtgctggttgctcaccatgtccattatccacttacaagtgtgcctcaaattggtcactgcaggctttcggttgtactcgaaaacttcacagaacaccagcttgtagggtccttactgaaggtatcccaaaacatggcaggaggcatgaaatgcatgtcactgttggagccttcagactgtaaaatactagagccatcaaaattctaggctaggcatggtggctcatgcctgtaatcccaggactctgggaggccaaggcagttggatcacctgaggtcaggagttggagaccagcctggccaacatagtgaaaccacgtctctactaaaaatacaaaaaattagctgggcgtagtcacacacacctgtaatcctagctactcgtgaggctgaggcaggagaatcgcttgaacctggcaggccgaggttgcaatgagctgaaatcatgccattgcactccagcctgggcaacaagagtgaaaactccatcagaaagaaaagaaagaaagagagagagaggacagaaagaaagaaagaaaaaaagaaagaaagaaagaaagaaaagaaaggaaggaaggaaggaaggaaggaaggaaggaaggaaggaaggaaaggaaaggaaaggaaaggaaaggaaaggaaaggaaaggaaaggaaaggaaaggaaaggaaaggaaaggaaaggaaaggaaaggaaaggaaacgaaaggaagaaaggaaggaaggaaggatggaaggaagggggagagagagagaaagggagggagggagggaaagaaagaaagaagagagagaaagaaaggaagagagagagagagaaagaaagaagggaaggaaggaaggaaggaaggaaggaaggaagaaaggaaggaaagaaagaaaagaaagaaaagaaagaaagaaagaaagaaagaaaagaaaagaaaagaaagaaagaaagaaagaaagaaagaaagaaagaaagaaagaaagaaagaaagaaagaaagaaagaaaagaaaagaaataaaaaggaaagaaaagaaagaaagaaatcccactcaggcaactcttccacacagttgggctcactgtccagagtctgggtcttgcagcgccatccttctccagtaccatcgatccagacatacatggcctggactttctcaccctgagacagggacatgtacacctgcttaatacctttgtttaagtgggaatgtgctgaggcggtcatggtggaaggtgttctgggcgctgagcaggcgggcgggtaaaggtaggccatgagagtgaggtgaggagaggagaggagaggagaggagaccgccgtgctgctcacacactccgctcttctcccattctcagctctccacagctaagatttattacagcaacatattcagaagatacagctagctcatcagggggaaagaacataggcagagactagaggaatccatgtgcaggcttccttactctcccgctcccatgaggggtcacacagaatgcactcttactccagcaacaacaatgcagacacgtgtgtgctgtgtttctgccccaaaagacagaaacacagaaactcttagtcaggcatggtggcccgcgcttgtaatcccagctactcaggaggctgaggtaggagaatcacctgaacccgagaggcggagattgcagtgagccaagatggtgccactgcactccagcctgggcaacagagtgagactccatctaaaaaaaaagaaaaagaaaaacagagtctgctctaagattcattagaggactcagcgtgccatgttttaactgggggctggtcacatcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttgcattctgcttaattcactttttttttttttttgagacgaagtctcactccgttgcccaagctggagtgcagtggcactatctcggctcactgcaacctccaccctccacctcccgggttcaagcgattctcctgcctcagcctcccgggtagctgggactacaggcacgcgccgtcatgcctggctaatgtttgtatttttagtagagatgggatttcactatgttggccaggctggtcttgaactcctgacctcgtgatccacccaccttggcctcccaaagtgctgggattacttaattcagttttaacgctaaacataatgttccgtttcacttacggttaatgctagacaccatatactcctccattcacccctagttgaggtacaacattctgttcccttcactattaatacttgatacttcattctacttcactctcttttaatgctacatgctgcattctaccacattcactattattgtttgagtcacattctgctctattcactcaacaatagacacaatattctgctctattattaatgccagacaccacattgtgcttcctttagccttctgctaaaaacaatgttttgcaccatttccaattaatgctgcttaacattctgttttgatatagaaaagttgaaagaacatacaataaacaccctcacaccctttacccagattcaccagtcatcattttcccacatatactgtcttagtttaggtagacagatggataaatagatagatagatgggcaggtaggtaggtagatgcaatttttgctgaatcaacaaagacatggcaattcacctcaaaataaggaaggagaatcacaatgacattatcacatctttaaaaattaacattaactcaatggttattattgagttagaaataattcaatttgaaataattcaataatatcatctaatacagaaactttatttaaattctcccagttgtcaaaaaagtcatcagaaaatatgatgagggatccaatcaaggatccaattcatattgcacacagttgctctattttgtctcttttaacctagaacagtctcccagctgttttttgtttttcatgacactgactattccattaacttttaacgtgagacacaacattctgtttcatttgccatcagcagtagacaccacactctcctctattcacccttagaacaaaactcgacaatatgctctctgcagcattcacactagacctcaaattctgctacattcactacaaatgcttgaatccacattctctgatcactattaacacctgacaacacattctgctgtgtgcaattgtagcagcagacataatgttctgctttcttttccttatgttagattcaacattctgctccactcactattaatagttgatgccacattcttctctacctatggtttacactagactcaacattctgctgcatttgtggttaaaaatatttggctccatatgttattaacactcaactccaccttccccttcattcatactttttatttatttgcctttttaagcattagatttagttccttttagtatattcacaaagttgtacaaccctatctatacaactgcctatagatagtatctaattccagaacattttcatcacccagaaagaaaatccataccctccaacagtcactcctcattccccactcccaagagcctctggtaacaataaatggatacttaactacctgtataaatttgccttttctggacatctcgtataaatggaatcatacaatatgtggccttttacgattggcttctttcatttagtgtaatgttttcaaggttcatccatgctgtagaatgcatcagtacttcattcctttttatggctgaataatattccatggtatagatatatcacattttgttatccattcagcagttaggcatttggtttattttcactttggctattataaataatgctgctgtgaacatctgtgtacaagtttttgtgtggacatgtttttaattctcaaaggtatatatctagaagtgaaactgttgtgtcacatgttaactacatgcttaactttttgaggaactgccaaactgttttccaaagcagctataccattttatgatcccaccagggttccaacgtctgcacatcttcacaaacatatattattatctgttttttttaactatagccatttagtgggtgtgaaatggtattgcattgtggttttgatttgcattttgctaacgaataataatgctgagcattgtttcatgtgcttattgatcccttctgtatcttctttggtgaaatgtctgcatttctgctccactcactattaaaatcttttgctcacttttgttatttgtcttattgagttgtaatagttctttatgtattctggattttagacctttattagatataggatttgcacatattttctcttgttctatgtgccgtggtttagattcttttcccttccaaaccttgtattaaaatttaatccccaacattggagaagggtcctaatggaagtgtttggatcataggagtggattcctcatgaatagattaatgccttctcttaggggtgacttctcactatattcattgtttaaaaagagcctggccacaggtaatacacctatgtaacaaacctgcatgttctgcatatgtatcccaagacttaaaataaaatttaaaaataaataaaattttaaaaaatgatttttaaaaagaacctggcgtctcccacccacttcttgcttcctctctcaccatgtgatctctgcacatgatggcttcccttcactttctaccatgagtggaagcagcctgaggccctcaccagatgcccaatcttgaacttttccagacatcagaattgtgagccaaataaaccattttttctttataaattatcccatcttagatattcttttgaagtaacacaaaatggactaagactctatgggttttcttttcacttggttgatagtatcatttatgctcaaaagtttttaattttgataaagtctaatttatctgttttttcttttgttgcttacgcttttggtgtctttttttttctttttcttttttttttttttttttttgagatagagtactactctgtcacccaggctggagtgcagtggcacaatctcagctcaccgtaacctctccctcccaggtgcaagagattctccagcctcagcctcccgagtagctgaaattacaggcatgcaccaccatgcctggctaatttttatatttttagtagagatggggttttgtcatgttggccagcctggcctcgaacttctgacctcaagcaatctgcctgcctcagcctcccaaagtgctgggattacaggcgtgagccactgctcctggccttggtgtcattttttagaaactattgcctaatccaaggtcatgaagattaatacctgtattttcttctaagagtttcatagtttatctcttatgtttaggtctttggcacatttagatttatttatatatgtgatgtgagggaagaggtccaacttcattttttttttttaagacatagtctcactctgtcacccaggctagagtgcagtggcatgatcttgactcactgcaacctccgcctcctgagttcaagcgattcttctgcctcagcctccccagtagctgggattacaggcatgcaccaccacacctggctaatttttgtatttttactagagaaggggtttcaccatgttgtccaggctggtctcaaactcctgaccccaggtgatctgcctgccttggcctcccaaagtgctaggattacaggtgtgagccaccgtgcccagcccaacttcattctttcacgtgtgaatatccagttgtcccagcaccatttgttgagaagagtattcttttccctgttgaattgataccctcgtcaaaaaaatcaactgacctataaatggactggcttacttctggactctcaattctattgcattgatctatgtgttgatccttttgnnnnnnnnnnnnnnnnnnnnttggaagtgtgagtcctccaactttgttctactttttcaagaattgttttggctactctctgtctttttcatttgaacacaaatataaattttagaagcagcggccaggcatggtggctcacacctgtaatcccagcactttgggaggctgaggtgggcagatcacaaggtcaggagatctagaccatcctgactaacatggtgaaacctcgtctctactaaaaatacaaaaatattagccaggcatggtggcaggtgcctgtagtcccagctactcaggaggctgaggcaggagaatggcgtgaacccgggaggcagagcttgcagtgagctgagatcgcaccattgcactccagcctgggagagagagtgagactccatctcaaaaaaaaaaaaaaaaaaaaaatttagaagcagcttgtcaatttttgaaatgaaaaaaatagctggagttttaataaagaatgcattgactccatggaccaatcaggggagtattgccatcttaacaatattatgtcttccaattccatcaacatgggatttcttctcatttatttaggtcatctttaatttctttcaaaaaagatttctagttttcagtgtacaagtcttgcacttattttgttaaattatataacaggtgttgtacagatatattcttttatgctatataaattgaattgtttttaagtttaatttttaaattattcattctagtctatagaaatacaattgatttttgtatgttcatcttgtatccaataactttcctgaactcatttattaactctaggtcttttatacatccttaggattttctttatacaagaccatgtgatgtacaaatagagatggctttatttttttctttctcacctagatgtcatttatttctttttctcaactaatttccctggctagatctcccagtacaatgaagaatagaagtagtaagaacagatattcctgtctcattcctggtcttacagagaaagctttcagtttttcactgaaaactgaggttagctgtgggttttacatagatgccctttacagtttgaggaagttttctattcttaatgtgtggagtatttttaccatgaaagctgttgaattttgtcaaatcctgtttctgcatctatttagaggatcatgtgatatttttcctttattttattcatatggtaactgatttttgtatgttcaactaacattgcattcctgggatacatcccacttactcataacgtataattctttttcacatgtcactggatttggtttgctagtgttttcctgagagttttttttttttgtctgtattcataagagatgttgatacgtagttttctttattgtgatgtctttggtgttgttatcagggtaatacttgcttcttagaaagagttgggaaatgttctatccacttccacttctctgagagtataagaaggatttgtgtgaattctttaaatgtttggtagaattaatgaaagaagccatctggtcctggacaattctttgtcgaatttttattactaattcaatctccttacatgttatgtgtgtattcaaagtttctattttttttttttttttttttagatggagttttgctcttgtcatccaggctggagtgcagtggcacgatctcggctcacggcaacctccaactcctgggttcaagcaattctcctgcctcagcctcccaagtagctgggattacaggcacacgccaccacgctcagctaatttttgtatttttagtagagatggggtttctccatgttggccagactggtctcaaactcctgacctcagatgatccacccgtcttggcctcccaaagtgctgggattacaggcatgagccaccatgaatggcctctatttctttctgggtcagtgtctttttaggaatttgtccacctcatttaggttatcaaatttattggcatacagttgttcaaagtattcccttataatcctttttatttctgtaaagtcaatgataatgcctcctctttcactcttttagtaatctgattcttccctcattttttcttgaacagtatagttagaagttattcaattttgctaattttttcaaagaatcaacatttggtttcattgattttctctattatttttctactgttctacttattaccattccaatctttattattttcttccttctgcttgctttgactttagtttgccctcctagtttcttaaagtgcaaagttattgatttaggacctttcttctttttaaaataggtgtttacagttatacacttccctctaaaaatgattttagctgcatctcattagttgtagtatgttgtgttttcaattctcctcagagtattccttaatatatcttttatttattctttgatgcattgtttaatttattgttgtgagttttccaactttcttttggttattgatttttaatattccattgaaatcagaaaacatattttgtatgatttcaactattttaagtttgagacttgttttatgcataatagtatggtttattctgaaaatactccatggtgcacttcagaagaatgtacattcttctgttactgtgtggagtgttctataggtgttctttaggtctagttggtttacagtgtcaattaagtttttcatttccttggcaatcttctaattattctattcattataaaaagcagggttttgaagacaccaagtattattgttgaattatctatttattgcttcaattcaggcagttttgcttcatatattttggggctctgttgttagatgcatagatgtttataattgttatatttcttgatggattgactcatttattatcaaatgctcttcatctcttattaacaatttttttttcttaaagactggtttgtttgtgggttttttttttttctgatgttggtataatcacctaaaggcctcttttggttactgtttacatggtatgttttttccattcttctacttttatcctagttgtgtctttgaatctaaagtgtatcttttatagacagtatgtagttgcattttattttttaatccagtctgacaatctctaactttcaattagtttgtttagtctatttccacttaatttaattaatgtaataaaaaatgcgatttcgtataatttacatctgccactgtgttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtgaaatcccatctttacaaaaaatacttttaaaaaattagctggatggaatggcatacagctgtagtcctagctacttgggaggctgaggtgggaggactgcttgaaccttggagattgaggcctgcagtgagccatgctggcaacactgcactccagcctgggtgacaaagcaagacactatcaaaaaaaaaaaaaacagtattttctagcgtgtcatcttaattccctggtcatttcttttactatttttttccagttatttttttcatgattgccctgaggattacaatttcatcttattttagaaacatctaattcagattattaatactaacttaattacaacagtgtcttagtttacttggactgctaaaagaaatgccacagatttggtggtttaaacaataaaaatttatttttcatagttctgaaacctgggaagtccaaaatcaaggtggcagctaattcagttgctggtgaaggttctttttcaggtttgcagatgaccactttcttgctttgtcctaacatggtagagaaagagttctggtatctcttcttccctaaatcctattgaattaaggccccacctgtaagatctcaccctaaagatctcacctctaagatctaaccctaaccctaaccctaagtctaacctaatcacttcctcataggccctgtctccaaatacagtcataatgggggtaaggacttcaacatacaaatgctaggggcacacaaatattcagttcataacaaacagtacgcaaaaaactttgctcctatatatatctcaattacctcccccttcctttgcactattatcatacaaattacatcttcattatatgttgattaacacaggtttacaatcattgatttactcaactgtcctttaaatcagataggagaaaaaagttataaacaaaaactgcattttttatattgtcttgaatatttacctatgcagttacctttactaatactccttatttcttcgtatgaatttgagttactgtctagcatccttttatttcagcctaaagggcgtcctttagtatttcttgtaggacagatctgctagcggaagtctctcagcttttgtttacctaaaaatgtatttttcatttttaagggatacagaattcttgagaaaaattggcagtcttttcctttcagcactttgaaaatgttatcccactatcttctgtacccgatggtgttaatgagaatacaactgttaatcttatcaagaatcccttgtacaaaaggagttgcttctcttttgctgttttaagattctgcctttgcaggagaatttcttgaacctgggaggtggaggttgcagtagcagagatctagccactgcactctagcctgggcaacagagcgagactccatctgaaaaaaaaagattctgactttgtcttctgacattttgattaggatgtgtctaggtgtggatctctttatcttacttggatttccctgtgcttcttagatgtatagattactatttttaatcaaatttgataagttttcaggcactatttttttaaatattctttctgtctccactgcaaattcctattaaacattatgttggtgcattacatggtttcccacaggtttctggggctgtttatttttcttcattctgttcctcagaccatataatctaaaattcactgattcttctttaagtttcctgattcttctgtcttcttaaatctactgttgattccatctagtgaagttttcatttcagttattttacttttcaactccagaatttctatttggttcttctttatcatttctttttttgagaaggactctcactctgttgcccaggctagagtgcggtgatacgatctcggctcactacaatctctgcctcctgtgttcaagcaattctccaatcttagcctcccgagtagctgggattacaggcatgcaccaccacacctggctaattttttctatttttagtagagacgaggtttcaccatgttggccaggctggtctcaaactcctgacctgaggtgatctacctgcctcagcctcccaaagtgctgggattacaggctatcatttctctttattaatatgctatatttggtgagacactgctctcatattttcctttagttgtttagacatagtttcctctagtttgttgaacatacttaaaataactgatttaaagtctttgtctattaagtccagcatctgggcttcctcagggacagcttcttttgactacttttctccctatgtatgagccatactttcctctttctttgcatgtcttagaatttttgttaaaaatggacattttatttaagttctgggatacatgtgcagaacatgcaggtttgttacataggtatacacacgtcatggtggtttgctgcacccatcaacccatcatctacgttaggtatttctcctaatgctatccctcccctagccccctaccacccaataggccctggtgtgtgatgttccctgccctgtgtccatgtattctcattgttgaactcccatttatgagtgagaacatgcagtatttggttttctgttcttgtgttagtttgccgagaataatggtttccagcttcatccatgtccccacaaaggacatgaactcatcctttttatggctgcatagtattccatagtgtatatgtgacacattttctttatcagtctatcattggtggccatttgggttggttccaaggctttgctattgtgaacagtgctgcaataaacatacgtgtgcatgtgtctttatagtagaatgatttataatcctttgggtatatacccagtattgggattgctgggtcaaattatatttctagttctagatccttcaggaattgccacactgtcttccacaatggttgaactaatttacattctcaccaacagtgtaaaagcattcctatttctccacatcctctccagcatctgttatttcctaactttttaatgatggccattctaactggcatgacatggtatctcattgtggtttttatttgcattgctctaatgaccagtggtgatgagcttgttttcatatgtttgttgactgcataaatgtcttcttttgagaagtgtctgttcatatcctttgcccactttttgatggggttgtttttcttataaatttgtttaagttctttatagattctgaatattagccctttgtcagatggatagattgcaaaaattttctcccattccgtaggttgcctgttcactctgatgatagttttttggttttttgttgttgttgttgttgtttgctgtgcagaagctctttagtttaattagatcccatttgtcaattttggcttttgttgccattgcttttggtgttttagtcatgaaggctttgtttgggcctatgtcctgaatggtattgcctaggttttcttctagggattttatggttttaggtcttacatttaagtcctcaatccatcttaatttttgtataaggtgtaaggaaggggtgcagtttcagttttctgcttaaggctagacagttttcccaacaccatttattgaatagggaatcctttccccattgcttgtttttgtcaagatcagatggttatagttatgtggcgttatttctgaggcctctgttctgttccgttggtctatatatcagttttggtaccagcatcatgctgttttggttactgcagccttgtagtatagcttgaagttgggtagtgtgatgcctccagctttgttctcttggcttaggattgtcttggttatgtgggctcttttttggttacatatgaaatttgaagtagttttttctaattctgtgaagaaagtcaatggtagcttgatggtgatagcaatgaatctataaattactttgggaagtatggccattttcacaatattaattcttcctatccatgagcatggaatgttcttccatttgtttgtgtcctctcttatttccttgagcagtggtttgtagttctccttgaagaggtccttcacatcccttgtaagctgtattcctaggtattctattctctttgcagcagttgtgaatgggagttcactcattatttgggtctctgtctattattggtgtataggaatacttgtgatttttgcacattgattttgtatcctgagactttgctaaagttgcttatcaacttaaagagattttgggctgagacaatggggttttctaaatatacaatcatgtcatctgcaaacagatataatttgacttcctctcttcctatttaaataccttttatttctttctcttgcctgactgccctggccagcacttccaatactatgttgaataggagtggtgagagagggaatccttgtcttgtgctggctttcaaagggaatgcttccagcttttgctcattctatatgatactggctgcaggtttgtcataaatagctcttattattttgagatacattccatcaatacccagtttattgagagtttttagcatgaaggggtgtggaattttatcaaaggccttttctgcatctattgagataatcatgggtttttggcattggttctgtctttatgatggattatgtctattgatttgcatatattgaaccagccttgcatcccagggatgaagctgaattgatggtcatggataagctttttgatgtgctgctggattcagtttgccagtaatttattgaggattttctaatcgatgttcatcaaggatattggtctgaaattctctttttttgttgtgtctctgccaggttttggtatcaggatgatgttggcctcataaaatgagttttggtatcaggatgatgctggcctcataaaatgagttagggaggagtccctctttttctattgtttggaatagtttcagaatgaatggtaccagctcctctttgtacctcttgtagaatttggctgtgaatccttctggtcctgggctttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaggtggatagcctgaggtcaggagttcgagactagcctgaccaacatgaagaaaccccatctctactaaaaatacaaaattagccaagcatggtggcgcatgcctgtaatcccagctactcgggaggctgaggcaggagaatcgcttgaacccaggaggcggaggatttggcgagctgagatcgtgccattgcactccaccctggggggcaacaagagcaaaactctgtctcaaaagaaaaatatatatatatatatccctccatccctttattttgagcctatatgtgtctttgcacgtgagattggtcttctgaatacagcacactgatgagtcttgattctttatccaatttgccagtctgtgtcttttaactggggcattttgcctgtttacatttaagattaatattgttatgtgtgaatttgatcctatcattatgatgctagctggttattttgcccattagttgatgtggtttcttcatagtgtcaacggtcttcacaatttggcatgtttttgcagtggctggtaccggttgttcctttccatgtttagtgcttccttcaggagttcttgtgagacaggcctggtggagactaaatctctcagcatttgcttgtctgtaaaggattttgtttctcctttgcttatgaagcttagtttggctgggtatgaaattctgggttgaaaattcttttctttaagattgttgaatattggcccccagtctcttctggcttgtagggtttctgccgagagatccgctattagtctgatgggcttccctttctgggtaacctgacctttccctctggctgcccctaacattttttccttcatttcaacctttgtgaatctgacaattatgtgtcttgcggttggtcttctcgaggagtatctttgtggtgttctctgtatttcccgaatttgaatattggcctgtcttgctaggttggggaagttctcctggataataccccgaagagtgttttcaacttggttccattctccccgtcactttcaggtacaccaactgaacgtaggtttggtcttttcacagagtcctgtatttcttggaggctttgtttgttccttttcattcttttttctctaatcttgtcttcatgctttatttcactaaattgatcttcaatctctgatatcctttattccgcttgatcgattcagctatcgatacttgtgtatgcttcacgaagttcttgcgctgtgtttttcagctccatcaggtcatttatattcttctctaagcttgttattctagttagcaattcctctaaactcttttcaaggttcttagcttccttgccttggattagaatgctcctttagcttggaggagtttgctattccccaccttctgaagcctacttctgtcaatttgtcgaactcattctctgtccagttttgttcccttgctggcaaggagttgtgatcctttggaagagaaaaggcattctggtttttggaattttcagcctttttgtgctggcttttcctcttcttcatggatttatctacctttggcctttgacgcttgtgaccttcaaatgggatttctgtgtggatgtcctttttgttgattttgacgctattcctttctgtttgttagttttccttctaacagtcaggcctctgagctgcaggtctgctggagtttgctggaggtccactccagaccctgtgtgcctagttatcaccagtggagactgcagaacagcaaagattgctacctgttccttcctctggaagcttcatcccagaggggcacctgccaggtgccagccagagctctcctgtatgagttgtctttccactcctgcagggaggtgtctctccatcaggaggcacaggggtcagggacccacttgaggcagtctgtcccttagcagagctcgagtgctgtgctgggagatccactgctctcttcagagctggcaggcaggaacgtttaagtctgctgaagctgctcccacacgctgtcccttcccccaggtgctttgtcccagagagttggtagttttatctataagcccctgactggagctgctccttttctttcagagatgctctgcccagagaggaggaatctagagacacagcctggctacagaggctttgctgagctgtggtgtgctccacccagttcgaacttcctggcagctttgtttacactgtgagggggaaaccgcctactcaagcctcagtaatggtggacactcctccccccaccaagctcaagtgttccaggtcaacttcagactgctgtgctggcagcgagaatttcaagccagtggatcttagcttgctgggctccgtggggatgggatctgctgagctaaatcacttggctccctggcttcagccccctttccaggggagtgaatggttctgtcttgctggggttccaggtgccactggggtatgaaaaaacaaaactgcagctagctcggtgtctgtccaaacagctgcccagttttgtgcttgaaaaccagggccctggtggcacaggcacccgagggaatctccttttctgcgggttgcaaagacactgggaaaagagtagtatctggggccggagtgcaccatccctcatgacacagcccctcagggcttcccttggccaggggagggagatccccaaccccttgtgctttctgggtgaggtgacaccccactctgcttcagctcaccttctgtgggctgcacccactgtctaaccagtcccagtgagatgagctgggtacctcagttagaaatgcagaaatcactcgccttctgcattgatcttgctgggagctgcagaccggagctgttcctatttggccatcttgccagccaagtttggacattttaataatataatgtggcaactttgaaaatcaaattctaccctctcttcaggatttgttgctgttgctattcagtaacttttctgaattaattccgtaaagttcgtattatttgttttgtgggactactgaagtctctgctcaggttggtagtcagctaaaaatcagacaaaggtttcctaaatgcctggaaactataagtctcctagcctttgccaaggggctctctaccttaaacattctgtgaggcagtttacaactttgactcaggctccacttcctgcttgctcagactatcaaggttagccaaaggtgagagcctagagccatctcaagtcttcccgggaattcacacagctctaagcttgcacacagtttcccaagaatatgtcacagctttccaaagccccctataaacaactcattacccagcttttctttttcagctttttgattaacctattattttgccccaactgcctcaggtggcaattactattgattgcttttgaaaaatgtcctcaaagaaaaggttgttcacacggggcaaacttcaaatcaggtcaaagacagccttgtgagtggcatctttgagggaaccatgagatatatcaaatgatgataactctctgggaatgaggcattgaagaagctccaactgtgttctgctccatccaatggcttccagacagctgttggttttcaatgctactatggagctggatagattatgacaggaatagggcaaaacaccacaaagctccaagggaaatgaaaatacatgtctgtgcagaaacttgtacatggttgtttatagcagcattactcacagtagctaaaaggtagaaaatttaaatatccattacctgattaatggataaacagaatgttgtatatccataaaacagggtattattcagccataaaaaggaatgaaatactgatacatgttacgatgtgaatgaaccttgaaaatatgctaagtgaaagaggccaatcataaaaagccacatattgcattatttcattcatataaaatatggattagtggttgtttatggctgggggaatagagaggtgacagctaaaaggtaacatttctttttgaggtaatgaaaatgttctaaaattgactgatgatgatgattgcacatatgtgtgaatattctaaaaatcattaaactatacactttaaatgtgtgaattgtatggtatgtgaattatatctcaataacacttttaaacactgccacaaagcttgctgttcttattaagattcagctgattttcttgaataaatgttcacaggactgatataagcctttggtaattagtggagttctgaaagttggcactgacaattttttccagtgttctcattaattttttggaggaattttcaggtccttacgatgccatttttgctgacatcctccattcacttttaatgctcactacaacagtttgttccaatcacccttaaatgaaagacagcattctgttctaaatgataatgctaaatataccattgtcttctcttcagtactgtcataggtaccataatctatttacccccaatattctttccagtctgtctgatgcatttcttttctgttttcctctatacctccaccctaatatcccagctgagaagcagacagcagtgggtgatgtggggaattaccgaagagcagaaaatattccgccatgcttaatgttttacattcccctgctttcacctccctgtttctcctccacccccactctaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggtaggcctttgggtcactgcctaaggagggacagctgttagtaaacaaaagagttctaagcagtattgtcttgtgttatttgtttcaatggtccatccttctcaatgtgcaaggcaggttagaaataggaattaaagacctagaggtctcagctttccctcccataaataatgccctaggtgggtctataggcagtcactcttcgaatcctaacagtaacactacagaaattatcaagttatacctaaaggcgcaactgattaactaaaagctgatggggtcaagaaaataactaactataaacctaaaagattgggaggtgtccactggcttttttctgcaagactgcattgttttaataggcttgattccagaagacaattgcaccacaaaaggtgagatcttaacgtagaatgcccaggttcaggcctttgcttcctgcctctaggaaagaggcaacaagcaagatctctgccagagtgggttctctctccatatgagggattgaataaaggaatatttgacagggcacctctgagaagttaccaacctctgttcacgaggttgtgcactgaccaaagaatgccaatggggagcatgcagcctgctggagcaaactgctccataccgtgggtccataactagttccccagaagatccaaccaccctagcttttttcttagttcttcaaacatacacacaggattttaaatatcttgttctctttccctgtactgctcttccagtgcactgtgtgtcctagcaaatgccacgttctacttgaacttaatttctaaacttctaaaaatgtatcctgatttaaaagcataaattcaatgatgtgatttttttaaagccgatctcttccaccaaatcgcaagctccataaaggcagagaccgtgtttggttttgctctgtgctatatccctggtgcctaacacaatgcctaacatatagtgagcatgcaataagtatttgttaaacaaatgaacaaagggataaacaaaagattaggttggtgcaaaaataattgcagtttttgccattaaaagcaataaagaagaagccttcagacagagagtctgaagtttttccactgacagattagggcaaccagggacccacacattatgacctgtcatagtgttgcaggtcacagtacatacctgcaatatgccaggtcctacaagctttagactgacctatttaaaatcgttgtctattaatcagtaaagctcaaaaataaaataaaacaaaacaaaatagttgtctgcccaggcgcaatgtgctgtgacaaaggaccctgcctctttagttttctttagtatgagactttgagctagcctacttgggcccaggttcttcatgtgcaaaatgcgtataaagggaaattctggtgagaattaaatcagaggatgccaaagtagctttaagttttgttcctgccgcacaagtgccaaggattaaaatgattacatatacacacatttccatcagtatgtttcttaaacatcagcaatctgattcaattaacttctggcagtttaccacagggaggaggccgacgttccaatacagaagatgtccatgggaattaagatatcaccatccttctaaactacattgaaggaggaaattgtcttgggttcagcaagccagatagaacttcttaaatgacccctagttttagttactctatattgtccatttaatacctagcctctgatgctttaaaaaaaaaaaaaaaagtctatttaagcaactggcatgatggcttgtgcctataatcccaactactaggaagactgaggtgagaggattgctttagcccaggagttccagaccaatgtgggcaacatagtgactttgtctcaaaaaaaaaaaaaaaaacagaaagaaagaaagaaactgaccaaacgtaagtatctctaggattttatttttccattttccctatacactagctgctttttgtaatttcatctgctagagacatttgttaaaaacactgatttgaaaagatcatgtccaagatattttactagcaccagcccctttgattgagcactgcacagctccagtagatgctgtttgtatggactaaaatgggaatggagcctcctgaagatatgtagtatggtgggcctatggtactttcaaaggctgcttctacgctccctaagtatctaccagtttgacacactaaaagaaaacaaacactatctctggccagataaagtgtgaataaggccactagctagatttgatcagattctcctgctctgttccctcctttgaagatacctcagcaatcaccctatccactccttccatgcaactgatgagagagacccacaatagcaaggccaagtcaccggtatcatgaggcactgatggcaaaggcaggagaggtgctaaaaaacccgaggttcttctccaaacattaaccataccaccatgagttcttatctgttcatcagtgtgtccatcctgaagcagataaaaattgtcctgcatttattagatcttaaataaaaactaagcctcatcccatggcgaaggtcaaaaactagtagccggaaggccagatttggtgtgcaaatatctgtactttggcctggagtgtttttaaaatctggacttaaggggtcagcatttaaaaaccacacttctggcttcactagaaaaaaaatcacagcatccagccacactgaatgtgcttcccataaggtattggtgcactggaactgcctttaggtagggaatgcattttccagttaataccatcccttctaaccagggatatttttcagccccaactcactttaccactcacatttctcctgcctgcctccttctatgcatttgaattaacgtaatctcattcataagggctcttaagttggcccaaatgtcagaaattacaatgatgcagaagtgagctcaccataaagaatagtttccttagagtaagccgctctggaagtgatttgtaccctagaggtgtacaagcttcttctgcagaaactctctttaacaggaagtttgcagaagggattttaagtcccagatggtgagtggagaggaactagctacatgcctgaatttctcagagcctgtgatcttggacagctttcccaactcccaccatcttcccatgttgcctcatttgttgtgcacaaagcatctggttctcgaattctctggccagcctccttaggcaaattatcaggaaaccatatctgtgagcaccagactcagcaggcatactactagcaacttccctgagctccagagtacactaccagatttcccctgctccagctctaagcagctccagatgcagttgggcatgcatttcctgccacctgctggttccaataagaatagcaagccttttaccagtcattcctagggaatttttctcccagacacaatatgaaattgataatcctctagctagatggggccttcaatccaaacctctactcctcctactcccatgtttaacagatgagaaaggcaaagaataattcacccaaagcagcataaaaagttaatttggtgcttccccctacgtaactaggtcccagtttaaaataaaaaataaaaataaaaatagaacaacaccccagctccagcaaggggagattttcattgaaatgcaatagagtcagacttagacccccttctaagtactaggtccagcaatttggctggctctccccaactcctctccttggccctggcattgaatcttctactgttgccctattcatagacaagtacttactgagcacctgtttgccaggcactgtaggtggcacatcctcttcctcctcacttttgcaatgaagatgttggacaagattcattcattttccaaggatttcttcagcatttaccatatgtctcaaacccttctggtgctaaaaatacaactccatttaaacaaacaacaacaacaaaaaaggacactaaagctggtgaagatatacaagtaaacatttgttcaacaaacatataccaagttttgagcttatgaaccagggactatgttcatatgttcagtgttgagagtgcagtgaacatgacagactttgcacggagcttataatctagtaagagacagacgctaatcaagaaattaccatacaatgtgataagagctttaaaaaaagacggagatatatacagagagcttatggagcacacagcaggagcggctagcctatacttgggagctcagagaaggcttctaaggaagaattaggtgaaagaggagttggagacaagagatggggttcagagtgtgttctaggcagggagaacaacttgcacaaaggcccagagttcaagaaaagaaccatgacattttcaaatataaggaaatatttcagtgactaaagcatagaacaccagatagaaatggcacaagatgagactgcaaaagcaggcagggtccaggttctaaggccttgtttatcatgttcaggattttaattaacctgaagtcagtggcagcctattaaaaggttctaagcaaaagatgaccaagatctgtgttataacgactcagatgggttgggtggtgggggcagattggaggctgttgcaatggtgggctggacacagtggctcacacctgtaatcccagaactttgtgaagccgaggcaggaggatctcgaggccaggagttcaagaccagactgggcaacatagcgagacccccatctctacaaacaagataaaacaaaacaaacaaatcagaaggtggcctaccctacaggagagatggagaggcaccagtgaatcctatactgagtttttctctgttggcccggtcctgcacaggaacaagcagaagacggtgttcttttcctgaaagcattatctagttgggcaatgtgagctgataaaacttcccaatgccaacattgaatcaacagctgagaccaaaacattagactctcaattcctcctcagagctcacatgcaacgataacaaagctggacatgaggagagcagacaatagtgcctccatgattcagaccagggcaagaccaccatgacctgggaaagagatgaactagaaggatcagggcagcaggcattttggtagtgagcataaggaagggacgtgagaaggcacaagagaaaatgtacaaacctggagggctgcaaagtatctggtgggggagaaggaaagcctggaaaggtaagttggagccaaatgatgaagggtcttgaatgaaaacttagtaaaaatccagaggtctgtctgaagttacaactgccagggatgtgggaacgtagaggcaggaagaagctgtggcttcccctggcttgtagaacggaagtgaggcccagagctcctgctccatcctggcccatagccatcccccttaccacccactcctgggagttattaactggggaatgggatggggaagagggcaaggaagcaacagaggcaaagcaggggatctgtccaaattgtcctctgaatttctaactaaaacccagtacaaccttgaatatgttctcaattataacctctgatggtcaaaagaaacttgtggagtagtggggagaatcttatcccccaggtagaagaaaaaatgaaataaaaatccccgagactcacagaaggaaattacttgcctatggtcatacaaccagcaattgatagagctgggacttgaacacaggtctccagactctaaaccacattcctatcccctgttttgcatctgtttcagcaggcaagtggcgcccctctataaggcagaactccccagccagccaaaaagcctccagaaacctagagtgatgcagtctggaaagcagggagaaccagataggcatggcctggcccccaagggagtgccttgcagggagggtgcctagcccctgtcttattttaagtagagccccatgttgaatctattccaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaatagcacaggaatctgagagactaaggaagagaaggggaacggagggagggggcacacttacacaactctctctgcaatatgtgcaatagcaaaatgcagtgatgcatgaattttacaatgtggcactatttaacctcagatgggctgtgggcggggggtcaggagggacttttctaatacagcaactgagggctgggaggaaaggagggggtaagggcagggggtgggggattggggaaataatagctttcaaaaatctgtccatgggctgtgcagttttcctgtttggaaggagagcgcagtctgccccagagcagaaagaaagtaatgtaatatatgatatatattcatgcttaatattaatgcaaaaccccaaaaacaaaagatttgtttcttaacctatcagcctagtaactgcttaaatttttaaagtcacggaagtaacggacaatttttcccagagtggaaacagtcacaaataagcttgctctggtgtatgtcccatatcatacccctccaaacgccatacctgtcttcaaactgacccaggcggacacatgccaaaaagccattttgcctctgcttcaagagggctgtgtggtatgggaatgggtagtggaaatggggacaggtagagagacgagaagggagtgactaaagagacggacatttcagaggccaaggattgagaatgtaggtaaccccagctcaaccctcacatctcaaggctgaggaccacaattgcccctctctgagccctcttgcttctgtgcttcaacaacgccccactcacccttcaccagcacccagaaatggccaatgtggttttctcattatattgccaatatgcaatcttttttatggttaaaaaaagtaataatcttgaaagataatatgcagatagactgagtgtaaacaggtacttttttcaaatgactatttttttggagagtctctttggaactgcaactgagtgcatgtttgggaaggtggggtcagtggtgtgaaatatatttattatctagtggttctacagagtaaagttttaagaggtgaaagggcagtgttgagtctactgccgattaggtataaatgggtggagagagatggtaatgtggtaatgtttagaaaatgtttgttatattttgacatatcatatatcataatgtgcaaagtttggggggctgaccccgttatatttttgtaagtctgttttttttccttttaggtgctttaacatttaggaaagttagacaagtatttctctttccttttaattctgaagtgccagaattgtcctgggacaggtagggcactccagaaaaaaagaaggaccagcagacgaatttagtttgggggtggggtgggtgggcatggtcctactgacagaaatggatatcacagatgggaggtctgcaaggtggagacagcaggcctctctgtccaatgtcaacagcactatgcctgaaataatggcaccattgtctgaagcattttccctgctttggcccatggccagagtactggggttccatttctttctttgcactttagtgtctgagctttggatcaaaggtgtatgtagaatgttgagatagctgacaatcagtttgtactgaggcctggggtttcacatgtgtcttttaaaaatctccaacttaaggcaggatggaggaggagtggtaagcagagaagagacactggaagcctaacttttccctaaagcaccttcccatagaggattttctcccattcccacagcacaataactaatacaggcctaaagtagcaggtcatggcaaagatctaaagagatttacataaggaaaatgcactatgcagccaaaaaagggtttggctttgaggcttgaatggtaaaggtgtttacatccaggtccggggaaaataaattattgccttcccttctcttggcctgtgtagaccaaaaagctaaactgtattacagctttggatgatatgagatagaacctggaatctattttattaagaaatcttgggaga

SEQ ID NO: 11770 - DNA, 49487 bp, Human
  misc_feature (1)...(49487): n = A,T,C or G
gtgttagccaggatggtctcgatctcccgacctcgtgatccgcccgcctgggcctcccaaagtgctgggattacaggcgtgagccaccgcacccggcccaaacaatgtttattaattgctctgtcatgctacttctcatgcaaaggaaatccatcatctcaatcattcattttgcagatgaggaaaataaagcccatttagtttaaggcatttgtccaaagtaacacagctagtgactagaaccacgtgccctggctaccacttccgagtgacatcagctgccgatccataagaaataccttcaaaccaatgcaggggtaagataaaaattacacgttacttttcaaaagtgttgtgaaaataggggaaaaaaaccaccaaacctgtaaggaaacataaccgaaggctaaccgtaggtaagcatatgagtagtaagacaatgggtgattcgtttttttttcatctctttcctcaatccttacagcatttcaatgttctataatgtgcttatgttataattggcaaatacatgctacagttttgtggagactaaaaacagctgttgaaaaaagggagcagaaaaatattcaatcattaaaaaaatccccttacagtaagggatttcagctacttgtctaaaaaaagcatactacttcagcggttccggaagagggaagagaggtaattcatattacaaattaaattaaaagttaaaatttctagttaagtaacttattaagcacaacatgcaataaaacgttgtccacttttgactttacagatttgggatggaaagaaaatgcaacgtttcctacaaccacccactttaaccctttcactgccagtttgaaaaggaaaaacactagctaatacaggctgactgggaatcatcagattacaaatcgttctcagaacgatctaacattttattgcttaaggtagaggtattagcgtatttttaaagtgtgtcttccagtaagttgcagaacttcccgctgaaattcaaaatactatacgttcacactgacattactgaaactgcaagagttgagctccctacttgattggggtagtaagcacaaaaatggttttgagggaacggagcagggaggggcagtgatctgcaaggctgattaatcccatacaagacagcgcttgttgcggggtaaggtgctgtttttaagacagctcttgttgcggggcaaggtgctgtggagccacaaagatgcgacagaatggatcccgattctcctggaactccggatcaagaaaatatgaggggcgtgagcccagaagtgcgacgcaagagacccgcggaaaggtgacagaacgagtggcaccagactcagaaagttggggagttaggaagcctgaaatcgccgcaggagtcgtgagaggggaagtgacagtctcttcagaaggtcacgggaaaccgggtcccagggcagtatccccacagagggctgcgtctccgggctggggcaggcggcagcgaaagggagacgcggctccggggccaccccagtcccggcaggagttctgcccggaggtctgggatgccctcggccaggcctcacctcgggagcggaggatcctgaaggcagaaaagcggctgaggatgccaatcgcccggcaggccaccatcttgagctgaagaggacagcagtggagagcgcctctaacgggtgcggccgagcggaggacttttctcccgtagcctggcagccaggcgcctggagcactgcctgactaaaacccagatgccgagtggccgccggccccttagccctgcccctcgctcctggctaacatggccgaaaggtcgtattctccgggggaggacgggggcccggagaggagggggtggagtgcctggttttccagtcaggcggccggagggcagccctcaagaacggccctgaccgcccgcggggtgaggggccctttctgggcaggacccgccccttggtcccgcagagccttggtacttggacctgaaccttgctccgagagggagtcctcgcggacgtcagccaaggtgagacggcgagccctcagctctccgcccgggctttcccaaaggcgagattccacttccttccccgcaactgtcgccggtgcccccggccccctcccctccctgggaaagtgggagttgagggagcggaaggaaactcctcggacaaggtcggcagtgctagctgcagttaggacagtgacttggactagcgttccagctgaagttcgggacagtagtgtcacctgcgccctaatttatcatcacaagttaacgaagtctgggggtgtgggggtgtgtgtgtgtgtgtgggtgtgtgtgggcgtgtgtgggcgtcggccttaatgtaaccctggtctgcgtagaagtgtgtgttgtttcgcctgcttcccctgtacccaggtcggcggctatagagattgtggacggcgccatgggtttgcccgatttctgctgtaaagaataagactaggtcaggtgacctttcggggcttgagtgtgggaggaacggagacaatcctccatccggctccgttatccagataatcctgcgctctcgggggttttccgatctggatgattatctatctggtcgttcacacctcagctcacttaagcggtgaagaaactgcctacgaatcagagagagtgattttacccatggccatatgtagtagaaataagactggagcctaagtctactaactcctagtgaagagttcttcattgcatggtagctgtttttgtgctggaatgatgggctggagtcctggaataaagtgattgatttcaaaaggaagtcacattgagagcctgctgtgctctggtcaccttcatacctttttgtttagtcctcacattccccaaattattatcatttgcattttctagatgaagtttgggaagctcagaatatatacattttctagtctgtgacagacctagcattcagacataagtctgagtctcactactcgccagactgacagctctgcaggacaggaaacaaggggcatcgaagttaagactgaaatgagtatagagacagagtagagaggtttctgtttaaagctcaagttgcatagtgagtgctcatcatgtgagcactttaagcagaaactggatgacctgaccacttctgaataaattgcaaaaaggattcttgataatcttacaaggtttttacagttcagagcctgcctcctgcccatgtaatgctttcttcaacacctaactgcgtgtaacacttattatttaggtcagaagtggtaaattttgttgttgttgttaaaggtccagacagtaaatagttcaggatttgcaggatcactttggtctctgttatatattgtttcttttgttttgttttgtttacaacttttttttttttttgagacagttttgctcttgttgtccaggctggagtgcagtggcgcgatcttggctcactgcagcctcctcccgggttcaagtgattctcctgcctcaggctcccgagtagctgggattacaagcgcacaccaccacgccgggctaattttttgtatttttagtagagacggggtttcaccatgttagccagcctggtcccgaactcctgaccttaggtgattcgcccagctctgccccccaaagtgctgggattacaagtgtgagccaccacgcccgaccttacaactctttaaaaatgtgaaaaactatttttagctagaggcccgtgtgttgtagtttgccaatccctgatttagatcactcatttggctccatttttttgctccctgtgctttctctacaaaactaagctccatcagggcagaaatgttataatgtttctttgatccctaagcactttagtccaatggtttatatagagggaaacagtacatttgtatcaccatctctactggtaatagcaaacacaggtatacccctaactgtgtatcaagcactattttaagtggtgtgtgcacgtgggtgtgcgtgcgtgtgtgtgtgtgcgcgtgcgcgtcctatgtggttaagtaactggcttaaagtcatacagctagggtgaatcaggatttggacatagtctggctttagttctcttaaccattacgttgtgtttcaaagttgtaataatgagctgttagagccaccccatcttgcttttgttttcattacttgcctagactcttcttcctttcccttgctcccaggtgcctgcagcttcgtgtatctttccatagttcacaccttactcaggcttaccctaaccaactcgatcctaccctaccctaccctggagtttccatgctttgaatatttttaccaaaatttctgttttctgaagtttagcaaatgacagaaaggtcagctctgctataggataatttgcttagtccctcttacttttgaaatctctattttttattaactattgaaggaatacatattccatgtaattttttattcagaaactacagaaaagtctaaagaaaatctgtaattccaccacccggagataactacttttaacattttgatgtgtatttttctggactttttaaaatgcatttgtatatttgtatatatttatataagatattgatgtacagtcggcccttggtatctgtgagttctacatcctcagattcaaccaatgtctgagtgaaaatgtagttaggcctacagtggtttcatttgtcctgaacatgtacagactttttttctcatcattattccctaaacgatacagcataacgactatttacatagatttacattgcattcggtattgtaagtagtctagagatgatttagagtatgcatgaggatgtgtgtaggttctttgcaaataaatactatgccattttatgtaaaggacttgagcatccttgaggtttggtatctgaggggggttctggaaccaatcccccttggatactgaggaacaacagtatatatagattttaaataaaactagaattatgcataagtaaaatgcttattttaaaaaaattaaagagaacagaagaatattaaataaaagcctttctttatccttccatgtctagactcatagcttcagggactttcttttctctttctctctttctgtcacaaaatggttgttgtagtagggtttacttacccatttccctattttccagttattctaatctattattctaatttctaatacacattgttctgtagcttgctttttcatttaatatatattatggacatttttccatgtcagtatatatacatgtacatcattttgtttcattttcttttccaaactgccaaacagtattccatggtgtgtttatactataacttacttaactgtttcctactgatgtgcatttagattagttacggttttccacaaatataaacagtgctatagtgaacaccttgagtatttctttttttttttttgagacggagtctcgttctgtctcctaggctggagttcagtggcgtaagccaccacccctggcccaccttgagtattttacgctagagacctatatatgctatacatacattttgaatatttctataggttagagaccaataaaaggcattattggactcaaaaattcacattttaaattctgatctataactacaaaattgtcatcccaaaaggccttagcattttacatgtcttctagtgtatggaagtgactatttagttagatgcattcttactagaattatatattaaccatattttcaatgtttgccaatctgaaaaccacaaaatgataccttgctttgatttaaaaaacaacaacaacaacaacaaaaaggctggacgcagtggctcatgcctgtaatcccagcactttgggaggcagaggcgggcggatcacctgaggtcaggagttcaagaccagcctggccaacatggtgaaaccccatctctgctaaaaatacaaaaattagacaggcgtggtggcacgtgcctggagtctcagctactcgggaggctgaggcaggagaatcgcttgaacccaggaggtggaggttgcagtgagccgagatcgcgccattgcactccaacctgggggacaagagtgagactttgtctcaaaaaaaaaaagaaaatcacaactttttgttagtgaggttgaacattatacattttgtttatttggcattttaatttcttctgtgaatggcttgttttctcattcttgcttttggtcatgtatcaggaaggagtctttcagttgcaaataacagaaaattcaaatcaaattggcttcttaaaggggatttattagtccgggcgtggtggctcacgcctgtaatcctagcactttgggaggctcaggagttcgagaccagcctgatcaacacggtgaaatcctgtctctactaaaataaaaaaaattagcctggtatggtggtgtgcgcctgtagtcccagttactcgggaggctgaggcaggagaattgcttgaacccaggaggcagaggttgcagtgagccaagatcgcgccgctgtactccagcctgggcgacagagtgagactccgtctcaaaaaaataaataaataaataaaggagatttattggctcacagaactgaaaagcacaatgagaggttgggttcagatgggattcggcaggactcttctttttccagaattctcagctccgtactcttctgcttgtttggtgttagctctatcttagcctagctttgttaatgtttgcaaattgctgtagccatgccaggcctcagaaggaaagatttgtgttccagaattataggcagaagacttgagtgttaaactgatgaaaccatccacaaatcaataccagtggtcaaggcaatgccgtgcatggttgtttgaggccttggtacctgaatcaatgatcttggcagagagaatgagattattctgattggtttaaaccctggagttgggctggattcaatcccatgtaagccacatacagcagctacatttgggtggaatggatattagagtacaaactacagattccatgatagattgtttctgtttttctttttctttctttttttggagatggagtctcgctctgtcgcccaggctggagtgcaatagtatgatcttggctcactgcaacctccgcctcccgggttcaagcgattttcctgcctcagttcccaagtagctggcttacaggcatgtgccaccaggcctggctaattttgtatttttattagagatgggctttctctatgttggtcaggctggtcttgaactcccaacctcaggtgatccacctgcctgggcgtcccaaaatgctgggattataggcatgagccactgcgcctggccttatttttcttataatttgtacaagttctttatggattatgggtatcaacccttttctgttttacatgttacaaatattttctctgaatctatttgccttttaacttgattttagtatattttactatgtgtatattttgaatgtttatatgatcagatctattagttattattttctgttgtacttctgggttttgtgccatatgttgaaatcccttctccatctaagtgataaaaatattctctgaggctggatatggtggctcatgcttgtaatcccagcatgttgggaggccgaggtaggaggattacttgaggctaggagtttgagactagcctgtctctaaagtttttttttttttttttaattagccaggcatggtggcatgtgcctgtagtctaagctactcaggaggctgaagcaggaggatcccttgagcccaggagttccagattgcagtgacctatgatcataccactgcactacagcttgggcaacagagcgagaccctgtctctaaaaaatacatacacgtgtgtgtatgtatatattatattctccgatgttttcctctagtacttttatagttagaatatatatatttaaaatatatacatttaaatatttaatctgtctggcatttatttgtgctttcgctgtgagctgcgaacctaaaattttttccaaatgtttagccattttcccagtgaattcatggaataatttctttctctcagctaactcaagtgttatatttattatacactaaattcttacatacatgggtctgcttctgaactgctacatcctgttttgttgatcagtgtcgtttattcctgtgctaaagctgctctgttttaattattggttctttctagaaagtgttttgtttgtttttttttgagacaggatcttactctgttgcccaggcttgagtacagtagcgtgatcatggctcactgcagcctcgaactcctggctcgggtgctcctcccacctcagcctcttgagtagctgcgactacaggcacatgccaccatgcccagctagttttttgtattttttgtaaagacagggtctcactaggttgcccaggctggtctcaaactcctgggctcaagtgatcctcccacctcggcctcccaaagtgctgggattacaggtgtgagcctctgtgcctggcctagaaagttttgttatctgttgcaacaaggttcccccttttgtttttcaacattttcttgacaattttcatgaattttatttcaagatgaaccttacgtaagggaacttgtagcccagacccttgtggcattgtaagtagcttctgagtggtgcctctctcatgggcctctttgtgtttctctggccagagtcctttgaatatccctaggctggtgatcctaaagcttgggcttctccatctctttccaatccacatgtttggaacatgttttgtttttttcttttcggaagctataggacctccttcttttagtctctaaagacccaagagaagttaaaccttaaagcttttgtattatctatttctgtgtagccaattaccgccaaatgtagcagtttaaaacaatacatgtttaccatctcatagtttctgaaggtcaggaatcaagggcactttagctgggttgctctgagtttcccataaggtggctgtcagaatgttggcagggctggagtcagctgaaagcttgcctgcgctagaggctccgcttccaagctcactcacatggctgttggcaagaggcatcagttcctcaccacaggagcctcttcataaggctgctcaggacatgccacctggcttctctcatagtgggtgagctgagagagagaccacgacagatgctgcagtatctcttatagcctatctcagaagtggcataccattacttgtaacatactttttggtttatacattctgtgatatggagagggaggcagctagacaaggatgtgaataccaagaggtagagattattggggggcaacttggaggctggctaccaaagtctttgttggtaaatcttgtgggatttttttggttttgattttttgttgttgttgttaaaacatgcttcaaaattaagaaattataaaaggtgtgtgatgacaagtcttccacccctgacccctagttacccagttccctttcttccagccaacaattatttttaacatctttattatacttccagggggattttatactgatacaaggaaatgtacataatatttttcctcttttaacatgaatgatagcatgctgtacagctattttgcaccttgctttcttcacttaatgatacagcttaaaatggttccgaattggtgcataatcatttccttaccttttacagctgcatagtatttcacaggggtgttgtagcatggtttacttacccattttcctattttttggttattctaatttttgactattacagtaacaatatggattatgtcctgtgtgtgagtaatatccatgaagtcagttcatggaagtggaattgctggttcaaacattagtttcagttatagttttcatggataattaccaaattgccctccccatggactgtgccagttctcttggcagcagtatatgagaatatctatttgcacatactcttacctacacagagtatatatcaaacctttgaatctttgctactttgagagacaattatatctgtggttttaatttgaattcttcttatgagtgaaattgaacatcttttcatatacttaagaaccatttgtatttccttttctgtggtctgttcatattctgtgcctatttgtctgctagtgttttccttagtaatctgtaggaactcattgttagaaatttagtcttttttggaggggtgggggaaagttgttaatatattttacatattttttaacatatagggttattatatgttttacttttttattgttttgaaacaatacagtatcaaactttgaaaaagttgcaagtgcagtactacaaactttttttagtagcagttgagattaagttgctgacatgatgcttcaccatccctatttagtgtatattcccttcagatacaaacattccacaaagccttctacataatcatagtacagccttcagaatcgtgaaactaatactaatggttttattatcacgcctagcagtctctctgcttctttgaccctaaaggagaggagcacacactctagaggtagacttcctaggttcaaattccagctctgggcctggtgcggtagctcacgcctgtaatcccagcactttgggaggccaaggcgatggatcacctgaggtcaggagttcgacaccagcctggccaacatggcaaaaccccatgtctactaaaaatacaaaaaattagccgggtgtggtggcacgtgcctgtaatcccagctactcgggaggctgaggcaggagaatcgactgaacctgggaggcaaagattgcagtgaaccgagattgcaccactgtactccagcctgggcaacaagagcaaaactccatctcaaaaaaataaataaataaataaataaataaataaataaataaataaataaaaattccagctctgccactcactagttgtaggtcttttggcaagtcactcaatcctactatgcctcaatttccttatctcttacaaaggatgtaataatcatgcctcctttgtaggtcattgtgaagattagatggttaatgcttagaatagtggttgctgcaatgtgaaaaccatgttggtgttcctatcataataatattattggatgaagaatagttgataagattaagttttaatgttttctagtagccatggatgaggttatcagagttcatagactacaatgtaaactacaaattgttcagctaatccaggatatacttttgttcttctctttttagattccagaatgactactatcttgacttacccctttaaaaatcttcccactgcatcaaaatgggccctcagattttgtaagtttattattatttttttatttttagagattggatttggatttataaacatctcgcacagatactgaatggtattgctttttgtaaacagtttattttgtcttccagccataagacctctgagctgttcctcccagctacgagctgccccaggtacagtaatttgtaaaataaatatttctgatttaaatgttagattccagattctatagtttgtgaactctgaataaaaaccaaaactaatttgctaattctcccctttttatgagcacatgaacatctctgttgccttcaaattaaaaaattataggtccaatcaataatgatactacattatttaggattaggcttgaggatgttaatgggaggctgttttctgggatttgaacctgctggagtcatggaggttccataaacctcgttggtcagtttatttatcctcttgctgtccgtcctggaggtgaatggcatacaaatgctcttgagacctgctatggaaccaaaagttaactttaaatttgcaatttgtgaaatgcttctctattgatgaatatcttcttctcccatgtgcaagagggcccattcctgaaatagaagtgattaggaactagttaataacagaaagttgtttagttaatatgaaatgaaagagtaaggaaatgtgttgattttatatggtcatttacacccttagtaaacccaatgaattaggcttctttactgcagatttttgtagaatctgctgtaggtttttatcttcactggctagtgctaaaaacaccctgacaaattcttaacatttttctccttgcctagattctgtattgacccatgcctttgattttggttttattatggtatttctacctgtataataatagaaaaaataccttccaggctgggtgcgggggctcacgcctgtaatcccagcactttgggaggctgaggcaggtggatggcctgaggtcaggagtttgagaccagcttggtcaacatggcgaaaccccatctctactaaaaatacaaaaattagctgggcatggtggcatacgcctgtagtcccagctacttgggaggctgagacacgagaatctttgaacccaggaggcggagcttgcagtgagccgaggtcacaccactgcactccagcctgggtgacagagcgagactccggctcaaaaaaaaaaaaaaaagaaagaaagaaaaaatcctgggatttggttcccaggattcagaagacctgtactctcttccagctctacctctttctgggcagtgtggccttgaactggtcactttacttccctgtgcttggtttcttcatctaaaaaaggaatatataataagtctagtcttgtcagcctcatatagttatgagatatctcaaagcactttaaaaactataaattcactgtaagtgcaagatggtatttttctattattgcctaatcccaactagagaagtttcatattgtcatataacaaatatatttcctgtggcctttacattctaactagaatataggtttgtagtagccccataaataattcctgtctgtcttgttttgccttttccctaattctaatgttgacccaggtctttgctttgcaaagtcacacaaatagacctgatccttgccaagtgggagaaggtcattctgaataccagcagaggaaaccaagtatctggtgtttaaactattccttatattgctctgtaactgtttctgatgtttgtgtctccccaactgtattgtaagccctgtgagtctttagctttttggtatccccagtgtataacatggtgttccgcaaatataacagtgtcccacaagtaacttgcattaacgctgatgatgatagtggtaccagaaggcacgtgataaaacaatgggaagtggccagctgatttgagggaggaagcaggcatgtgcctgtgctgagcaggttttaggttgcagtaattttttttttgttttaactggcattctggtttgaagattgcagtaattttataactaattcctcttgaagcttgtgtgaatatctcttcttgacagagctgttaggatgaaggaattaaaatagaggggtacagaatttatggatgtttttagtcatctgatggactggaaatgtaagtgtctgatggaaattttgactgatttgatggttatgtctatgtatagatgtctttctctctgtgtatatatatatatatatacacacacacgtgtataatagttgtataatacatgacacatttattatcttctttgattttaattgtttttaaagagtatacaatgtatatcagtcagccattgaattgtaggttttggagttggttagagcctttgaggtcatctagttcagctctaatatttgcaaataagaaaatcgtggcagagtaggcctacaacccagatattttagctctcaattcagattcttataattcattactgctgtgtgcccagagcactgtagaatatataaaatggagctgtattgtcttgagaaaattttgatgtgcttaggagccagtgtgcacatgaagcagaatgagagtccttaggtgactattgaatacataattggccattattagaaaggggtcatatggtagttttctgctgtggcctcaatcagtcctctcgtaaatgtgctagtggctctgttttctctaatgctttttcttatttatttataagtgttgaaagtaatgggttcatgtacctgattgccttgttgatcttgcgtcactgggaaggctaagagctccccttctttttttttttttttctttttttttgagacagagtctcgtgctgtcgcccaggctggagtgcagtggcacagtctcggctcactgcaagctctgcctcccaggttcatgccattctcctgcctcagcctcttgagtagctgggactacaggtgcccgccaacacacctggctaattttttgtacttttagtagagatggggtgtcaccgtgttagccaggatggtctcgatctcctgacctcgtgatctgcccacctcggcctcccaaagtgctgggattacaggcatgagccaccacacccggccaagagctccccttctaatgctgcttgcctaagacagggtcccataactgtagtatatccattgtcttcttcccagtttattgggggagggggctcaggaaaaacctctgtctcctctgtggcacctttacccagtaacggcggggctgagggaggaggaggtggtaaggtaggtgatggttcctcttcgcttctctttttaggctcttctgtgtagagcagggccaaagcagccctaactaaggcccacaacgttaaagatgttactgggacctgttgcccttgtgcatgatgtcatttaagatttcttcccacttgtggctgggcgtgatggctcacacctgtaatcccagcactttgggaggctgaggcaggcggatcacgaggtcaagagatggagaccatcctggcaaacacagtgaaaccctgtctctactaaaaatacaaaaaattagccgggcgtggtggcgggcgcctgtaatcccagctacttgggaggctgaggcagaagcatggtgtgaaccctggaggcagagcttgcagtgagccgagatcgtgccactgtactctagcctggggacagagcaagactctgtctcaaaaaaaaaaagatttcttccaacttgttcccagaactctaggtctagtgtgccttcttctgggaaccgtgggttatggaaaacaacagtttgcattaggtcccttaactgagcctccgaaacggaggctgtgctagcttcaagcagctgtttcaatacttttatgtactgttgctgttgagctgataactcaagtcccattgttacgggtgggcctttgttcttagagctcccaagatggggcaggcggctcccaagatggcggcaagcctttttttctctgacctgaggctcttggcctcatggattccaaggaatggaaccttgggccatgcagtgagtgttatagctctattagaagccatgggtcatggaagagaatcgtggaacccagcgactagcgttgagctcgattaggacgaacctgggcacttggccgcacagaaacaatggcgagcctctagcccaaacaggaatggcactgggtgcctcgctggatcagaaacgcagcggacaccctgccagatccgaggggtggaagtcaacagcgggtctgcgacggtggcgaacagcgggtctgtgacagtggcgaacagcagtggtggaaggtgagcaaaagctcagctcgagccagaacaaacatggaccagaagagtgtgcagttgcaagatttaataaagtgaaaacagagctgctatacaagggtaggggatccaaagggggttgcccctccttgctcaaatgcctggggtttatatcccaatcattgtcgctccccctgtgctctcagatgatagatgatttgagtatttctttacctcctgcttttaacctaattgatattttagtgagccttctttaccacctgattggtcgagtgtgagctgagttacaagccccgtgtttaaaggtgggtgcagtcaccttccccagctaggcttaggaattcttagtcggcctaggaaatccagctagtcctgcctctcaccatgatgaaaccctctcaccatgatgaaaccctagcttgaacatcatgtcccatgatgaaaccctagcttgaaaatcccctcgaacttggaaatcctgagtgggcaccaattacttactgcacggtcacttcactttcattttcaagggttctgtcgtgatccattgcagcatgtctcacacggggcaccacctgccgggtctgtcccacagaccctggctgactgacagatgaaatgagtactcagacacaggtatgcagtgtaagagcagctaggggtctgcctggctctagtggccaaagtgcagcagccctgagaagctggagctccttgcttttattcagtgtaggcacagtgatgaaagcctggagcaaacacaatctgtgggtaattaacgtttatttctccccttccaggaacgtcttgcatggatgatcaaagatcagctcctggtcaacataaataagctagtttaagatacgttcccctacactcccttgtacctactccttgccctctgcctcagggttatagaacagctgccttcagctattctcccccagggctctgcagaaccttctgaccttttagaaggcctgcatctttccctatagtttctcccaccactccgactgatctcctacatataataatgaatattttttaaatgtgccttgtagagttagtttaattactttataatatgctaaattatttggaatggccagtgtgccctagaggttgcccagaggtttagaggcaggaatcatcagtaactgtagttatcagggaaggctttactaggaggtagaatgtgaacgaggcccaagagacaggtaagaattcgatgggcaaaaaaggggccaggcagatgggaggtccataagtaaaggcaaggaggctgacctgagcaaagctgtaaaggactgggggctggctcatcttgttctattttgagaagtagtggaaaatacttaaggtggaaccgagtaaaacaagctatttgttagaagagttaagaatttgaattttatctgaaagtatataaaaggaatatatggtcagttttttctggttttttttttttttttttgaggcagagtcttgctctgtcacccaggctggagtgcagtggcatgatctcagcttacggcaacctccacctcctgtgttcaagccattctcctgcctcagcctccccagtagctgggattataggagcgtaccaccgtgcccagctaatttttgtatttttagtagagacggggtttcaccatgttggccaggctggtcttgaactcctgacctcaaatgatctgcctgcctcagcctcccaaagcggtgagattacagcgtgagccagcacgcctggcttggttagtttttaaaatgtggaatgacatgatggtgtaccattcgacctgtcacctgcaaggtcagtcatgaatagtgtgcaaatcttcaaatttagtgacctgttttctgtctgctcaaataaggattttccttgaggaccgatgcatttaaccatcttgttctccttgacactctcctgcctttgatcttgtgtactgttctctcttgattctcctactacctctcaagttactgtttgtctcacatattccctcagccttctcattgtagggacatcacaaagctaagggttttttggtgtagtaatggaccctcaagttaaggatgagaaggtttgtgtgtactacagctggaaaggtgttaggaaccaagcaagcagctctaggggccagctactttgtctcacacaccacatggtatgtccctttcctggtctttctgcttctatcattcttcattctggctggcttatttgctcacttatggtttacaaactctggcttacgaatgacatcagtttaccatcaacctgttcttcctcatggcatctttttagcttcaactaattggcatttctttccatgcttctttgcctagagagagaatctgaccaacacagttgatcacttgtaggtagatgacactggtttctggttggctcctatatggatggatcattggtgagtccagtacctactctgaatctaatcagcttttatattgacttagggatgtgtctatggcttcccctttggcagggactgtaagcagggcaactccctttagaggggcctgtgggatgtccaaaacaacaacaacacaacaaataccccccccccatccagacaaacaaaaaaagtatcttttattgttaaagaggaaataggaaatttaaaaataaaagaaatagagggggctgtgggagaacaggcattgcagaatacatctctgctttccttctgtattctaagcttcaatatttcatgactttctaatctacactcatttctcttcagaggttttgctttgcatcttctagctaactgtggaattaacatatccacctggttgtctctctgtcacctcaaagttagcgagtttaaaaatgaggccaggcgcagtgccttatgccggtaatcccaacactttgggaagccaaggctggcggatcacttgaggtcaggagttcaagaccagcctggcaaacaaggtaaaaccccatctttactaaaaatataaaaactagccaggtgtggtgtcgtgtgcctgtaatcccaactgcttgggaggctgaggcaggagaattgcttgaacctgggaagtggaggttgcagttagccgagatcgtgccacagcactccagccttggcgacagagcaaggcatcatctcaaaaaaaaaaaaattaagtccccttttttttccaaaaccagttctcactttgtttcgggtagctaggtattcttagtctctaagattcctttataatcctgttttcctctttcctttctttctatatctgattggttgccaacataccttgttttcttttataaacttcctctttactcatgttgatactgcctttatcctggccttttgtgccacatgcttgggtttgccacagtctctttgcttacctccttgttgcctttatctccttcaccagcagcacttctccatgaatgctgccagcgtcatctttatgccctattttatcatgactattaactctcactaatatttctttaaagttggttgtagatgtttactataaatacttctctgtgacattaacaggtgtggtaaggtcgttgttgacattgtattcccaataatttaggatttttttctatctttgataaggaataatgatagagtaggtaaattccaacattaacaaaaacaagaaaataatgaactagattttgatatactaacatggaatgttcttcgagctatattgttaagccaataaaatatacataatatacaagtatatgcatgtaagtgcactaaaagaaacgatttgaaagtatatacaccaaataaacagactttacctcttagaagaaaatagtgtggtaggcgaaggcataaagagggaactttagtttttactctccatagttcagtattatttactttttaaaaaaaaccataggcacacatttatattttattctttaatttaagaaacctaaaggaagtttgcttttttgagattaaaaagtatttaggcatgtagatttttgcagaatagcaagtcaccaaccaagtgccccttatttccacgtagaaaaggtaagaacatcaagctatgtgaagagtgaacaatatcaatcattgcaacttctaatattaagggtagatttgcgtgtaaatttggttacttctaatgaaataggttgtcaaacacttagtaaaaatgaactattttgttaatggcataaattccctcatcattggatataagctttgtttatcttaaatattatttagaaacttacaaatgctagtcaatttcttagcctttttttaaaaaaaaattaaagtggtttagtaaatggcaaatgcaagttggcattaatgatgtaataattcttagaatgactatcttaaaaaatgtaaaagtaggccaggcacggtagctcacatctgtaatcccagcagtttgggaggctgaggcgggcagatcacctgaggtcaggagtttgagaccagtctggccaacatggtgaaaccccatctctacaaaaatacaaaaattagctgggcatgatggcaggtgcctgtaatcccagctactcaggaggttgaggcaggagaattgcttgaatccgggaggcagaggttgcagtgagccgagatcacgccattgcactccagcctgggtgacagagcgagactccatcttaaaaaaaaaaaaaaaaagtaaaagtcatcagactttatatattttaattagtagtttttgtttttaaactttatcttaaagctgtccagaccaaaacgaagaagacgttagccaaacccaatataaggaatgttgtggtggtggatggtgttcgcactccatttttgctgtctggcacttcgtaagtatgacatgatcatattatttttttccttcttttaagacactttcaaaagtagtctttgtaaatgtaacccagtaggtaataatattgttagtggactaatatttggatagcagtcccatgaaattaatatagaataagtcaagacagtggtgaaataatatggcaacatttgttttttatccttctcatgaataagtctagcgtagttttacttgaaacagctctattttgaaaacctagaggtccagatagcttgcttccaacagagctgtcctttccttttctggagacaagtacattgtccctgtttctcctcagaagtttgagtgctgaagatgtgggccatgggcattctgaagggcctatataatccactggtttggcctcctggaaattattaaaattggagttgatagggctggtccaaacccccagcatagcacaaccccaagtgtgtgggaccagaatggtcctagaccagctccagaattccctagatccaaattgctcttctccttggccttttgtgcttcttttctgtccccgagtgaaggttagtctatccaaaagctgataatggactttgataacaaggtttaaactgttcattctattctgtttagattgttttaatgtttatattttgaataggtagttgccagctttaaaaaaatgctgcggaatgttaggcatctgttaaaaagaatgagacctatctttatatactaatatggaagacctaagatcttgaagatatgttaagtataaaaagcaaggttcaggctgggtgcagtggctcacacctgtaatcccagcactttgggaggccaaggcaagaggattacttgagcccaggagttcaagaccagcctgggtaacatagcaagaccttgtctctgcagaaaataaaaaatattagctgggcatggtggtacatacctgtagtcccagctactcaggaggctgaggtgggaggatcacttgagcctgggaggtcaaggctgcagtgagccgtgatcatgctactacctatactccagcctgggtgacagagcaagactccatctcaaaaaaaaaaaaaaaaaaaagcaaggtgcacagtattgtgtatagtgtgcaatgacttatgaaagatacacatgtgtgtgtgtgtatgtgtgtatacacacacaacaaaggttcatttttaaacagatggtttgggacctacaaatatattttcttacagaagtaatgctatatgttggccaggcacgtggctcatgcctgtaatcccagcactttggaaggctaaggtgggtggatcacttgaggccaggagttcatggcaaaaccctgtctctactaaatacaaaaattagctgggtgtagtggtatgcacctctagtcccagctactcgagacactaaggcatgagaatctcatgaacccaagaggtggaggttgcagtgagccaagatcatgccactgtactccagcctgggcaacacagcgagaccctgtttcaaaaaaaaaaaaaaagaagaagaagtaatgctataagtaaatggtagtgacgtttctttattcatcctattttatcaatatagtaatccacttaacgatgtttctataatctctttcctgtactgacacaacagtaaaagtaagaatcagaaggctttagcagcaggaagaagatgatgtcctccttttactcagcagcaataaaatagaaaaagttccatcaagacatgaaagttcttggctaggaagactttttttgtaaggatcattatatattatgtaggtgtttgatactgttttactagctgttaaaaaatacaaacaggccaggttcagtggctcacacctgtaatcccaacactttgggaggccaaggcaggtggatcacctgaggttaggagtttgagaccagcccggccaatatggcaaaaccccatctctactaaaaatacaaaaattagctaggtgtggtggtgcatgcctgtagtcccagctacttgggaggctgaggcaggagaatcacttgaacctgggaggtggaggttgtgatgagctgagattgtgccactgtactccagcctgggtgacagagcaaaactccatctcaaaacaacaacaacaacaacaacaacaaaacacccaaacatactcaactgtttcatttacttttattaaacatttgatgattagtatttgcatgaagtttaatttgaggtatttaccaaattggcatagggttgttcctttctttgttgtgtattgtgttttagtttaattcaggattctggttcatgagcaatctagtggtacagagaagagaaaaacattgagtaatgtaagaaatgatagtgaatagggaagaaagaatcaaaagtattttaaggcaatattcatgtaaagaacaaaagtcactaaaaaataacattagaggccaggtgcagtggctcacacctataattccagcgctttgggaggcggaggcgggaggatcattcaaggccaggagtttgagactggcttgagcaacatatgagcaacataactagacacctatccccaacgcctcctcaccccctacctcccagtcctatctctacaaaaaaaagaaaaaaaaaaaggtgttttaattagccaggcatggtggtgcatgcccctagtcctagctacttgggaggctggggcgggaggattgcttaagcctaggagtttgaggctgcagtgggctatgaacgtatatgagctatgctattgcacttcaacctgggtgacagagccagaccttgtctcttaaaaaaaaattaataataataacatagagggaaaatgtataaggacaacaatttttacattattgatgttaggattgaagtaccaaatgagtcttctgtaatagaagatcattttctaagtggaaaaagtctttttctgtttaatttgcagaaacgttgctttcaacttgagtgttatttggaaggccaggttcttatgggtaggggcatttgggaagcactcccgggaatagactctagcagtggaattcagaagtctgtcaatcattcaggtagaggagtgtgagagtatgagaataaagattgtaaatgataagttggctgggcgcagtggctcacgtctgtaatcccagcactttgggaggctgaggcgggcggatcacctgaggtcaggtgtttgagaccagcctggccaacatggcgagaccctatctctactaaaaatacaaaaattagccaggcatggtggcgtgcacctgtaatcccagctacttgggaggctgaggtgggagactatcttgagcccaggaagcacgttgcaccactgcactccagccctccagccttggtgatggagtgagacactctctctcaaaaaaaaaaaaaaaaaaaaaaaggattgtaaatgataaataatttatggcttaggcattttcaaattgacacatgacttttccccaaataattctgtcctaaatttgaggaaactggatttacctatgaaaaatttggaaaactactcatggttctcctgtgattctgagtgaaaatgacagtaaaaatattttggagtttttaagttttaattttcagggacttgaagaatgaatcttcttatttaatccaatgattaaatctctgacttaaaaataaagagaatttatttttgatctttaaacaaacaaacaaataaatagagttcatacccagatcttggtttctaaatagcagtcttcaatacaaagaaccagagctcctttgaagaatgattagggctgagccagagaaaagacaggatgagcaaggagaacttgtagtgccggaaagcaaagaagtacttaaaaaaaagaggggttcagggggtcatgtcaaaaagacacaggtctgacctgcaggagctaccggtcaccaaaactgcaatgatttgagcaataaaataaattgcaatagtattggaacataacccaaagaataaaacaaatgcctacgagtctaatctgatataaataagtgaataaataaatacacattgggaggccaaggtgaatggatcgcttgaggtcaggagttcgagaccagcctggccaacatggtgaaaccccttctctactaaaaatacaaaaattagctggatttggtggcaggcgcctataatcccagctactcaggaggctgaggcaggagaatcgattgaacccgggaggcagaggttgcggtgagccgacatcgtgccactgcactccagcctgggcaacagagtgagactctgtctcaaaaaaaaaaaaaaaaaagagtaaataaatgagaaagaatgaacaagtcttccttacagaagaattttgattaataaatataggaggactgtgtacagtggttcacacatgtaatcccagcactttgggaggctgaggtaggaggattgcttgaggccaggagttcgagaccggcatggacaaagtgagactccatctctgcaaaaactaaaaatgaaaaattagctgggtgtggtagcagacaccggtagtcctacctacaagggaggccgaagtgggaagattgcttgagcccatgagtttgaggctgcagtgacctgtgattgcaccactgcattccagtctgagtgacagagtgagaccctatctcaaaaaataaaaataaataaagaatgagaaaaataaccattagaataccacataatacttgctgcgagatctacaaatgaatgctaaaattaggtgaaatgctaagaagaaacagaatatttgcatagtctcagagaatctcccccaaaatatttatcaattactatgatgatttcgacatacgtccgcaaagtctgtgttattcctgccactggaaggtggaacttaattctcccctcagaatgtgggctagacttagtgactcacttctaacaaattgagataagaaaggaaaaaatagtaactttatagtggagtaaactggcagacatcacttgacccaaatcatcactttaacatcactggtagtaagtcatgttgatatcatgtgccccctgatacgaagctaagagaaatacagtttacctctgtgatattcttcccctaaatccataaccccagtcttcaaaagtgtcaaggtcatgaaagacaaggaagactgagaaactgtcacaaattggaggagactgaggaggcatgacaactaaatgcaacatggtatcttggattgaatcttggaacagaaaaaggacattagtggaacaactggtgagactcagataggtagtagcttagtgaatagtattgtgccaatgttcatttcttagttttaataagtatatcatggttatgtaagatgtcagtattagaaaaagcaggggaaggctgggcgcggtgactcacgtctgtaatcccagcactttgggaggccaaggcgggcaaatcacctgaggtcaggagttcaggaccagcgtggccaacatggtgaaatcccatctctactaaaaatacaaaaaaatcagctgggcgtggtggtgggtgcccgtaatcccagctattcgggaagctgaggcaggagaattgcttgaaccctggaggtggaggttgcagtgagctgagattgcgccattgcacttcagcctgggcaacaagagcgaacctccgtcttaaaaaaaaaaaaaaaacagcagggggaaagaggaactctgctctctttttccaattcttatttatgtatttacacagggtcttgctctgctgcccagactggagtgcagtggtgtgatcctagcagcctcaaattcatggccttaagcagtcttctcacctcagcctcccaagtagctaggactacagatccatgccaccacgcctggctaatttttaatattttttgtaagagacaaggtcttgcttgctctgttacccaggctggtcttgaactcctggcctcaagtagtcatatcacctcagcctcccaaaatgttgggattctaggtgtgagccaccatgctcggcctctttccaattctttggtaaatctcaagttacttaaaagcaaaaagtttcttcaaaagtcctaatacatcacctgtagccctgtaggcattacaaaataaataaataatatacttttaaaataaaatgtttaaaggaaaagagacctcaaaggtggggcttcactttaaagaaaatttagcatatgttatactgaacattaaggtgttggacaacatttttgttcgattcttagcaagctcaggaggagttaaggcttgctagacttttaaggatgacaaatagcgaagtcacactatttcttcatttgaaatgatggactgccttggatagtaaagttaagtgtgtttgtagcagcatgtgtttgatgatctctgggtatttcaaatagaatgaaaatttttcattgaagctctagggttttggtttaaattactggttttcgttccccagatataaagacctgatgccacatgatttggctagagcagcgcttacgtaagtaaatgcagtttcatttccgttcttatttcattaaaggcactttctccagtttttacacataaaatagcaatttgttcttattttagccatctgtactatacaaatttaagcagcttatgaatattgtcaatctttattttgcaggcctaacagtgtcttagcctgacagtatactttaatgctaccttagctagccacaggactcgattgatcagcctaaacacaatacatatatttgatgattgccttaggaacttgtataagggtagctgaacagattatgtagatatttacctagaaagaagcctaaaagacacctgaagattcatgtgcaaaccaagtaaaaatgtaaaattagatgtagttaaataagattaggctggatgaataatttggttgagaatcattaaatgtgttgctgtttcataacatgtaaggcattatctcttcattttccactgacactttgcctttgtgtcttcaaccagccacagttctttcttagtttggagaaacccttcagttgacctttctgtccattctaactctatgtttgttttttttttcttcctgcaatacctcaagcatgagtgaaagagcagttgtttctgtttccttattattagtttcctctgtctaattgtataatcattatttccattttccctttgttttacagaaaccatactttagaatcttctcttaataatggttttatgattgctcaatgtactgatcctttctcagtcctctgtctctgtactttatagcacttgacactgtaagctataatcacctctcttctgttgacttcttagtaatatgcctttatgatttttctttttcttctgtatcctgactgattcttctgtagcttttttttttttttttttgagacggagtctcgctctgtcacccaggctggagtgcagtggcgtgatttcggctcactgcaagctctgcctgccgggttcacgccattctcctgcctcagcctcccgagtacctgggactacaggcgcctgccaccatgcccggctaattttttttttcttttttttttttgtatttttagtagagacggggtttcactgtgttagccaggatggtgtcgatctcctgacctcgtgatccgccctcctcggnnnnnnnnnnnnnnnnnnnnttgattgggccctccattagcatgctcgacggccgccatgtgatggatcactcctgtaatcccagcactttgggaggctgaggtgggcagatcacctgaggtcgggagttcaagaccagcctgaccaacatggagaaaccccatctctactaaaaatacaaaattagctgggcgtagtagcacatgcctgtaatgccactacttggaaggctggggcaggagaatcccttgaacctgggaaggcagaggttgcagtgagccgagatcacgccattgcactccagcctgggcaacaagagcaaaactccgtctcaaaaaataaaaataaaaaaccacacacacacacaactggatctctccctctttctctttttgaaaggtgttttgcaagtttcattccttagagctttgcatttctctgtatgcatattttcctttaaaaatctcatctactagctaggcatggtgtcttacacctataatcccagcactttaggaaaccaaggcaggaggatcaaggtaggaggatcttttgagcccaggagtttgagaccagcctaagcaacatagtaagactccatctctacaaaaaaaaattttaaaaattagccaaccaagagaattcagctcaggagttgaaggttgcagtgagctatgattccactactagactccaggcagggcaatcgagcaagactttgtctcaaaaaaaaaattttttttaaatttttaatttatttttttctgtatggagtctcactctgtccaaggctggagtgcagttgcttgatcatagctcactgcaacctcgaagcctcccaggtaactgggactataggcgtaagccaatgtttctaaccctctttttagtttttttaattgataaaaaactacagattttacagatttttatttatttatttcattgtagccaagtttagtcattactcattttgaagctcagcttattccacattttatctggcactccttcaagttggctcctgtgtgccttttgttttttagtataatgctggttgttgatatataatttgcatgcaataaagtgcacagattttaagtgtatagtttgatgagttttgacaaatgtatataccccgtgttcctgtttttgatatggtcccatttgtcttttttttttttttttgacacagagtttcgctcttgttgcgcaaattggagtgcagtggcacgatctcggctcactgcagcctccgcctcccaggttcaagcaattctcctgcctcagccttccgagtagctggaattacaggcacatgccaccagtcttggctaattttttttgtatttttagtagagacggggttttgctgtgttagccaggctggtctcgaactcctgtcctcaagtgatccgcctgcctcggcctcccaaagtgctaggattacaggcttaaaccactgtgcccggctgatatggtcccatttgtctttgagtgcttccttacttttggcacaaaaaagatggaaattcactttgtactttcttctggacctggtatcagtcatttcttaaaaaaccttttgtccttttaatggggaatggcatttagaaaccaaatctggggccgggtatagtggcttacacctataatcccagcactttgggaggccaaggctggtggatcacttgcagtcaggagtccgagaccagcctggctaacatggtgaaccctgtttctactaaaaatacaaaaataagccaggcatcatggcaggcgcttgtagccccagctactcaggaggctgaggtgagagaaccacttaaacccaggaggtggaggttgcagtgagccgagattgtgccagtacactccatccagcctgggtgaaagggcaagattcttatctcaaaaaaaaaaaaaggaaaccaagtctgggttcagggagtgctcattcctactggagtgttattgtgtctagtttctattcatgggcacaactagaatatatgtattatttcaatcatttgttgatactgatatttcaaactaaaatttaacatacccaggacttctttttttttaattttttttaatagtcttaagggagactttgctttatctctttgattgaatatttgtctctctttttcactgcaaactttggtttctactaacattaattaacattaatttataggtttcttatctattttattctattccaaattattttttattctctaacttctcattaccaattcagcatcaaatgttgacttttaaaatcactctttcattcatttcttctttgagaaggtgccaaatgcttgtcaaattaaagaaaagatacagtctctgtccttttaaattcaaggctaacctttttcaaggagcgcagtgttttgtgtgatgatctctggcactgccttgatgtgtgaaatgtttctttgctttggatttctacttccaggggtttgttgcatcggaccagtgtccctaaggaagtagttgattatatcatctttggtacagttattcaggaagtgaaaacaagcaatgtggctagagaggtgagtaaaacaaactttatgttgtttaaagagtgataggagaatcactttgaatttcaattaatagaagttactttacaaaagcctttaaaatctattgagttacatttgacctaaaatgtgattttacagcttgggtaatgtgttatttaatatgtaaaagaattctaatataaatcaaatgacatacactatattagtgtatatccatactttactgtaaatcaaataaattatttgagctggtttaggacattgtctcttgtgttaggaaaatagagatcagcaaagtgtggctgatagtatttttagtaatgttagatatcatggcttccaattaatttaaaatttcaacatgttgcagagaactaatttcataacttgacttttgttagctggaagtagccttgcttactcatttgttcccatcaactagatggcacgtaaggcagcttggctttttaaaaactatttcacaggagtttacttttgccctagttggcatagctccatgtagtgtcgattgggcaaccaagataatgacaggccttggaacttctaggatgtgtcctacaggcaaatccaaacacgtcttctgggctgtgttttcatttaaaatcgattggatgaagttggcaccaaaagcacatttcattgtactcagtattttccctagttctggtctgtgcttgccatattgttgggttcagtatcactgtcaactgagagacaagggcacatgagcaggactgaaagtatttgttctgttccacctctgtacctggcagaaatgttagaactgccaaaggcctggcatgactgaagcctacgaaactaactgtgtgctgttgaggggcaggaaggaattaacaataggaagagattttatttcccttctgaaattttttgtttttccttgaaccttgacatttctgaatgtttcaaatatgataatttcatgagtacatcaagctgctcataatacattttcaacttttatattctgaaaataacctattacttttataagagcacttaagatgtaaatagtaaatttttttgctgttttctcctcttgctcagctttttatcccatcctttcttccttctcctcctcctcaaaaaataaaaaaataaataaataaaaataaatgtttccattttctctgtaattcagttctttttttcctaaaactaaagccataatgttttcctctgaaatttttcctggaaattttacatccatttgcagatctcagctattgattgacaggaggtagattccctctgcctgccctgtactaataccagttatgttgtgctccaggtaatttttgcagcatctgcagggagagattgggttgagggggatacattatgagaatgtcactctaaagctgtattgcaacctaaaagctaacataatttccagccaaagaatttcttaggccctattgcctgtattaataatgttaatatacagtccttgcaacctaaaagctaacataattttcagccaaagagtttcttaggccctattgcctgtattaataatgttaatatacagtcctaaaaggctcctggtgttcatgaacctgactttgttgaaaggttcagcatatttccctgttctccagcttaaagacatcttcctccttttcccttagtgccctgagagctattcaaatttcaatagaagtgtgtggacaagggtcaccaatagccacctctatttaaagctccttccgtcctgagagtcatctagggccaagggcaacacaaattagaaaggcccttgtgagaatcgagccattgcaacctaagtgccccttttacacttgccctttgcagagctcttccctcctgcccccctgagatacttgcgtctctcttcctttcggattggtttacgttgagaggctgatgcacaggtgcctggcagaagttctcaacaaagcaggttgggcatttagtatcaggcctacctggaaagaccagaatgaggtcatgttgcagttacatcactaacacatttctgtttctatagattatggtaaatagcataaaagtaagtaagtataaaggtaaaaatcagttaagagacattgaatttctaattgagactttggaaacatttattttactaaattataggagagtgtgttctgaggataattaatagtttcagggaaagaatactaaaaatgaattccctataatgggatccagtatttcatagtaaatattgtgtgggtgtgtatgtgggaggaaatctggaagctttatttctaaagtaaaactttaatattataaaaataagtattttataattgcacctgtgcattaattatttacataaacaaaaatggaatcagacgttgattggtttttgacagcataatttcccccaataaatagtataataaaattatagatgtgctcatttcatgtttgactttcactgtgccattataatagaggccatttttaaaagattaataatgacctcagtttttcttaaagccgctcagatgacaaattattctctttgtatcacgtattatgccatcatcctggccacttgttagttggtctgacccttatttgttcacagactcacttgtaactcaggcaattctccagtttctttcattgagttgagcttctgtatagttggcaagttttccagttcatctttgcattgggtctgcagtgtgctatctgaagtatcagacggtcagtaagagaaaccagctggcagtgagcagaaagataggtgtaaagcagacagggtcttgagtgggaactctgtttatgaagggtcagttctttagaaatcattttcatgtttaatcacttttgctttgctgctaagctttgtgactgatcatgagacctgataacacagatagtgaggactccaccccataatatatttcatcatcattccagcaactgtctttaataggttcttttaagtatatttgaacattaaacaagttaaaatcaaattatatattgatattcttgaaggccctgagcaaaacatcgataagaaattaggtgagttaggagagtatcatagcctcgtgtctgcactagaaaccagccagcaggaattttgcatatacctgtcaattaatggcaagattaaatattagtgaaccatttctgtgatggacttcatttgattttaaatattgctctggagaatgttaaactgaaaccgtttccagatgactatgaagattagtgctcaaagcatcatttacatgatgcccttcccttatagtgatcatttcattcactctatttcctaaaggctgcccttggagctggcttctctgacaagactcctgctcacactgtcaccatggcttgtatctctgccaaccaagccatgaccacaggtatgtttaaatggaaacagacagtacatgttaattattctcctttgtcttttacttgattataaaaatgtacttttttttttttttttttttttaacacagaacctcactctgtcactcaggctggagtgcagtggtaccatcatagctcactgcaggctcaaactcttgagctcaagagatcatcctgccttaggatcccaagtagctgggtctacaggtgctccaccacacccagctaatttttaaattttttgtggagacgggatctcgccatgttgcccaggctggtcttaaacctctggcctcaagtgatccttctacctcagcctccaaagtgctgggattacaggcgtgagccaccatgctcatcccaaaaagtactcttaacagaagtaaaagattagcacagatctctatacttgtgttttttaaaaagtaaggtcaggtttaaaatttgggggttctaaccgtagttaacctctttttttgctctccatacctgaggaacattaccattggcgtggttcctctgtgaataatgtggctggctgcagcagggattatcaactggaggagtgtatctctaggaaggtacttcagcatctgaggcatgagtaaatagtttacaacctgccaggctttcaacctaggtgcttcagatatgatattttcccacaaagatatggtcttccttccttcaccactaccatacttgtaaatcattgctttagatggcacagctctttccttcactttctccttacatccttgtcatttttataaatcactgaaaaccccactaacaaactttagcaaaactgtgggatattttgtagcatcagctcttagtgtgaggaggcaaggaagcctgaaagatttagtaatcatgtgctcatctagtaacatcaaggcccaggtgggcaccccacctcatgtgtggcggggaatgatgcccgtgactgggggcgttcgccactctaggcagcatgtgaccaactcctggttagagaaacagaatactggccagtggccataaggagagagggggcctgccttacgtttcaacagctgtaatttctctgctttgcagcagaagttaacattctctttataggataaaaaatctttattaaaactaaagctgggagcatataaatatgcaagatgttctggtttggaatatgatttgttcaagagttggtccaatggatattcctagaagttgacgtccatatggcaggaatgaaacttgtttttctctaacgtgttgaatgtgtttttagtcatttaagaaaattaccttaattcttctgaaaagttgaaaactttaattacagatgttgtacaaagctgataactgtcattcagctttttaatcaagaagcttaaattggaatggtatgttattttctgtaaaagatattcatgaagtataacctgtgccctgtaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgaggtaaggcttgtgtttgcagggcatcccactgcagagatttagaattaggtatggcagtgtggactctgctatgctgtaataggtgtagattctgtagttacaggaaagggttaattacttgctcaagatggaaaaaaaagatagtggttagaaaactttaatttgtgagccctctttagagatcctctttagagatcctctgcttgtcttggacttgattgattaatggtagacaaatagattttaacttttccaaataacacagaacaatcctaggtgttagcataacaccggttaacagtgtacctgctccttggatatctcctttcccagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggtgaaatgaaatgcttcatgacacttattagggagttctgaattgctcctaaaactcaaaaacatcccgagtgatttttccataagtatgttggttctgtttccaaagtattcagcctttattcttaaatatggatgcaaattttgatttatgttgtaacaataggttaacattttttaatgtttctataagagtgtccttttaagatctgagcactaatctcagcactttgggaggctgaggcaggaggatcgcttgaggccaggagttcaagaccagcctggtcaacagcgtgagacttcatctctaattaaaaaaaaaaaaaagaaaaacagagtctccttttagatcttgctgatatattttagttcttacatacatgcctgtttttaaaattcctgaatcgtctgacttctgtatagaatagccaactgtgaatgaatgtcttaagaaaatagggtgtcctatttttagtaaagcatttagatgatttcccaattgtcttttaagactttagtttaaaatttgataatatgataattataaaacactttccttctagtgaataggtaaggtttatatttcatttgtttttgtaatttttaaagcatatttctgtggagaagatatataaggcttgtggttccatagagttaaaaaaattcatttttttaataggaaaagatacagttaccaaagataatggcatccgtccttcctcactggagcagatggccaaactaaaacctgcattcatcaagccctacggcacagtgacagctgcaaattcttctttcttggtaactgtcaatgttatttgtatttagtagtgacttttctatttctgtactctctgtagaaaagcctaatataactttttgtgtgtgttatgaatagagggttaaaaatatagttattcattttaatgtgaaagtggagtcattaaaaaaaaaatagaatcacggttttaaggcccgagaagtcacctaatccagccaccattctgccacaaaagctcttcctttcaggcacttaaccagtcaaaaacttctattgcttatggtgggccctggaaatgaaaagaatagacaattgcaatatagtgagatgctgtgatggctgtaaggcttaggtcgaacccctgacccagatggggggacagtcagagagtcttcttggaagaggtaacacttgagcagcaaatcttgaaggaagagtaaaagccaactcaggaaggattttaaaaggcatttcgggccgggtgcggtggctcacgcctgtaatcccagcactttgggaggttgaggcaggcagatcacctgaggtcaggagttcgagaccagcctgagcaacatggagaaaccccgtctctactaaaaatacaaaattagccagatgtggtggcacatgcctgttaatcccggctactcgggaggctgaggcaagagaattgcttgaaccctggaggcgtggaggttgcggtgagccaagatcgcaccattgcactccagcctgcacaagagcgaaactcccatctcaaaaaaaaaaaaaaaaaaaaaaaaaaaggcattttggacaaagggaatagcaaatgcaaaatcaaggaagtatgagagcaaggggttctttggggaaaagttaggttggagcataaggtatgaactgggaagtcgcagaagacaaggaaaagcaggcagaaagagtaacaggatacctcttccagccctgattgttagaaaactgctttacactgaccccaatattattttcctgtaagcatcatggaacaaatctaccactgtttgttttgtgttttttttttaacttatcaacatgtagcttcatatccttccatgcttttctgactcctcaattaaacatctttattgattctgctgctgcttgtaagatgtgatttctcttctcttaccaccttgggtatagtcttctggatataggccatctggtcagagtttctcttacaatgtaactctcctacctggccataaagtcttgaaaacatacgcagatgtttgacatatttgcccatggtaaatgactaattaatgcctgctcttgataggctaggggagtggaatctggagtagttccaacaggatggaacaccaccctgttaagcccaggtggtgaagagctggttaggttggtcatttgcaaaaccgaattggatgatagagccatgtggcatggactacacttgccagatctgaatccttttgattatttccagggtatgctaaaggtccaggtttatttagtgagaatcagagacacaaatcatcagaggtgacacatcacaatacatggattttggggactgcattagtgccccacattcattgcaattttgcacaatggcacattgaacctgttattaatgtaatgtctgtaaaccatttattccatatggtcacctatgtctccagactttatggacaccctattggtggctacacagtctcttcagggttgccgagttataaaaatacgacagaatgtggtagaacttattttgattttacaaattatgaagaatagtttccttttctttggaattctgaagtttttgggggagcttttcttctttgaagtatggtaaaggacgttttttcagtagtacttctttgtcctccagcttctcggttgtcatttgggaagaaatgtatggggtgtatccaaagagggaagattgtggttctaatgtcctcagctggttctcccattggtttgctcgttacagaatatataagtagaataaaatgacctgtaagccacgggcagaaagcagctgagagcccagaaaatgtaaaaataaataaataagagatatgtttattttggttcatattttgtgccacaagctaaaaactttggcttaaataagtgtttagtgtttattatgagcagttctttctttttttttttttttttttttgagacagagtctggctttgtcacccaggctggaatgcagtggcacgatctcagctcactgcaacctccgcctcccaggttcaagcaattctcctgcctcagcctcagcctcccaagtagctgggactacaggtgtgtgccaccacacctggctaagtttttctatttttagtagagatggggtttcaccgcgttagccaggatggtctcaatcacctgcctcatgatctgcccgcctcagcctcccaaagtgctgggattacaggcatacaggcatgagccaccacgcttggccatgagcatttatttctaaagttacctcttctgttgattcattttgattattatgatacttttgaacagccttctctaccctcatcctccaaaaatgagtcagcgtgtgtatgtttgaattatgatttaatgatggatacagtgaagtaagtgttgttatatagaatcactgtataagtctaatgagttaatagattcaggtacagatatataagatggctggagaaagacctccagacaggctgaagaattttaacattgtgctggttaacatttcagactgatggtgcatctgcaatgttaatcatggcggaggaaaaggctctggccatgggttataagccgaaggcatatttgaggtaaagtaaatgttcaaacaaatcatctctgatttctttattttattaccaaagctcacctctctatttttttacctagggattttatgtatgtgtctcaggatccaaaagatcaactattacttgggtaggtagcagtttgtatccttggactataatcacaagtatttgattgcctatgttttattatactggttaataaatgattaacactggtttattatttatttgtttattacactggtttgagagtatattaagccctgagttcataattggtttatgtggtggtttttttaaaaaaaataatagtaatctggccgggcacggtggctcacgcctgtaatcccagcactttgggaggccgaggtgggcagaccacgaggtcaggagattgagaccatcctggctaacacggtgaagccctatctctactaaaaatacaaaaaattagccaggcgtggtggcgggcgcctgtagtcccagctactcgggaggttttggcaagagaatggcatgaacccgagaggcagagcttgcagtgagccaagatcacgccactgcactccagcctgggcgacagagcgagactccatctcaaaaaaataaataaataaataaaatagtagtaatcctttccattggtatatcatgttacagttttggattattttccatttttttcctataagttttacatatatatatggacacacacaacttatattctttttcattaagatagcatatgcattttttcatatggctacacaccctgctacacaatcttcctaatatagccttttataaaagcctccccatgtttagactctgttccgttccctcacaaggctgtagcctctagcctccactgtgacgttcacatcagtcaagccctttcccttgccttgctctttgaactctgttcttccagttcttcatgttattagcttgtccttatccctcactgtttatttattatcaatttctctgactctgcaacataagagtagagggcatgtctgtacagtttcactattttatctttaacatttcattaatcagtacagaaaaatcaaagaatgagtgaaaagacattagagtacctatgtaaaactcagtttggggaatatgaaggagctcttagtttaaaaattaaagttttaagatattacttattttttctttgcagaccaacatatgctactccaaaagttctagaaaaggcaggattgaccatgaatgatattgatgcttttgaatttcatgaagctttctcggtaagtaatttgaaagacacatatgaagggactatagtcataaaaaatgtcatccatatttgtgggagagagcaaggcatggtttatgatgtgagtagagcaggagtggacctgcatattttaagtactgattcacactgctgggaggggcccgaggggagggaagcaagggccacacatacagtgttggagaacataccaaattgcttctttaggaaattgccattgaaaactgatacaaagatttgttcaactttacttttttttttttttttggagacagagtcttgctctgttgccccagctggagtgtagtggcacgatctcggctcactgcaacctccgccttccaggttcaagcaattttcttgtctcagcctcccgagtagctgggacaagcaggcgcctgccaccatgcccgactaattttttttatatttttaatagagacagggtttcaccatattggtcaggctggtcttgaactcctgacctcagatgatccacccgccttggcctcccaaagtgctgggattacagatgtgagccactgtgcctggccgatttgttcaactttaaaccatacctaaagttgttaaactttcacaaaccattcctataagaaagcgtagaggaacatgaataacgaggttcttattcgattattttctcttccagggtcagattttggcaaattttaaagccatggattctgattggtttgcagaaaactacatgggtagaaaaaccaaggtgagtttctaattttaaaaaatgcgtgaattttcaaagcacgttaataattggatcttagttacctgttcttaagaatatgaagggaaagcttctctttcttttgaagaattttgtctttcattaaagatatttatttcttagtgtaaaagtagaaattcttgtatttcattaaatatatttatttcttagtttaaaaatagaaattatttagcaaaaataaaattctgtgttttttgttccttgcattctgacattagatgaaaaataaatggactcctgacttttaatattgacctagacttactttcttttgcagtaaaattatttgtaatatgtctgacgttacgtattttcctctgtctctcttacttcgtagtactaagagcctagcttgattctgatcttaagtaaacttatctttacatttgtgtctttgggggagccaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcaggtacgttacagtggtgtcataggaccctccagagagtcattttcttggaatgactagaatgtatgatttagtttgaaaccttcttaaagcaatatttttgatgacctgggggtggggagtggggagggataacagctgtaattctgataaaactttttgttttttgggttttttttttttttttttgagacagtcttgctctgtcacccaggttggaatgcagtggtaatatcttagctcactgcaacctccacttcccggattcaggtgattctcgtgcctcagcctcccgagcagttgagattacaggtgtgcaccaccatgtccagttaatttttgtatttttagtagagacagagtttcgccatgttggccaggctagtctcgaattgccgacttcaagtgatccaccctccttggcctcccaaagtgctgtgattacaggcatgagccaccatgccctgccataattctgataattctttggaaggaaacagctatttaaacccaagctatttttccccaatataatgtttattttttacttataaatatatgctgattatgaaaattgtggaatatatgaaaagtatatagaaaaagttagaatcatctataatctccccatcagacattaacattattaacatcttgatatattttcttctttaataattaacttttatttatctagtcaccataagactttataaaatctctccaagagagaaactatctttctagagaactgaattataccttaactggggagttaatttacttctggataacttactgctgttcagctggggaaatatattgttgacagattttttcctttctacttcacttgcattagagacccaacttcctgactgctgtagcatctcactctaggaataaaatccaaaaggaagattgtagtttgttttttgtttgtttgttttttgagacagagtctcactctgtcccccaggctggagtgcagtggtgccacctcggctcactgcaacctctgcctcgcgagttcaagcgattctcctgtctcagcctcctgagtagctgggattacaggtgctcaccaccaagcccgggcaattttttttgtatttttagtagagacggggtttcaccgtattggccaggccggtctcgaactcctgacctcaggtgatccacctacctcagcctcccaaagtgctgggattacaggcatgagccactgtgcctggcctgtttttgttttttttttttttttttaatcccgatgtgaacagattttctcttcctctagattacagaaacttcctgttcctgatcaaaatgaataaatatttaaaagcataaactggccgggtgcagtggctcacgcctgtaatcccaacactttgggaggttgaggcgggtaggtcacttgaggtcaggagttcgagaccagcctggccaacatggtgaaaccttgtctctactaaaattataaaaactagcctagtgtggtggtgtgcgcctgtaattccagctactcaggaggctgaggcaggggaatcgcttgaacccgggaggtggaggttgcagtgagccgagatggcgccattgcactccagcctggtgacagagagagactctgtctcaaaaataaagtaaatgaaataaatcttacgtttaaaagccctttttcatggattttcctcagagactttgcagaaaccaaggggtcagttatttatcagttggaacattttggactttatgatcacaaatgctttttaatctgtgtaacttcatctacagaaaaccatggtccattaagactagagcgatccctctatctcttcatgccaggcttctaccagggagataacctgtacacattactcacgagcatagtgcgtaatccacatagggtaatgtctgcagatttgagtatgtgttccctaattctttatctagcatgtagagtataaataacacaatactggatgcttttatggatgaacaaggaataatacctagcacctttcttctagaagtttatagtatgaagagagaagataagatgcatctgagaaactagattaaacttgacattgtttgatcaagagccacgtgagcaataccaacatggttggagacagaggagaaatccatcgtggtgaatctagagcagggtttctcaactttggcactaacattttgggccaaacaattctttgttttggggggctgtgtgttgtagggtgtttagcatggcctctacccatcggatagcagtagcaacaagctcctccccacctctgccccaggtacacacggttggtataaccaaaagtatctccaggtgttgccaaatctgatctagagcaagaaaaaacatggaacatgaaaacagtgtgtttaaaataaagccagagagggctgggtgcggtagcttatgcctgtgatcgcagcattttgggaggctaaggcagctgggtggcttgaacgcaggaattcgagactagcctgggcaacatggcaaaacctcgtctctaccaaaaatacaaaaattagccaggtatgatggtacgcacctgtggtcccagttactcaggagggaggtgagaggattgcttgagcccgggatgttgaggctgtagtgcgctgtattcacgccactgcactttagcctaggtgacagagttgccttgtctcaaaaagcaaataaagaaattaaaataaataaaaaataaaataagcaagccagagaggagtagtctaccttattatgaattctttcaggacaacccccaagtcagtcaaaccttcctatccctgctctttttttgtctgcttgtgccttttcaatgtacttaacatgccaggtgtggtagctcatgcctgtaatcctagcactttgggaggctgaggtgggcagattgcttgagctcaggagttcgagaccatcctggacaacatggcaaaaccccatctctactaaaaatacaaaaactagctgggcgtggtggtgggtgcctgtagtcccagctactcgggaggctgaggtggaagtatcacctgagcccgggaggttgaggctgcagtgagccgtgttcaggccactgcactccagcctgggtgacagagggaggccctgtttcaaaaaaaacagaaaaaccaagtacttaacagtttgttttgaactccagtgtatacttgattgaggacaaagaccatgtggcaaatctttaaacctgcagtgttcaacttggcactttgtaaataatagtttcttttatttacttttttgttttttagagggtgtctaaaaattctatgctaggatttagactcatctaaactaaggacatagctagtacatagcactgtgcatagtgctggataaaagatattctacttctggccgggcacagtggctcatgcctgtaatccagcactttgggaggccgaggcaggcagatcacgaggtcaggatatcgagaccatcctggctaacacggtgaaaccccatctctactaaaaatacaaaaaattagccggacgtggtggcgggcgcctgtagtcccagctactcgggaggctgaggcaggagaatggcgtgaacccgggaggcggagcttgcagtgagctgagatcgcgtcactgtactccagcctgggcaacggcgaggcacggtctccaaaataataaataaaaaaaataaaaaaagaaagatattctacttcttccctttgtggtccctcagatcattatcttaacctgtgtagaatagtgaagaagggacaagcccagcctttggaatcatctagacctggtttcaaatcctggccctgttaccttaatagctttgtgatttgggtgagtcacttaacctttcagagcctcagttttcccctctagaaacttacttttattggtatttgctgtatcatgtttatgtttatacagttaaaaaagcccctggatttctcattttaacagcatccatttgtagagcatcactaggaattagattctgtactagacagagcctgatgcatatatgtatacatgtatatatgaatgtatataaatatatatgtgtgtgtatatatatacacacatatacaaatatactgtatgttatgtgatgcccacaaaaactctatgaagtagacactatgagccccattttgtagaggaaattccagtttagactgactacaaactttcccaagatcacagtgattgattggcagagccaggatcccactccaaagcctgtacttttctccttgttctctgctgtccctgtactaggtggattcatcaccattcattgctctaattggactttgttttctttacagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattggagaactgtttacctcattttttattcatcaggggagggtggttctcttggcttaggaccagatttttgcctttaattactcatttataacttctaactattgtggtcaatgctgaggctgctgggaagataaagacaatcctgtttatttatttattattattattttttttttgagatggagtctcactctgttgcccaggctggagtgcagtggcacaatctcggctcactgcaacctctgcctccccggttcaagcgattcttctacttcagcctgccgagtagctgggattacaggcacccaccaccacacttggttaatttttgtagttttagtagagatagtgttttgccatgttggccaggctggtctcaaactcctgacttcaggtgatccacctgcctcggcctcccaaagtgctgggattacaggtgtgagccactgcgcccagcctgacagtcctgttttagaataacacattttgttttccccactgctgaactgcagaatgtttatttcactgtttggagatgcttctgttagctaggatttaaataaagtgtaaagaagttttttattttgatcaactactctaaatcctctcagatttttgaaaactaccctgtactaaaataacatggatgcgagtgtttaaagaaacactagcttctttttatggacatttgtgtgactgttgcttaggtctatgaaagttactgggaatcaaaattaccctgtagttcagggacagattgggcaggagacctagtgctaacctcttaaaaggatatttgagagtcccagcatcgtttccccatggtttccttggtaattataatgtgagtttttaatacgaaaaccattatatttacatatatatcacaaaaatcaggtatagataagttaaatataaaatgtaaaaaccttaaaatttagaaaaaaaataaccctgtgaccttaggttgaaggaagagagggatttcttgaagaaaacattgaaaatactaatcatgaaagatctataaatttgcctgtgttgaaataagaacttttattcttcatgtgatgatacagagtggtggagaaacaaactaaaagtggagcaaatatagtagatacagctttaaaaggatccaggatatataaataattcctacaaatcaataagagtaaagaccactcggctgggcacggcggctcacgcctgtaatcccagcactttgggaggccgaggcaggcagatcatgaggtcaggagttcaagaccagcctgaccaacatggtgaaaccccgtctctactaaaaatacaaaaattagccaggcatggtggtgggcgcctgtaatcccagctactcaggagcctgaggcaggagaatcacttgaacccgggaggcggaggttacagtgagctgagatcacgccactgcactctagctctgtgcgacagagtgagactctgtctcaaaaaaaaaaaaaggcaaaagatcttaacacaatttttagaaaatgatatgcaaatggtaaataagatgcttaatagtaatcaggaaaaacaaattaagatcataatgaaatacacctgcctgactggcaaaagttaacaagactgagaataccagtgttggtcttggatgtggacaaattagaactttatatgctgctggtgagaatgcagattggcaaaaccactttgaaaaacagtctggcaactgggccgggcgcggtggctcacacctgtaatcccagcactctgggagcccacggcgggtggatcacgaggtcaggagattgagaccatcctggctaacacggtgaaaccctgtctacttaaaaaaaaaaaattagccgggcgtggtggcgggcgcctgtagtcccagctactcggaaggctgaggcaggagaatggtgtgaacccaggaggccgagatcgcgccactgcactccggcctgggcaacagagcgatattccgtctcaaaaaaagaaaaacagtctggca

SEQ ID NO: 11771 - DNA, 57139 bp, Human
ataataacagccagtattcttcccacatacttccggtcaaaagtggggaaaccagaaaccgaataaaacattgggaagagacatactgtgttcctggaaaaaatataacagagccagatttaactcggtgagagggaaagtgacccccttgagaaaccagggaatgtctcaccctcagaccaaccctttcttttgcaaattgaattggtcaaagtttagttttgtcatcatttctattgttataattcttattcattttcccagccccgtccacacttctatttttcactacccccacgccccacaagttgccaccgggtcaggtggggacatatccggagagaaatagaaagggatgcattttaaagcgagttctcttttgagaggaaaacaatgggtagttttggaagtgtctttcttaaaaacggaaggagaaggtgaagaaaaaaattatcaacagcaatgggcccctttggtttgggttttgactttttaaagaggaacctctgctgtcctgttgcagtattaaaatcagggcaggaattttgcaaaatgagaaaaataaacttcgggagaaaacccagctgggagcagcttcgggaaagcgacagttctccgaaaggaggaagggaggatgcgcgctgtagccggctccggagtttactgcccgaacgattggggaaaagaacgaggattctcaaatctagttgcgatctctcgtctctcctttattctgttcgtggtgcgggcttcggagcgtctgggaaagccagtctgtgaagctggacttgcagaatcctttgaatgccggtccaggtggctgcagggcccgcagtccgggatgccggagaaaggaaccacaaggaaaagacgctacgctcggagtttccccttttccttgcagccccggcggggcctaggcctcggtttccggcccacctcggctcagaggtcaagtaggaactcatctcgtcgacctagggtttgggagaaggatttcgggttgcgttcttggcatctgggagcaaacacgagcctcggatttggggacatatcgttattaacagcttgggaaacgaaagcgaagctcggggcagccactgcagcctggctgagagaaaggacgcgggttgtgctctctggaagcaaaggggtctgcggcccagctggcctgggagcttgtggccggcgctggaagctgcccgctctccccgcgggcctgaccttggctcccgccgcagctctgccggccgactgcctccctgcacattttgctgccgttccagtccttacaggaccgggcctggagccaggccatgcttcggaaagccctgggggttggggacgcgcaaaacccagaatcgaaccccgaagctgggggcaagtccagattcagacgtccagctccctcgggaccccttggcggagaacttacccttccggaaggcccgacgctctccggctctgtgctgggcaggcctagctcttctctcggcgccaccaggggcgtctacgcggtacgttttgcaactcaacctagtgggtttccagcggtgcgcaaaagtttgcgagcatccaccactgcgctgcttagaaattgtgcccattgatcagactaaaaataatagtcgtcgtgattacaaaacaaaatagagtgcctcgtgcctcggcgggccctggtacaataattattctctacagaaaccacctctctccactcccacccctactccaccacccactcgcaccccgcccctgccgggccactctgggacgaattgcattcttggacctttctctccgcaaggcacattacggagaactccctctgtctcgtgtcccctccacgacaacccagtaattatttctatgcaagtctgcaagagggcactgagttatcgcatcccaagcctaaccagctagagcggcgcctcggtattcatttgcccagagctcctccgcgggggatttaaaaataataataataataataaggatcccatgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggaggtgagtttcaccctggaggactgaggggggaaataggtttctctttgcacttggccctccttggcttttcaccccgtcttagtcttgctgaatcttctcttgctgtgctgctgcttctcatgaacgaaataagaatggcttcgtgtgtcacctggcaagaatggattctctcgaaaggtttgaaaatccctattttgcttggtggcccagaccatctgtgctcaatgagctaagcaaatctggctgggctattacctgggagagtccagatttttcctctctggaggggcctgaagattatttatgggaattaattttatccccaaatctctgagaacttaaagggattgggaaggtctttctggatttccctttccctctactggagatgtagcggttcagccttcttccgatgccatgtttgtttttcgtgtcttcggcctagggtcgccttgccagcaagcctaaaggcctccaagctgacttggagggtgagggtgttttcacaaataaatacatcgcctgggcaaagggaaaatatctgtttgcaaacaaacctggaaggtggagtgagcaccatagcaaaggagggctggctttctccccggttgccccacattcagggttggagattctccactttggcattttgcagcaatggcctggcctgggattttagcagagcagtcacagagggttacacagctgctgacctcggggcatttctcctccctccatccctttctccagaccttgacttgcaggcccaagtctcttatcagaaccctagaaaaatcagtatgatgggggtacaggaggtaaggatgggaaacagaacaggactcctgacatttactccaagcaccaatattcggtgtcccaatctgggtctgctcagactgagacctactgactgtgtttgtgcttttattgacctcttcaactcaccctaaaaaaaaaaaatacatctcagagagggaaagggcaaggagaggagaccagtggagatgaaaaccctagccagtccccagtgactgtttgattattttaataaaactgggcactgccttgtgtacacctggagcaggggacgtctggtggccccactgggtggggggtgagggcccgcagcgatttcttagcatctttgatctcggcccccatcccaatgcaccttcaccctgccttcaccccagagtcgttgagagtaggggtgatgagtagggggtggaggggagatgtcaggaaggcgagcgccggccaggcggggtcaggcagctctccttctcgaggtcagcgttggagagaatgtctgcaaggctgcggaggcccgcggtgtgtttgtgtgtgtgcgtccagactcggttctctgcaccgccagcgtcactgagattacttcccgattagaagccgaccgcgtttgaaatgatttgtgcaggagtttttgcagccaccgcttgctcagagaagcagagatggatggaggttgggaaaggggtagagaggagggagttattgcaggtctgtgttgagagtcgtattgtgatttgagtgttcgggaaatctagtggaaatttggggtggggggaagggaggacgggagggtgggagggagagagaagggggagggcgacagagtgcagtgggagctagttggataggcgatttcagtactttgtgagcatcgaggcaacccaacgtcactgtgctcagctgagttggcttgtatttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgaggtaaccgtcccggcagatggcccgggaggctcaggagggagctcgtcggccgagtcggctggggcggcgggaatggcggattccagcccggctttgcattctgcagagcacagcttgcagagattttgcgcggctcggagctccccggcaaatggagtctgggaggccgccgcggctggcggagcggcattgaggtttgcagaagcacggcctggttctgtcaaaccgcatcttgttcgcctccgccagcccagagctccccgggaccctggcgagggcgcggggtaggattctccccgcggccggcagtgaatgggagcgcgtgtaggggcgccagccctgctttcttttgttgtgagtaggcagcggggctccagtcgccgcctccctgaagccccgagaacgaggcgaagaaagctgcttgcaagtcaggcctcagaagctgtccttctcctcggccccatttctagatctctggccacagcaggtcagggtgggatctggccgcttgcttaagcagctgctgaggttttgggggaccatcgcttgtgcccgcttcccaaagtcttcccgttctagggggaattcctacttgcgtatagaagagattggaaggagatcagagagcaggagacaggctcatcgggcttgaacagctctgcggcagttattttgtgtgttctaagctcatacgcctgcaaacccgggccgttctatgcattgcggggacccgggctgcagattcaatgtctccagcctaggacttatccgagaatgattttgtcctcgccaatcctgagcctgagcctgcagttttagcaggccaggcctggctgaagttcagagaaacccctttcggcctggtcactccacaaaatgcccgccatcccccgcccggcatcagagcgctggtggcgggcacccagtgacgagccttcctcggaacggctgcacggtgactttcttcatctagtcttctgtttggctactttttatcttttaacgaatcttacttaaggttgggataaagaaaaggatgtttaattttaaaggacttttaatgttaaggcctgtaactggtaaaaggtgtatatgaattctcttttgaacctagtctcaatctgcacaaccttccccttctgtgtttttctttttgcaagaggcgggttatttcacacatttctgcctgctgcagaaaactattcctcttgtgaggtttaataaaaagagtttcgacggcatcttgtaatttggcgaagaaagaaattctctaaaggacactgggtttttgttttgttttgtttttggttcctacccagtggcttccaaaaatacccacgccttatctttattggctcttccagaagtccagacaaatttgacgggcagcttgcttatcacggagagcctgcgcaggggagatgcgggcctcaccttctccgggtctgacgcgggtcttttgcaagaagttgtgcctgcttataaagtaatagtaatactactaggaatactagtaacagtaataattctagggccttctgcagtcaccttcggctgggaacggaggtgctggtagctggaaactgggggccaaactgctccctcctgtcactagaattgtgctctccaacctttctctcgttctctctctgtcctccccacccccatctccccctgcttcttgtcctcagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcaggtaaggagacctcgcgcttcgggtccctttgcagagatcaaagtcagagtctggctttcctgctcggcttctcttgcggggacagaacaaaaacaaaataaaaaaaccccaaaacgaacccaacgactataatcatcccttttcctttttattcccactcagttccacctttctctgccctgtctccccaaatgctagcgtattgccatctactttattgtgacggttatctttacggccaaaggatttttgaaatctatttaaattgttcgagaaatctcaattatccggccgtttggggtcagctaacaatggcctagataattcctttccctctgcactatgtgtagaatcggcccccagcatcttaataagggccaggtcagcggccgattcaggccggcatgagcgatggcttgacccctcttctgatcttccgtagccttcgcctcctcccgcctcctcctgcctcctcctgcctcctccgcgccgccgactagacccgcgcgccgcaccatttgtcttgcggtcggggcctggctggctggcgcgccatcaccggccgctgggagcgcacagagctctgcccggagggcaccaggagcctcgggttcgccaggctacaacctgggcccaggcagagggaggagcctcaccttgcgctctgcgcccaaaacccaggacgcactgggcgctcaagtcggcccctcagtagatcctggtaatttttaaataaggtgtcacatggggtgaaacggggtgacgaccagaagagacacttacacatggctaaaatcctgccttgggatttcgatcccttcctggcttttcccggcttctctctttggcctttaagtttcaggaaaacgtgtgtatatttgtagagaagcagagagcgtgaacacagtttaggaaacttagggatttttttttttcttttaaggaaaagcaaacccactttttagactgttgtaaattattccaaaatgaagagtttgtgtgtgcatgtatgtgtgtgtgcacatatgtatatatatgtatatatatacatttgcatcggttctgtaaatttagttttagctgaaagccaaaatgttaaatggcatcaggcgtgtcctataatcaaaatagctggatgtgaatggaactacttgtagagagagcctggaaggtttgttaatatagatatttaggattaattatccttctggactgtaagaatatatgataatacaaacatttttaggtttcaaaattcatgtatgttcaggtttgcactcaccatggtcgagaataagcaagtatttgcacatctgtatgtttgatgtgtgggcatctgagtgtctacatgagaatattctgagtggttttctagattaggttcctagtttttctaaattaggttttttatctatcccccccacccatctcaggtgaagtggattgaaattggctctggttttttttttttggtttgtttgtttggttggttttttcttattccggtcctcctcagtgacattccggagcaccctgatggtgggtgatcactccatagccttgtgctgatggcattagaagcagacaatacagcactgtgggttcaagtggttgttgcaaccctcagggattcagcctacatagggatccctgggcagaggctgttgggtgctccagataattctgcagtgggctgaagccactttttactctctgagaccacaggctccagcgggaaggaggagcagtctctgtgttttgggggagtttggggaaggaatgcccactactgccagggcttgttagtgtgacttttttctccttcttgcagggcatggagggaatcaaagtgtttctccatgaaagagaactgtggctaaaattccacgaagtgggcacggaaatgatcataaccaaggctggaaggtgagatggtttgttgtgtagagagagggacgaggagaaattgtgggagaggtgaagaagaaaaggtggcttggaagagaagaaggaaggaaaggggcaaaaggagagggaatatagagaaagaagagaaaggagaggagaggagagagagagcgaaagatagatcctggttaaagaggcacaaggagattcctccattgatctctcctaggatggaggaaatactccagaagttcaagcccggaaactgggcatttctcccacctcacatatagaaagaataaagagcttgggaggccgtgctatctggattcgtaatgagggaaagagagaagagggaaaggagaaaacagaaaacagagacccagagaagacagagtctagaaggtttttgggtttcagggatcttggactttatctttactccaatcctcattcccaccctccctgaccttggagtggctccagggtcccacccgattgtcaaactctgaatcgttggatgtattcgctacctctttcattgtttatagaaagcaggcgaagcctttaaaactgaaccggggctcggccgggctctatatacagacaccaataaacacggcagcttcgccaagacactcgccccggagttccccttaaaagctcgcagagttttagctagaaatgctagacttctgggggaggaggaaggagagtggtgcagctctgtatgtcagtgtgagtgtgtgagcatgtgcacgcgcgcgcccaggcctggggacgtcctggccacatccctacccgtgctggacgggtcttccgcgtcccgcaaagcaaaaagccagaggatgccccgagcaggcgtgtggagcaggcgaacggtaggcccaagccaccgagtgtgtgaagggggagggtggagccgcctttccagacgccccccgcccccgttctccagccgaagcctccctcaataaactgacaacagtgacatttattattatttaaaattaaacaaagtctgctccccgctcggcccaaggcctgagtgaactaggaggcgcgttctgtttatatcaacgaactgcagtcctcttcctattcccccaggaaggaaagacacgtccgagtccctctttccccccgagcctgagccgtgaggatttaactataaaaggcctgcgaagtcttctgcgcctccgcctccgggcgcgctcgctcaggctgataaacactgcgaggctttggctccggggctcggagggagaggcctccattcgaccgttcccgccatcgctgagtgagccgagatctgccaacttgtcttttcgccccgggccagccttgagaatctttgctttctggggcatgttcctcagaaggtggagggaaatttggagtgcgccagggcgcagaaaggcagcagagacggcacagttccgggccatcggcttgataacgactgaatcttagttcaggcctcagctttttctgaaaccagatctggaagggtctggaatttctttgctgaaggccaaggaatttcgactctccgaggaagagtttcaggggccttggagaagttgtgggggcattcaggaataaactcctgctagagacccatgtcagaggtcattaaccgagttatactgggaaccgcggccttccccttcctccagcggcagaggaccaaagcaaggtcgggaagcctgggcgcacccacgcgtgtgcatctctggggcgcacacaccttgtgtacacgtgacaccttagcaacgcgaggatcggcggaagcacctggctagacagatcctctaggatcagcgcctagcattgtacctaataagcctcctctccccacaaatattaataataggtgtctggctccgaaaagggcggttagcaagagttgaaatggaggtccctttgaagcatcttcaaaacccgttctctagaggcgcatgcgtcctggtttgttttccgcttaggttacctacagttgcccgcctgctgttacctcctcccttcgcctttctcctccctataacttcaagggaaacccgggatggatcttgcggagagcggaacggggctagtttccgcttccacgtttctccaggaattgctttttcccttaaaatggatggaggctgccttaaaatactggcattaattcccgcccccctctctccctccgtccctctctcttaggcggatgtttcccagttacaaagtgaaggtgacgggccttaatcccaaaacgaagtacattcttctcatggacattgtacctgccgacgatcacagatacaaattcgcagataataaatggtaggcactggggtggcaggtggagcggggagagagaaaagtggaaccttctcccaaaaagttgaaaagttgtatcagtgaactttttttttttttttagttcctactgtgtgctaaaggcgtctgtccgcctatcccattgctttttactaaccattctcagacaaagaaactacaacaattagctccggttttccagatgagaaagcggaggctcagaggaagtgaggtgcctgtgtctattgctgcacccacaggttgtggatttttacaaagggtattgttaccaagtgctggaggtatttctgggggcataaaaccatttacagttattttttatgagttacctgctttgaacatgcatttttatgaaattgcaaaatcgactcgtggtattcgagttaaacagttaggagaggcccatttcttgggtagaatcgttcccatggctgccagcagtgcaggggcctgacgatgaaacccccgttgaaagccctcaaggaattttcaaggctttttgcacgtccagacctccagaacccgccacttttttgtgggatgcgagaggctgtaagaagaaagggctgggccaggggcttgcctgggcgcaggcacaaagtattctggggcagctgggattgcagatacctaagggagacgggagagcctccagattattcccagctactactcaacaaccctcacctggtgcgtgaactgaagcacgcttcggtgcagtgcgctacctccagactctgagccaggcctctagtacacctctccttcatctaggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatgtgagtaccgtggcctggattccccgccttgtctccctcttgtcctctctcccttcttctcactgggtttctctcccttcttggctctgtgtgcctacatttctccttttctttcctccattttcccccactttcgtcgctttctgcctctaccttcttgatctggacttccttcctcttccttttcctcccctccgtctcaattctctcattcctttctcttctttcaccttctcacttgctttccctttgctttctttttcttcctactatttcatcctctgtctccactactctcctacacagacatctgcccctctgcagtcctcccggtgatccacactccccagatctgggtctgtcgttccttggtggctggagatatggcccccggctcacctggtctggggctgcatccttgccgttagggcccaaaccctctccctttgcctagggatggaggaatgattgaagctgctcattccaggcctggagagtctgtgaattcgatctgtggttaggagtggagggctgtgtttcagtcttgcagaaaatatggacctcctagcccagtggatacccagtatagactgcacagaggctggaccacaatgaaagccatataccttccctccccacttctcaatcctgccttaattttgggatgttccaggggagagggagagcccagctcacctgccccctcttttccagatgggaaatgaactcataagagaactatggtgccagtgccactttttagcttgatactcccggggagatctgttttttttccaacaaccagctttctccctttccacactgtgcccagagcaggcgaatgtaaaccagggtcctaaacttggagtctggattggacccaagagaggggactggtgaatttcctgaaactgaatgcagggtattgaatgtgcagcctgctcaccacccaaaagaatgtgtaggttttagtggattcttagtagggtcatcacccctcttccccaaagaaaaacaaaacacaaaacactgatttttgaaaaaatgtccccaaatctcatcgtagaagataattaattactagaacagaacacggattctgtattcacgtttagaacttttagctggatgattctgccatacaagtgggtacattcgtcttgggcatttgattctcacggcagcctagggggcggacgggaggcatagcttttgcacaggagagtccaggggacgggggtgacttgccaaggtcctacagcttgtatttgggagcagagatttgcggctaggtctctctaattacaaaaggagttccctgtcctggaaggttgtagcttcaaagaggagcaacagataggcgcatggtcgccgatttcagggaaaggaggggactgggagggaatgaatttggtcaagggggcgggggaggatggtttatgaaggtccaaacgagaaatctgctcctttgaggccttggggctgaagcactgaagtccccaggatctgggatgggaagaggatctcaggggtccacactgatgggtaaatgcagctctcagcacgtgggtggagaggaaaaagaatcattcactctctgtgcagcctgcttggagcgctcggaaggcattcccaggcaaatgcagagccactctgttaaacccgggtgttttgcccacgagtccttcttgctgggcttcccaggaggtgctctgtaaattcagcttgtgtaggcattggctgacccgccctggctgtgtatctgccagtccccagcagatgccttaccagcaccagggaaaaccggagccatttctaaaggttccacatgcatctctgggctggctccttctggaggatgggacccttgggtggggtcctgcgtggtccttgacgctgggaagtgggacggttccccaggctcatttcagctcctagctttttctctgctcctctggagtgcctttggggtctctctagggcggatgcctgcggaaggtgcacaaccccaccaccaaattcctggcatccctgccagcttcaggacgttcccagctggggagaggggctcggagctgctcagaactgcctagaagccaggcattcccacccgagactccggacttttaattcagagccggcctaatgaaattaggagccattagatcgccctcgcgctgatgtctccacactgtccccagccgtcaaagcaatttggctaagccgggccgatggccccgccggccggggactgtggcggccagcggggccccgctgcgtctctctgtcgccacgccgccccggtcggcgtcgctatcggccggggaggcggccgggccacggcggccggagattagagacgcgcggcccggggtcgggcagccgcggggcccgcgagttcctcgtccctcccccgcccccggccgcggctcgcctcccccaactacctccactcgatcggggccggactccagggttggtccaagaatcttgccccagggtcatcaatgcaaataatcaaagtcacagagacaacctccgcagttcccgggaaaaagcaggccagattttcaggctgttaaacgcggcgattcgcacgttcggtggggatgtgtcagagcgttctggtaaatactagcgtcatcagaacaacaaacccagttttattggtgaggatgctcatctgtgactagccctggctccagcaagaacgtgcagcctggaagtcctcctcctcctcctcttcctaatgataatggtggttgtaaaaattacagcacaactacagcagttaggacccctcttgtccctgggaacacccctaaatatggggaagataggaagtagaaagagaatattcccgaaaaagcagatgtagccgttctgtctggggccaagcgtggagataattctggttgtggatcctgaaacgtgataaagctggagaaagggagtttccaaggcaaccagccccttctttgaggggtgtgggtggtgcttcctccccacaccttatgagccgacatccttggagggcagatcacccgtgacccccaaatatcttctcttttcacgaactctgctttgcttgttctccaaacaaaggccccagatttgaggtctgatcacccaccctaagcctcagaaaaaggctgtgcagagaactggtgatttttttttttacttatttcagttttccaaacacttgatatcttctcttgcatcccttagagatttggggagtgggggttatttctatgtttgttgtttgtttgtccccgtgcccctacaccacctgtcaatccaaaagtgcccttgaggcttccctccagacgcggattcctcgatccagacttgctcagctcccgttgggggtgggaagtgccctatgcagggagttaatttattaagcaaactttattaagaattctgatttactgctctgtgtgccttgggtagattcctggaatattaccctggctttttcggttggaaattgttatttttgaaatgtttctttttaatgaaatccctggccccttttcaaaacagaagaaaaatatctatttttcgagagccgatataacaaggcgaatttagagggcggggagcagggttttatctggagacaaagggagttttgattttcttacaatctcattttctttattatttttagattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaaggtaagcctgaagcccaggaaccagtgcctggggccgtctgctctttcttttgcatgaatctgcaaggttttcctgctggaactttgctcctctgaatggcagcagtcaccaacttcgaccccagggtgctggggtggggacaaagctgcagcctaagagtttcagctgtttttactatatccacgagcttggcttgacagtcaccaccacacatatgcacccacaccagttagaaacaaacttgtcaaaccatagatgggccacacactcaaataccacaagaaggcatcccactgaccttatgaaatgcctagtgggaagaaaggttgcttaatggctctggtgctgccatttcatttctgggcaactgtttctgctggggtcagttttctcctctctgcctttttaatatttttcactccgagacagggtctcactctgtctgtcacccaggctggagtgcagtggcacaatcatggctcactgcagccttgacttcccaggctcaagagatcctcctgcctcagcctctggagtagctgggactataggcacacaccatcattatgctcagccaatttttaacttttgttttttgtaaagacggggtctctctatgttgccaggactggtcttgaactcctggcctcaagtgatcctcccacattggttttccaaagcgttggtattacaggcatgagccactgcacccaattttgccactcaactggcaacagcacaggtggcaaagttgccgggatccttaggattggactttcctgatgcttccctaattgtttcagaaatcactgactccagaccacattcttgggaaaggtttgccttgttaaaatgaaaacagagcaacctgcaccaccagcagcttgggataacactcccaagctggacttagacaaagagcctgcagaaccacagcttggtgaggggaggcagacctgcattgcttgggagaaggtggctgcagtttggtgtaggggcgggatgctgtcgcatggattgtgtgaaagtcagaccccatgaggttcaaaatccaggcactggttttggcatttcaaagcttgacaatgactttggagcaggctgcctatagcggcaggttggagggtgggggaggatcttctctttttcctcaggagaaagtttgtctcgacttgtcaggattcacctctgttccttagatacccgagtgcatgtggattcattttattgtgggtggcaggagggatttaatgttctaagccttggtatgaaaagttctagaatctggagaggcgagcaataggtgctgggggaggggcccctgccctcgtgcggttgtagactgttaggagtattaagcagtgatttgggcttagaaggctctggaagggcaaagtgggaggggggtccatatgggatctgtgagggcaggtcacctagatggatgtggagatggtgtgcccctcccttttcttagctacagtccccaccagcaaggctggggtggagggggaactgcaggagctggggactggacaggagaggccggagaaggatgagaggaaggcttagcaccccaaatcctcccctcacccctcgaaggtcattccagtgcaggctggcttggcagagaataccccaactgaggccgggactgttccaaaatgctgtggctaatctccaaatccagattgtctgtgaacaggccaagctgtgatagacagtcctttccaggccacaaagcctgtctgggaacccaggtcgagagagagcttcctgccctcggaaagaaaactcattcccctcaagacaccattcctttttaaatgggtaggaggatttttccgagtatccttccacctgttgaaccagcaagagcaaaaccgagggtcgaatgccctgaaagatgcaaaactatttcaggccaatttgagtctgtctccttgaaacctgtttccctcaatggctgctgtaaacctgtgtttagctttgcggtgacggtcacaggaaaaaaaaatagcaataaggaagctcaattcttcctatatatgtatatacttacatgctctcagaccagactggggtccaaaaatatatgagatcttttccccctctaccccaagaaagcccaggttcatacaggaggataggaaagggtagacatataaaagtgaccggcttaaaaaaccatctgaattctcaggtcctttggaagaaacaccctaaattctgtgtagttatgttcttaagactcatcaggtgtggatagatgtgggaaaactcactccctctctccctctttctgttgacagccttattgaggcataattgtcatctaataaactgccatatttgaaacagacaactagataagcttcatgtgtatatatatgtatacctgtgaaactgtcactgcagccatttgtgaatatgcccaacaccctttacattgctatttaaaaaatttcttccccaatacacgtatttagtgattgatgtgcatgaatgcctgcctgcccaatggggtgtgtatgtgtgattttttttttttttttttttttagcgcaatccagggaatcgtgtgtctgaatgctcacaggtctaagaatgtgtgtctccaaatacgcatttggatatatgcgtatttcacggccacactaagtgttcacacacaataattgcttttttttctgtattgattgagtcagggagcccagttgagctgtgcataatgttctgtttagccagcctgacagattccttgacatccgggagagaaatttcatgggagacaactttctgttaccctcccccacttcttcctttagagcaccaaagacacctattttctttttcaggagcaaatccaaaactgtgcactttcccagtcaagtgcagggcccctgcaaacatttcccacgtggatatatgatgtgtgatttaaataagcgggccagggttgcatgtgatttgtggactcagtcttgctactttattgtcccacctggactgggtgttgagacttctgacttcatgcgtagaagccagctgagctcaccatcgcatagggttaaggtggaggactgtggaagctgactgcttgggttcaaacctatctgactttgggcaaatgacttaactccatttccccacctgtaaaatggggataataagagaactcacctcatagtgttgttgtgaagattcaatgagataattcccggcaagtgtgtcatgtgggacctggcagagagctagcacagagcattagtaatgattgatggaccattgattgactacttagcagatcagtttattaacagggcgactccatccaaaacacagacttcggaaaactctttgtttactcattctaacttcctggctagtttagaatctgaaagactgggaatttaaataagttcttattcctgtggttgaaaaacaactgcaaatattagtctttgtggtttagttggctcattccctgatcatgttatcaattcaaggactatttgtctagcgttttgccttggataaatgagcagggaaaagaaaagcaatgcatgtgattaaattgccaagacaatttggaaaaataagggccaccgtttttatggtcaaagggcccagtgccttcagaatgatctgtctctatttggatgtaggtaccaggtggaggtaggtaggctacatggttcatttcttaggctgcaatcacatacccatataccactgggcccctaatgacgagacacatttcctcagcccagctgtgatctcgggctggatttgggacttatttccccagatggttgacagcttaaaaaagatatttaaaaactcaaatcttccccagcgacgttcattctgtgaaacacgtttttgtaaagttttcactgcagttgtcagcagctcccagtgcaatccctagaaatatttaggtgttaaaaaaaggtcacgtgggcatttcatttccctgttcttgcaacaatggctgtgtatgcaagcaatgtctatccccagatattaacttaactttgccattaaaaggcattttcctcctgcttaaatcattgtgtaaggagtctatatttatgaggtatgagctttctggttcagaccaggaaatgaacccttaatagagagacataattaagatttttggtcctcgtgagggttttaaaaaatttttttcaaaagcaagaattcacaacaattattctcattaatttttacaacctctgtctcagttggagctggtatttatgtttgtttttcccccactcccaaatctctcccggatatccggttttatgttgattttgaagggagtacatttgcatggtgaatagaagtcagtttcagtgaagccttttggtggaactgggaaatccaggtgtatcagtttgtgtgcccatgatctaacacacagcatattaggaagggaactttataaacatggttacagtatgtgagtggacagatattttgacctgcagacaatgtatgttgtatgttgacatttctcaagggtaattcttaggtcatataggcatctataatcagtttccaaaagaagttacgtgtaaagatcaacatacctaagtgaatatataagaaattgtgcttatcctgtgcaatcatatttttgcaagctatgatggtaagtgcaagattgggtaacagccaatctgtttgaggtgcaaggaatggatttgagcaaaaggtttttgctgataacataaaattcacccttttcttctttccttggggcaattttttgttctgagttcttggtggagcatggacatcatggactgagcactaattctcatgctgagatcctcactaaattctgtgtcacagcctcaccatcttcgacatttacttctgagactgcggaggggcaggctgggaggtgggaggaaaaggattccttcatccactttttttttttttttttttttttttttttttttttggaaacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctctgcctcccaaagtgctgggattacaggcgtgagccaccgcgcccggcaataaaacacttttaaatgatctatttctccttaactttttgcaagtccattaagagatgatttatggtcaactgggtgaaatttcattgtgataaaagctgagtgagaaagaaaagtcccattagatgttgggtttttagactcttaaaatacaagtgaatacaggagtacacatcttaagatgactttccaaaaggattttatagatttttctactcattcagaagagtcaagaaaaaatctgaggccaagcgtggtggctcatgcctgtaatcctagcactttgggaggccgaggtgggtggatcatttgaggccaggagttcaagagcagcctggccaacatggtgaaaccctgtctgtactaaaatacaaaaattagccaggtgtgttggtgggcacctgtcatctcagctactcgggaggctgaggcaggagagtcacttgaacctgagaggcggagtttgcagtgagccaagatcgcgccactgcaccccagcctgggtgacagagtgagactctgtttcaaaaaataaaatataaataaaaaatctgaaagctacaggaatagacacagttaaacaaaaatgggctgggtgtggtggctcacaccttaatcctaacaatttgggaggccaagagctggaggattgcttgagcccaggagttcaagaccagcctgggcaacatagtgagactctgtcactccgaaaacctaaaaaaaaaaaaaaaaaggttgagggagggagaatgtgtacacacacacacacacacacacacacacacacacacacacacggatactttaaaaatattttaaaataaactttagggtaggaatagtggctcatgtgtataatctcagcactttggaaggccaaggtgggaggatcactccagcttgggaggtcaatgttgtagtgagctatggtcactccactgcactccagcctgggtaacagagtgagaccctgtctcaaaataagtaaataaataatttttaaaaatacttggctcagctgggcatggtggctcacgcctgtaatcccagcagtttgggaggctgaggcaggcagatcacctgagatcaggagtttgagaccagcctggccaacatgttaaaacccttctctgctaaaactacaaaaattactcaggcgtggtggcaggcacatgtaatcccaactacttgggaggctgagacacgagaattgcttgaacctgggaggtggaggttgcagtgagccgagatcgtgccagtgcactccagcctgagtgacagagtgagactccgtctcaaaaaaccataacaacaacaaaaaacctggctgggcacagtggctcagcctgtaatccctgtactttgggaggccaaggcaggaggattgcttgagctcaggagttccagaccagcctggacaacatggcaaaacctcatctgaactgaaactaaaaataaaaataaaaaaattagcccagcatggtggtgcatgcctgtggtcccagctgctcgggatgccgaggcaggaggattgcatgagcccaggagtttgaggctgcagtgagctatgttcgcactgcagcactccagcctgggtgatagattgagaccccatatccaaacaaaacaaaaaggcttcattttttagagcagttttagtttcacagcaaagttgtgcagaacataccaagatttcccctatagcttctccccaccacatgcacagccacccccaccatggacatcctgtaccagagtggaacattttttgcagttgatgagcctacactgacacatcatcatcacccagagtccatagttcaccttagggcccactcttggtgttgtacattccatgggtttggacaaatacataatgatgtgtacctgcctttatagtatcatagggagtagtttcacaaacccaaaaatcctctgggctctgcctattcatccctccctctttccaacctgtggccaccactgaccttttaactgactccgtagttttgctttttctagagtgttgtatagttggaatcatatatcttaaaatattaattgtatgtatattttttatggtgaatacacataggtgcacatacatataataattttattttcaataattttggggttagaggtaaacctcataggtcatctcttccagaaggcagaatagataagaattcctctcttcaaatgaagaaattagagggtacattcatttatcaagcacagtttctcaaatctgtaactatactactgggaaagactcgagatgatttttagggatacttgaatatgatgaaatcacagagaaagtgttttttgtttgtttgtttttttgttttttgttttttttttgagacggaattttgctctgttgcccaagctagagtacagtggtgtgatctcggctcactgcaatctctgccgcctgggttcaagtgattcacctgccttagcctctggagtagctgggattataggagcctgccatcatgccaggctatttttttttttaaattttgtattttttgtagagatggggttttaccatgttggccaggctggtcttgaacttctgatctcaagttatccacccaccttggcttcccaaagtgctgggattacaggcatgagccaccatggctggctgaaagttgttctttttaaaattatctttctagtcttctattagagagggagtctcagttcagtactggtttgtgttaactagttctctaaaagtgtctaatttccacttgcaacaaagagaaggcaagctttggatatgagtaaagacaattacatatatttattttcttcttattgagtagcaagtgattctagtttgtcatacaaagaagtgatatcatatttgtgtgaaataagtgcaaattaaaagtggtttgatttaaataaaaatattaagccagtgtacaggtgctgtatagatatggcaataatagtgaaagaaaaccttgaatgactgaagtttgagtcatgctgctctcatgtctataacatgattctctatgttctctatgaaaattcagttcacacgcaatttttaggaaatacttctggcaaactccgtatggttgccttctgtcacctgggtctgctactgtacattcacactaatataatgcgttgatggattaaattaaagttctgggcctggaaccaaaacgtgcaaaaagaccctgttctgtaactatgccttgtatgttgcaacacagatttccaagagagaaacctctcttctttgcttaggacattaaagaggtttggtgctgttcaatagctattatataagttatcattatgtatattggcgtttatttcattaggcaccattttccaccagaactaggaaacgctatctgcaaaactatgaaatgaacatgaaatgaggcataatagaatttttgaatgcaataatcaagacatgttttctgcagaaacacacgatggggtcaacccttccaatggagatgactacgctgcctgatgtgcaacgatcatgtcaacatgcacagctttccaaaggggagggagtactgagtattgaggcctagatggtgtttaaaacacaaaatgcaagattggaaaaaaaaaaaaaagaacccagctggaatgatgcagagtatgactccaattaatgggcaaaccaaacccaggtgtttttccccttttaaaagcagtccaatggaggacatttttcaaagcctccacttgaatgaagtggtgggtcccgttgacgtgactggcttaatttgcttcttttggttgccagaggctgcatttccatgatatttattattagctcatgtcctgaggtggtcttgcagcaatcaagtgaaaaccagcttgttctctcttcctctttccttcagatcacgcaattaaagattgagaataatccctttgccaaaggatttcggggcagtgatgacatggagctgcacagaatgtcaagaatgcaaaggtaggaaagtggattcctcaactttctcctccccacatacccctcaaattacccaggtaagccagcagcaacccagcacctccctccaccagcattcctgcccgtagaatgccaggcacatggaaatggggagaatgagccccctctgtcccattttctgataaccttcacatgtggttggcgccattgggcaacctggagaatacattttctagtggagagaaggtacgaagagttcggcattctccattctcccagggaacaaaaggcacagctttctcttctttctctgctgtctctctccctgtagggaaaccctttctctttttcttcccataagtcacagccgatgaatgctttttttttttttggcaacagctcttggtaaatgaaagagaagttaatgacttgatttcctgagggtgaaatacagacaaacttgacaccatgtggtgtccagggcactggaggattggaagctggtgctaaaaattgctcggtatttttacatatcctgtggtcatagttgctgatatgatgaatagaacgggctgtagcaaatgtacatagtgggaatttggtctgatttgaaaggattgtacaagcattgccaattttgtggaacattctctctacctcttgatgtgcttccaaaataacttaccatatggcaagcgaattagaaatacatcttgatccctctgaccaagaaggtttgtgtgtgtgtgttgtgtgtgtgtgtgtgtgtgtgtgtgtgtgttttctttttttctgtttggtgggtttagtgtttcaaaataaaatgagatccttttggatgttttccttatcctttctggaagatgtgaaaagggagagtcaggcagatagacagatatattcattcaaagaaagataagagacctaagaacataaagggagaaagaccttaaatctgtggttttaatattaggtttagaaatacatgcaatggaaaaattgtttttagatagcgggcttatcaggtcaaattttgcaagctttttaaaaaataatgctagcccaggtggcatgttcctgcagccccagctactcagaaggccgaggcaggaggatttcttgaacccaggaatttgaggctgcagtgagctatgatcacactactgcactgcagttgggacaacatagcaagaccctgtctccaaatattaaaaaaaaaaacaagagaatgaccctgtttccaaacattaaaaaaacaaggagtgtggtacatctgtgcacacattcctgttttcataaattggtttccttcaagattgtggactcacaaggtactttttgtggctaaaataggcaagttctgagtttgttatttaaaatttatttttggttttaagcatctacattttgaaattgattgggccatagggtcagtggaaaagatgacaacaaatatcatgttttagctgaaagaggttcaataattcacggccctgggctcagagtgccaactttctgttcctatcccattctgatggtgatttgccgttaaggtggcttagtcattgccacacaaagtcacctctcagtcctacaggcaaagttcctgctgtgcaggtgggagctgaagggagatcacccattcccacctgcaatcaaagggtttcatcatctcttacttcttccctcctttttacaaggtcaagggcagggggtgaataatagatttaaggtgtgttgaatcatcccttcaaactttaccagttaccacctcctactgattataccttccagcataactcggaattcagcccccttctgccagggtgctaattctagccaccaccagcctcctaactaatggagacccaaattcagttctggtctcctccagggactttctttaggcagccaccaaagagatctttgtaaaacacaaatcaggcaagttctctttgcagtggagaacatgtccaagtctcctgttgccatcactataaggtttggactcttttgcctggttagccatgaccttcccatctggcctggccacccccctaggtttgtccttcaccagtgtccccctaatatgtgtcaatcatgctaaaggaaaggcttcaaacctgtgttctttcctttatttttggcccttcgaacacacatttcgtctgtgtcaaactcttttccctccttctcaccaggccatctcccaaccatcactgagtctccttgtagcttttccttccttcaagaagctttccctggccatagactgtgtggtcagcccatgtctcccccaggacccctcctgggaatcagcccctcaaactttaccagttgccctccaggcttttctgtgtccgacccaggcctggaactttggaagatgattggacagatgacagccagctatgaaagtagagacaggtgggcatgtgcaggtgtgtgagagctcagatgtcagatgtcagtcatcaagggagtcttttctaaaagctctttttttttttttttttggagacagggtctcactctgtcgctcaggctggagtgcagtggcacgatctcaggtctctgcagccctgacatccacaggctcagatgatcctcccacctcccaagtacctgggactgcaggcatgcactgccatacccaactaaatttgtatgtttttattttattattattacttttttgaggcggaatctccctctgtcatccaggctggagtgcagtggcacgatctccgctcactgcaaccttggcctcccgggttcaagagagtctcctccctcagcctcctgagtagctggaattacaggcgttcaccaccacgcctggctaattttcgtgttttagtagagacggagttcaccatgttggccaggctggtctcaaactcctgacctcaggcaatccacccgcctcggcctcccaaagtgctgggattacaggcgtgagccaccacgcctagcctaaatttgtattttttgtagagacagggtttcaccatgctgcctaggctggcctagaacccctggactcaagtgatctacctgcctcaggctcccaaagtgctgggattacagacattacccacagcccctggccaactctcctaaagttctaaacacatgttcatttgtttgtgtacttacttattgattgattgattgattgagacagggcctcgctctgttgcccaggctggagggcagtggtgcgatcatgactcactgcagcctcaaccttccaggctcaggtggtcttctggcttcagcctcccaaggagctgggtgtccaggcacacagcaccgcatccagctaatttttgtatttttgtagaggcaggatctccccaggttgcccaggctggtcacacaactgtttatatatttaggcagatgactcttctttggcctgaattggctgtcctaaccatctgtcaaggtattgcagattgcttgaggcctggactaggtgtccttgatgggtaggaactttgcagatggaatggaggaaaagtgtggctagtcattggtagaaagtcagtaattgacatgttgagtcaaacctctcagcctaagagccatgtgtgtctttgtggccatgttagcagttgccctggaaaccagagggctgaactaaccactgatgaagttgggggagtagatgaggtcattggccaaggtctctggacatgtccttggggaaggagaaagagtgaagaagagtggttcccacagaaggctttggagtcagacaaacctggggtcaattcttgttctacatttatcagtatgagccctggggtaagtgatttaacctcatggaacctcagtattctcatctgcaggaggggcatagataagtatagcctctactttctagggttcctgtaaaaattatatgagcaaatgcctatagagtgcttgattcctagtctatatgttcagtaaaatttaactaatttggaggaaagctccccagtactcccaattttgcccttgttcagaatttattttgggtcattctcccaacccccaggttgcagtcagtagtgacaagtggggaatatggctctccagagtcagccttgataacagccaggcaggaacggcaggctcactgctaatcttgtaattctgtttcctgtcccctacacacccggtgacagctggctatgggagaaaagcaggagggatgaaatatcctctaattccaacaattggtagaagggagtgaggtgggattacagagagttaagcattaccttgcacttattccacagaaataacttttggatttgcttggcaaatgtctggctgttcccccatctacctcttggcccaactccctgtgtttggaaaacgcagatgatgtcttctttattttccaacattttttaatggtttctagttacaggagcaatcactgcttattataaaaatttgggagctatgggaaagcacaaagcataaagtcatttaaacatcctgtctcaagcagaccaattaaagggtgtgccaagtttatttagaaaggttaatcaatctgtgacttaaaaaaaatctaatcctaaaaactaatatttccccaaattgaagaacccttagattggtgacaaaggagttttttttttaataaaaactatttatttatttaggacagggtctttccctgccatccaggctggcatgaagtggcacaatcatagctcactgcagcctcgaactcctgagctccagcaatcctcctgccttagcgtctgaagtagctggactacaggtgcataccaccatgcccagctaattttttgtagcgacggaatctcactatgttgcccaggttggtttcaaactcctggtctcaagcaatcctcatgtcctggccttctaaatcatgggaattacaggttttagatggtgcacagacccatggacacatcagtcctgtgatttcatagatgttattgctcagaatgagactgagttctaagaaaggaagaaaagaaggaagcaaggaagggaggggagttaaggctgattaaagaggaaatattaactgaatagcagaacggctcgtatcaaggtttggggaacattgtcaagataatatgcaaagcacagaaatttgagaaacacacataaaagctcaaccacctacaaagaaaggcttgagagtgccattgctgtttgaaaccatctaggccctggttttttatagaacaactctttctttggactttgcttcagtcttcaagatgtattcaaacaagttctgaacttcctaggagccaaaggggctggagctgggactggggcagagtaggctttatggagagggtaaaagtagacctcgtagagagaatgggacctgaatctgttgggaagaagggttttctgggctgaagcaaggaagaagtgggcaagggtctaaaagtctagggggctggagtaggggtcagattctgaagatctctgaaagccagctggagtgactctatgacaggtatgaggagagctgctcctagaagtgtggaattgtagagatagaagggattccaggagacagcatctgatccacctgctctcttttgcagaatgggaaactgaggcccagagactcatttacttattcagcttttgatctgttgatttgtttatgcaactaaaacatttgttaagtgtttgctgtatgccaagcactaggcatacaaggatgaatcaacacacaggggaccagggtccatggatggaaacaggcccaggagctggggtccaggctgccgcgctgagcagctccagggcttttctactcgaccgaggagtgtctgtttcctcatctgtaaaaaggaagtcattacagagcctacctccaggcctgttgcaaggatgaaatgaggtaacgtgtgtgtactgattattattgctgcataacaaatgactcccaagcttaagctgggctggctgggacaccctggcttccaaactatcccatctgttctctgtgtgtgatgttaaatccaggccagccaaagtggctcacctgcgacaactttccccaacaacacattgggagtcttctagcagaggaaggaagtatacacttccacaaagagctcccagaccatcaaagtccccaagttccctacagttgcaatctgctagcccccagtaatgtcccataaatgctgcttgtggtgaaaagaccaggcctttgctggtcgccgttgtgtgcaaggggaagcaggaagcaccagggaggcacttttattttgtctgtgattggtgggtcatgctatttggaaggactcagctgtgcagttcttgctgaccatcagatggtggctgggctaccggtaacggaaggcaggtcaggcaggatgtccagcttggcacactcctgtgacccacagttgatgctgcttttggatgggacctcagctgttgtccactgaaaaatcagaatgtggcctctctagcttggcagactcagggtgttcagactttctcacggaagtggaagccacctggtccttgctgactgcaccttggatgtcaggtagtgtcacttctgctgcattcttttggttgaatgtgactcactcaggtgggttcagattcagggagtttgagaccagcctggacaacatggtgaaaccccgtctctactaaaaatacaaaaaattagctgggtgtggtggtgctcacctgtaatcccagctacttgggagtctgaggtgggagcattgcttgaaccccagaggtagaggttgcagtgagcccagatcgtgccactgcactccagcctgggcaacaagagtgaaactccgtctcgaaaaaaacaaaacaaaacaaacaaaacaaaacagaaaacaggttcaagaagggaggacaagttctctcttctacctagaaggagtgtcaaggaattcgtcgacgcattttaaaactgcctcagcaggcatggaagcacacagcacagtgtctggcccagagggacgctcgatcgctggtaggtgttaagacacggtccatgttctgttgaagccagatgccaggttgacttgcccaaggtcacacagtttggatgaaggggcctgcctggctgcaagcttgctttcttcaggatggagagaaccccctttccactaaactgggcttctgctcatcttcttgtaaccataaaccccagaatatgaacaagcaatagcaaagtccttcatctcggtatttcttagctcacctcacacagaatgaccatgagcaatgactggtcttttcaccataagaagtatttatggagcattatcaggggctaagtagatgatggattgggggacttggttggcctcagagttcttcatggaagaaatgaagctccctttacttccttgctctcttagtgtgctgcagacggcatcaggggcgtggtccctgaacctaaggggtaacttgaggctctacttttggtgactgggatctgagccacccaaccagagagtggatgggaaagtttggagtccaggatgtctcagccagactgaagcccacccatgactcagctccagtttgattattgaaaggactctacacagccacattgggaactgaccaacctcacccgcctctgtgggtgcttatttttaccctctctaccttgttcctgtagggtagggcttctgaaaatgggtgcaagactccttttgaaaatctagttaaagcaagagaccctctgaaagactcacaatatatgaatagagaaaaaaagtcgctaggtgtggtggctcatgtgtgtaatctcagcactttgggaggctgagacaggaggagaattgcttgagatcaggagtttgagaccagccagagcaacgtaggaagatcctgtctctaaaaaaaaagaaaaagaaaaagataaaaaaaaaaaaaaagattaactggacatgatagcctgtgtctatagttgcagttactcttttggctgagacaggaggattgcttgagcccaggagtttgaggcagcagtgagctgtgattatgccactgcattccagcctgagcaacagagcaaaatgctgtctcaattaaaaaaattcaatttcaagggatgtataaggcctaggtctcctaaaaggttaaaattcttctatttgaaccttccctcttctattacttccttcctgattttaaattaattttcagctcttaacctcaaatgatcatttttcaaactgaaggcttagcactcttgtgttctcatgcttgtggttaaaggtaatctgaatgcccaattaatgagaagtggttttcgagacaacattagacaaccttctggagatggcattaactcccctcttagggttgtaatttacctagccacatggcttcctccagggaagcagtgcatttatgtaaaacaagagcggggttgtgtctggggagctgagccagcctaagtgaagctgtaaaattgagatgtttttctgaaaggatctcatcttgggtcatggttatttgtcaaggcatggatgctcagaacccaaccccgccacattcccactttcccactcaggtacccccacccccacctaacccatccccagcatatctgctattcaggaacagggttgggagaaactcactcacccatctgtgtttttcctcatctttaatgaggtataattgacaaaaagtgtatatacttaggttatacaacttaatagtttaatatacgtaaatgtgagataattaccataatcaagctaattaacatattcagcacctcatatagttaccattttattttcttgtgtatatatatattttaatatatatatataaatatttaagatgtaccctcttagttaattttaagtacacaatactgtgctcttaactgtattcacattgctgtacgttagctctccaggaattatgcctcttgaataactgcctcttgaataacaaatgcctttgacctatatctccccattgcccttctccccagctactggcaaccaccattctcctctccactgctacaggtttgactattttagattacacctataagtgagtcatgtcatgttgatctttctgtgtccggcttgtttcacttaacaatgtcctccaggttcattcatgttgtctcaaacgagaggatttccttctttatttttaaggctgaatagtattctagtgtgtgtgtgtgtgtgtatatatatacacaccacattttctttatccattcatccactcatggatactcaggctgattccatatgttggctcttttgaatcgtgctgcaatgatcatgggagtgtagatatctctttaagatactgatttcatttcctttgggtgtatatctagaagagggatatacatatatccctgggtcatatgagagttctatttttctgttatttatatattgttttgttttgagataaggtcttactctgttgcccaggctggagtgcagtgtcatgatcagggctcattacagcttccacttcctgggttcaagcaatcctcccacctcagccatccaagtagctgggactacaggcacgtgccaccatgccttgttaatgtttttcaatttcagtagagacaagaccttgctatgttgctcaggctagtcttgaactcctgagctcaagtgatcctcctgccttggcctcccaaagtgctgggatgacagaacgtgggccactgcacctggctgatagttctatttttaatttttttgggaacctccatactgtgttccatggtggccgcaccaacttgcattcccaccagcagtgtgcaaggattcctttttctccacatccttgccaacatttgttatcttttgtctttttgagaatagccatcctaacaggtgtaaggtgatatatctcatgtggctttgatttgtatttcctcaatgagtaatgaagttgtacatttttattatacctcttatctatttgtatgtcttcttttgagaaatgtctattcaggtcttttgcccattttttaatgggatttttttcaccactattgagttgagttcatccacaattgagcagtgtttctcaaacttttggtagacatcacaattacctggggggcttgttaaaaaagatttctaggtctcactctcagaggtttgagtcagtggcttcagggatgggtcagaaactgcccttcaacagttttctccagtggctctgatggaggtgtcccctggtcacacttgggtaatcccttggttctagagaatgagtgagcactagagaatgcagatgaacacgtgattgtatttctgcaaacaaagcccatgtatgggccattttacacaaaaggcaacccttttctctacttagtactcaactcacactgaacattagaattacctgtagtcctcccctcagtgttctattatgaaaaatcgaaggcgtgtgagaaacatggaagaattgtacgatgagtgcccatgtactcactgcttagagtctacaattaaaattttgctatatatttgctctaccacatatccctccatccactcacctatccatccattcatctagccatccttccgtccctctctccctccctccttctttttattgatgcatttcaaattaaattgcagacatgagtacattttaccccaaacactacagtgtgcacatcattaactaggactcaatttttgttcacactcctgtattttaggttgaatttatatagggtgaaatgtacaaatgttaagtacacctctcactgtttggcacatgcacatacctgtgaaacccaagcccctatccaaatatagaacattcccatcaccccagaaaattctctcatttcctgcccccttgtcactccctgcctccttctcttcaccagaggcaatcaatgtcctgacttttttcactataggttagttttgtctgttatagaatttcatataaataggatcatccagtgtatactctttgtggaagacttctttctcctgggaagcttttaaaaactcccagtgtccatgctgttccccagaactataacatcaaattccctgggggtgagtttgggtgtcaacatatctatttttaatttcccaggtgattatggtatgcagccaagcttgaaaccaactcccctagaggaagttcctcgtctttgtccatccccaccctaagccgtgtcccccaatcacccaactccactaattaacatcctcacattaaaattttattttccaagagacctgctaccttgtagttgttctgaacagggaaggaggcagacttttatattagcacagaaaacatttatcattccttcagaaatagttgctttgggtgactttgccaaggtcatcctcagaagcgaaggtcaccaggaagtccttggcttacttctggatcatcagtggcctccacatgattttccccagaacaaaggatgccccaaggcaatccctttggtacagaaagcagtttgagaaagctgtagcattccagcttccagaaggattgaggccttggaggactccttctcaccaccctacccctgttccaaaatcatgtaaaagaaaagactaaacctaagtcatagttaagctggtttaaatggttaatttacaagactggactaaaatattggctgttcagttcagtactagactatttgatgaattattaccataaattcattaaaagtttagcttgaggctgggtgcggtggctcatgcctataatcctagcactttgggaggccgaggtgggcggatcacaaggtcaggagtttgagaccagcctggccaacatggtgaaaccccgcctcttctaaaaatacaaaaattagctgggcatgatggtgggtgcttgcagtcccagctacttgggaggctgaggcaggagaatcgcttgaacctgggaggcagaggttgcagtgagctgagattgcaccattgcactccagcctgggcgacagagcgagactgtctcaaaaacaaacacaaacaaacaaactttagcttgaattgtccttttatgtctgtagttttacaaagtttagcttgaattgtcctttgttgtctgtagttttacatctagcttttacccgcagaatccacacctgccctgtgagataggcctcttgttctccgttatgcaaacagggaaactgagacaaagggtaatgtcatgaattgcccaggacttttctccatgatttccgaaccatctccatagtttgagtcaaaaccgttttttgaatcacagaccctttttgagtagccaatgcaaatgtgaacctcttcctagaaaaagtgatcagctctaaatatttgacatttttgggtattcatacccatttgaagcccttgctgggtaagaacctctgctccaaaatataataatgtatatttacaaaatagtgtttattgagcaatgtgtccccagtgtgtgtgtgtgtgtgtgtgtgtgtgtgtgtgtgtgtgtgtatgtatatatattcgctaagcctttccatgcatcatttcattttataaccccaaagaggtggctattttattatccccattttatagacagaagactgaggcttgggtaaaggaagaaactagccagcaatggagtggtctagttcgtgcctggatactgaaggaaggcacattcacctggcctgacatcggagcctgagcttgatgctaccactctgatactatattatctacagatttaacaagtgggacccaaggccccaaaccaaaatttttacaagtggtgggtacttaaggccagggagagaagtgcctttgagtttcttggcacccctcaaatcatatagccctggttgagtcaacaatgggaaatttaggccttataaggtggctcatgtctattatcccagtgctttgggaggcagaggggaggatcacttgaggccagatcaaaaccaacctgggcaatatagcaagaccccatctctaaaaaaaaaaaaaatacaactattggctgggtgtggtggcacatgcctacagttccagctacctgggaggctgaagcaggaggaccccttgagcccaggagcttgaagtcaccgtgagctatgttcatgccacctcactccagcctggacaacagagtgagagtttgtcttaaaaacaaaagaaaaaaaccgacaatgggaaagttttataacctctttgtgccctcacccccattcttttttgaaatttgtataaatttagagagtacaagggtagcttttatacctggatctattgcatagtggtgaagtcgggcttttagtgtaagtatcactttaatagtgtacattgtatccattaagtaatttctcatccctcacccacctcccacccgtcggagcctccaatgtctgttattccatgctctatgtccacgcccaggttgtacacattctttagctccacttataagtgagaacattgtgtccccttattctcatcagcaacatggtacccagcgcccttctcctgctggtgtagtgtaaactgagtaagcactttgcagacttgaagaagccagtgattatttactatttgcactaggcgaaatccagccttgggtgtgccctctgcagtccctgccgtgtccgtgcatgttagatcagaacaacttcctcaagtgtattagaattagaatgttaagaaatcaagaaagctctcaaggggtgatgtggccccctttttaattttaatcacagattaaaatgctatcgagaagaggaatttgctccaagagaagagggatttcacagtccctcgccttgccccagtgcactgctttagttgtttgaaaaaggctgccagaaattgggtaaggatcaccaggaaaaaaaaaaaaaaaaaaacacaaaaatctgaacatgccagcgccccctgccacctgctcccatgaaaaggccaattcagtcggctgtagtggaaaacgttctcccgggtgttcattagctggagggaggctgaggatgcagtttggccgtggatttcaatattcccttgtaacgttttacaacccagacccagcgacaatggcgtcattcattgcactcgctcacgtggaacagaacatgagagaagggcagagctggggagaagctggtctgtgggcgctgatacccaaggccagctgaggtactcaggacccccagctcgtgttggggtcgggggtcccagactcttgtcagagcttgtccatgggatgcaggtgtagctgcttgatacagcagagagcagtgagatttgactgttgcaaactaaagtttctgcaaagagtaggatagatcagtagatcttgatattgcccgggtggagccaatatccaattctctcattaccagcatgctttataaagtgggatttgccaagtagttggtatggaggtaacaattgcttattattaagcattagttaggtggctgatataatgggcttatggggacttttatcactcatccccgttccaccattccccttgatatagggacttggaaggaagggcgggaggggtatgagggatagaaggctatatattgggtacagtgtacactgctcgggtgatgggttcatgaaaatctcagaagtcaccactaaagaactaatccatgtaaccaaacactacctattcccccaaaacaaaaaaatttttaaaatgtcatgtgaaaaaaataaacatgataactgataggaaaaaaaaaggttaaatgaggtcataagtgtggggctttaatctcacaggatggtggccatataaaaaagaggaagatagatagatagagagagagagagagagagagagagggagagatcatcccccactctaaccctccctgcctggcatgtgaggacactgagggaaggcggccatcagaagcgaggaagacaggcatcacccgaaactgaccatgctagcacccacatctccagaactatgagaaaatacatttctgtgtgtgtgctttttttaaagtattaggtggcgtgagttttggaataggattgaccctgggtgagactcagctttgcctcttagctgtgtggtctgggacaagtcacttgacctctctgtacctgccttttcttttctttcttttcttttttcttttctcttttcttttcttttctttcttttcttttcttttctttgctttcttttcttttcttttcttttcttttcttttcttttcttttcttttcttttcttttctgagacagagtttcactcttgtcatccaggctggagtgcaatggtgctatcttggctcattgcaacctccacctcccaggttcaagtgattgtcctacctcagcctcccaagtacatgcccagctaatttttgtatttttagtagagacaaggtttcgtcatgttgaccagactggtcttgaactcctgatctcaagtgatctgcctgcctcagcctcccaaagtgctggaattacaggtgtgagccaccgtgcctggcccatctgcattttcttatctctaatgtaaatgtaactgtacctgtgaaatgaggttcttgccaggatcaaatcaggataagcatataagtcaagcagtacggtggctggaacattaggaggcacttgaagaacaatgtagatgagaatgatgatgatgatgattaaaaaaagagcaggctccttttgctgcctgtatttctagagacagaagggcttttcaactttcactttaattctcttgtgtccttgcttcttcatggatgttcttaagctgtagaagaaaatagttttatcttctcatctggaggactttagagatttctgtcatactaaccacgtctctttggttgaccgttcctttgatccatggatgagctctgtgaaaattgccccgctgttgtttgattctaacattttctttcctttgcatgtgtaattctataatgattgagaagtcacttccccattccatgcccatattttgacacttgtcagaggggtttggggacatcgtatttcaggcattaacagagatgttcacgatcggtgttggggatgatgtttcaggctctttagagggaaacaagctgtgagggacaagtggttattgggatgatattgcttttcccacttctgtgttagtaatcaaaagcaggacttggcctttccagagagcaattttgcaatttggctgtactggaacggagaattccacggagtccattgatacattctcttgtaaactctctcagccaacattttttggaggttattttctttaattaaaaagaaaaactgttcctattaaaaatataaaaccaaaagagatttcccccttcctcttggagctctgacagcaaaatattggaactaaatagatctaaatagaattgtcggcaagttttgacaacttttataatgttttattgttattataatttttcttctttttctttttttcttttttttttccattacgtagcttgaaccacaaagcaagagctgtaaagctaattccattcccttcagcctcctggccccagggggagattctgactggtgcggctgctcggatggctccagctttggttctgagatggcacagggaagctgggctaggagacccctgggtgtcctgagggtgtctgtagactcatggaaacttggcagatgctctgtgttcctgcctggccactctggtgtgctttcacatgacaaacaaaggcagggacatagggtggagatgttcacacacttgagggggtagaagtagaaagagtcttgtaccccaaaaccctgctcccctaaaagcatattgtgttctaaaaattgaaagacatcattaggatacaatgcaaaagttatgaggaaatgattggattagaattctagttgtgtctctttctaactctgtgatcttgaacaagttgcttcatctccctgggcctcaacttcctcatctgtaaaatgggatcaaagataatacctatcacatagagtcatagaaaggatgaaatggacgaattcaagatccttcaaaatgcgttacgtgtagctctttgcgcatgatattatttcaggtatactctttaattttaatagttaagcattgattgattgattgattgattgattgattgagacagggtttcactctgtcacccaggctggagtgcaatggtgcagtcatagctcactgcagcctcaaactcctgggctcaagcaatcctcttgcctcagcctcctgagttgctatgaccataggcacataaacattcgtcttaattgcattaaaataactataattagcaccacaagcctgtaatttcacagatatgatcacttatagtgaagcttaacttatttagataaatgattaatttttaaaatgtcataagttaaagaatagatggctgtatgtcatggtgaaaattgtgtctgactgaagtttgggatttactgacacatgctccttctaggataggggttcttaaactgtttgatgccatgggcctctctggcagtgtgttgaagcctatgaatcatctctaagaataatatgattaaatgcatgaaatagaatacataggttacaagagaagccaattatatttgaaatatagttaccaaaatatgttttaaatggctgtttagcaatatatgcagtttgtaaatgccatgcccaagattccctatccccatcctaaatgctggatatgggatgttaggggtcaagctcttcttctctcacatacttggatatttctctctttgtcccttctatcttgaagcacccccacccccaccttctctctactcctctgcaaccttccacatcccatccattccccacctctctcatttcctttgagcctcctgctgctgcacagcacgactttccttcttcccaggagaggtttctactgagtccttctgaggaaaaaaaatgggaacacctggtatgaaatctgaaggtaagggaatgtggaggaccagtcctaagagtgtgaggggccagattttgagcacactgagggatgctatacctatgatgtcatggaatttttattatgcttactttgcctgtgtgagccctgaagctcaggggagggttgtgtgtcagatggacacacagcctgtaagggatagggatggggcctgaattgggagctgcgtaatcttagatcccatgctgattttttcttttcttttctttctttctttctcttttctttctttccttttttgtttcttttttctttctttctttttaaatcttctatgtccttgttcctccttctttctcattttctttccctctcttttttccctccctctattctctctgcccaaaacaataacagtaatgacgatggttgccatttgttgagcatttactgtgtgccatgtacctttctgagtcttttcatggttaactcattaacccgtttcttctatcaacagccctttgaactggggacattcattatccctactttacagatgggaaaactaaggtatggagaagttaagtatatcagtggccacaaggacagaagctcaggaggaaattctgacactagcagcaatctatccagatgagagtaacttaggattatacctgaccttcctaggttgtcagctaccagtttttactaactttgggcaatgacctgagccccaccttaaagatggacacccacaggttaagtctaaataaatactcagattaactagctttcaaattagggaatttaaagacatacatagactaaattgacatatttcaaaataccatgtgtgtttattgattgttaaaaggggttcttaactgggggtgtttatttacttttctgctgaggtatagaactgttggtaaatctacttgcctaatgtataaggcatgaaaaattagtacccaaatatacatttgtgaaatatgatggacatgaatataactggatcattttattcatcaaagacctcttttttttccttattctgtgacttttctggtggattctctcacacctggttcagccactcaggaaatctgtatcagggcactgataggcgttatctcccatcttttctctttcagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaaggtgagtgtgatcacccctggtcaatttgctttctttcttaccttttcctttccttgggttgggggtgagggggtgaggagtattcatttatttactttatttatttaaaaatgtaaacaacacaaaaatatatggagataagaaatttaaaccaaacagctaaaacaaaaagttcccttgacatgttcctacccccagttccagcccctcctttggagaaagcttatttgaaatgttcagacctattgtattcatttatgcacacatacacgtggcgagtgcagagaaagaactagatttatttttacttttttttttcttttttttttttttttgagacaggatcttgctctatcacccaggctggagtgcagtggtgtagtcatggctcactgcagcctcaaccacctgggcttaagtgatcctttcacatcagcctccctagtagctgggactataggcatgcgttcacacactgtactaaatttttgttgttgttgtagagacagggtctcactgtgttgcccaggcttgtctaaacctcctgggctcaagtgacccacctgccttggcttcccaaagtgctgggattacatgcctgagccaccacacccaaaattttttttaaaaacttttaatatagatgaaatcacactgtatgtattttgcaacttgctgttttttttcttttaaactttagaatgtgttttgggtatctttttatgaacctagactgccttattttatttttaactgctaaggaggaagaattgactggaaaggataaaatggagtttattttgtcactccctctggtaggcagggaggttgcttgagtggtccctgatggtattacaagccgtgatgcaggaaaaccccttgtgactatcaatgcttctctggcatatgtgtcagtgtttctcccaggtggattttgaactctttttttttttttcctgatcaaaaccaacacacacacacacacacacatcacaaatgattttccccgtctcatcccccatttaaatctactaagctgaggcattccgcagttttctttgccacatgagaaataaatggcttttttttttttctaagtcatccaagtccaaaggggctaagctaaagaaagaattttctggtggcccttcttgtgagccagaatagaagtgtttggcacaggtggtgtggtggagttcagctcgatagaaccattgcttggtgtgagctgtagatggtatggtggggagactgcagcctttggggacagagagatgcgggtttgaatctcatctctgctccctgcttcttgtgtgacctcactcaggtgttctagcctctcctagcctcagtttctcactttgtaaatgatatgtttcctaaagcatctgatagttagcaagtacgcagtaggtggcagccatgattgggtatgtggcagatatcgctccagaaggtgattcccaggaggaatctgcctcttgtctttggactggcattaatttaatcagtcttcccagagaagactgcctctctaggtgagagcttgagaagacagatacagaagggatggggtaggctaaagtttacatctgtggtctgtagaatcaatcaggatgaagttcacctttgcaatttaaaaattttcataagtagtgacaagttgcttaacctttccaagcctcatttttaaaaatctgtaaatatgggctcagggtacgacttgtctcataggcttggtgcagagatgtcaaaaaatcatacacatcatatgttatctcagggttgactcagaaagtagtagctgttttgctctaaaagacactaattttaatctacaaagtggcctgttgaacctcacagcctcagtggtcaacacaagcctttgtgaatccagtgcccagtgcctagccctttaggaaaaaataactcgctaacaaccaatgggaatggatgctttggtagctttttctggagctggggttacatgaggaaagtaacatagtttgactatttgacatttaccaatcttgcgttttaaaggagggaagagctgtcattggtatttacatggggctaggagctgacctggatgaggcctgacttccagacttacctgaagccaatccaaactccttgaatctcaaaggcctgaacaatatcactccaacaggccccctggcgtgactcccggcacgtctgctgccggatggactggagaccagatgcctgcaaatatgtctgcctctttaggcatgagcaggaggttaagaatgtcctatgggacacaggtccctgaatagagattctgttttatattatatttaagggtgcccttcctaagtcccagatcgagctttttcgacaacactatggagtagatgctattattaacccactttatcaatggggaaactgaggctcagaaaggttccaaacaaaaactgccagtggttcttgaaccccagcctggtctgcagattctatacgtgtgcatttcaccactactctataccgtcttggttacctttgctcatctgctacaatctcaaaatttcattttccactgaagatctgtctttgagactgggtcaaacatgctgattaagagctcaccaggtttgaattcgggagctctaatcgattaaattaatgccagaccaaaagacaggcaggaagaagttaaaaaggatcatggtgctttttaggttcaatatttacagcagcatccttataaatgcatccctgaaggatgcggcagggaggctttgaatgcacggttcacaaacctcttaggttatgacttgactttcatggactgtttgttggatccttggatgagcttaaaatcaacttggagtggccactggggaagctggagttgggggctgatccactgtagtaatactcacagttgacgacacttggcagctgtgtgcccaggggcaagttgttttacctttctgggcctcaactatcttttgtgcaaaatgaggataacaatagcacctgcttgatacggttgtgatgaggggaaatgagatcatccacagaaagcacctagaacagtgtctggcacctacaagtgctcaatgaacatgtgcttgccacaggcctgcccttgtgaagctcatacggttgcaagcaggtcggacattacacaagtaattataaattgcttaattgaaattgtgaagcctggcactgtggctcacacctgtaatctcagcattttgggaggctgaggctggaggattgcttgagtccaagagttgggactagcctgggcaacatagtaagactccatctctacaaaaaataaaaaattagtctggcatgttggcacatgccagtggtcctagccaacccaggaggctgagatgggaggattgcttgagcccaggagttcgaggctgcagtgagctgtgattgcaccactgcactccagcctgtgtgacagagagagaccctgtctcaaaaaataaataaataaaataaaataaatgattgaatgctataaaggagatatgcaaagtgttaaggaatatcaaactggagtgtcagtctagggtaggcaatcagggaagcattgaggctgagatcagaggagactgagtgctggataggagaagggggaggtgtgagggtatccacacatagaggaaagcatgcatgaagccccttggctgagggagagcctgccccctggggagtgaacagaaggctgagatgttggcactcaaggcaagggcaaagtggtgggggatgagggctagaggggaaggcagggaccagtgagatgccagcctgtataagccattttaatgaaagatgtcagattttatcctaccaccagtgcacgtccattggagggatttaaatttgtgagtaacatgcctaagttctttatttggaagcagtcactgtgctatgatagcacaggactatttagttggcaccagagacccattgaaaggctgtcatggggtttgaaacaggagatggtggctccgaccagggtgtggggagaagctggagatgtgggtggaatcaggccttagtggctggttggcgataacaaggtgaagaattaccccactactttgtggatttggaaaccaacactgaggaacttacccaaagtcactcagctcgtgagtggcccagcttgagatgtatactgaggcctgtgggctcagggtgaatggggtatgcaccctggagaaatcctttcacctttccagaaactctgcccttctcacctccctccacccccaaaagggagctcccagtgacagggaacattccaaccgagggctctctgtcctgcctaggagacaacaaatagcaattcatcatcagcctccacactgtaaagtgataaggaatcagccgaggtttccttccagttgggattctcattaagtgataactccatgggtggttttccccctggcccctgcctgccccactatctgacttcccctcattgtctgtctcctttccaatgagcccaggagtcaggcccaatgaaatgtcacagggccaggcaggccggagggctccttgtgtttggaaccggctgtctccaaactatctctcccgatggactgagccaaaaaagctgggaaggtcttttatcaatgccactcaatcaaatccaggaccccagggcctgggagagcacttgtctgtctttctccctctcacccctgactctcacccccactcgcattagaaactaaaagcaacccaaataaagattctagcaaagccatgagctgaatcagatattcaaaggaaagttagagattgagaggggaaggggaattcgatatggaaaagggctttgcagggtgcattttctgagtgctatgttttaaaatgcgatttcacatccattcctttgctgattctccagttccctgcagcagtctttggactaggggagatgccacccatctctattttgcagggatctaatggaggaccaagagacagggttagattttaagcttatgtggctgatgattggcagatctgggatggatgcatcagattaatctttatttattgagcacttaatgtataatggacactgtgctaggtgcttgggataagtggaggacatggtggaaaaggctcccgctctcaagaaacttgaattcttactggatgagacatataataagccagtaagtaaatttattggtttcaggtagtgactaggtgatgtttcaaactgagtcttttgatttctcgttgagaatcttcgcacaataccattccaacccttcctactttatgctaagagcatggggacaccaaaaacaaataacaacaacaacaaaaacaacaacaacaaaaagtcatccacccactcatccacccacccaccaatccatccacccaccattcacccatccacccacccatccacccactcactcattcatccatccacccatccatcactcatctatctatccactcactcatccatccacccactcatccatctacccactcatccatccagccatcaccccacctatccacttatccatccacccacttatccatccccccacccatctatcaacccatccatccacctacccaaccactcactcatccatcaacccacccatccattcacccatctacccacccacccatccatgcatccatccacccatccaaccacccatccatccacccactcatccaccaatcctcccactcattcattcatccatccatccacccacccacccacccatacatctatcctcccatccatccatctactcatccacccactcatccataagagtcaaggtttgctaccttttcatgttggctgagcatgtagggttgcatgaaatggaaagcctggggccatctgtcagaatgagcactgctttgtgagtcagaagacctgaattatagccaccttcccaacttgctgaaggtcactcagctagaaagattactactctgagtttcagggtctctgtctgggaagactcgccaatggttcttcatctgaatgaactgaattggcaagagaaatgacccatttgggaatagtgaaaatatttgctcaataggattagtatttaaaagcactctgtgagctttccagctctgtaatctacccaaatactattaagtatgggacaactttcagaaagctatctatccagtcttccaaaagagaaagagggaaaagagaatggacccaggtcatttggacagacaagatttgaatgctttatgtgcaaggaagataaaaactcaactgccctcattattacctcaattaaatctcataaaaagttcaggtattatctccatttacaatcaagaactgagattggaatgacctggtgattcatccagtcacatggcgagcgagcattggagctgtaactctgtgccttaatatctgtgccttggatgcattactaaattcactttatccggaatcaaaaatatctagaaaaatccaaagtactagggttttctacagtgccatgccataatgagtggtcagaatcaggaagaatttactgttacctaagagactcatttcggtttaggatagttgcaatataactgaccactcttaatatgcaactttctgaagccgagttgtggactcatctcatcagaagacttgatacttaagtatagcccatttaccaaccctgaaagttaatcatgacttggctggagataggtctttgctgttgaacagttattgggctctcaaagaagagaaaaaagaaagaaactgagccataaccaaaataaacacagagattacatccagagcatttatcatgactgacctgaaatttggatccttgagttggaatttctttacaatgtgatgaggcctgagaggaatttgagaatgttcaggacctgctttcatcaataagccaagattgagtttttcttagtgctctgcattagatctttggggtattaaagactggaatgtataattttacgattttccaaaatgtgttccggccgttttcttattattcttccttttttacttgtaacaaatctggaaggggatcagaaacttgaaaatagttagtttgccttgtttttttttcctcttgctaagggtgccctgcagctgtactttctattattgaaaagggtaacaccctggttaattggaaaacccaaaggttatgattccagcaacaatggaaacactcaggtttatgaatctgggggaaggaaggaagagttgaaggaaaggaatcaagggaggaggtggtgaggacaaaaagaagctgagtatagcaatgtcttcaagcctccaaacaaacaaacaaacaaacaaacaaacaaaaaaaaccccgcacagttaaaaggtgaaaaatgtggccgttcattcatctggatgttttcaaacatctgcatggttggcatgatgtagatagaacacctggaagagtgtgtttttcttttttttttatttttggtacaaatttttttggtatcctataagtcccatatgtggcccagaaagagtctagtggaaataagtttacttgctgttaagtgggcacaaccctaagagatatgttttgtttgtggatacttttggcttatctgtgggtgtcacttggacattgatacaaatggagctgattggtggaatccaaacccaagctactctacctgggtttgggagctattttacaaaccagtccaaagccaaaggatttagtcttgagtcaatggcttacttgtgtctttatatctgaggaccacctctcagtcacagagtgtcagcctccctcacttactgctcatggtaggatagactgggattgaggacatgcaccaaaaacgggatcatgttcaccactctatctccagcacctggcacaatacctagcactttggagcagctcagtaattatctgctgtatgattgcatgagtggcactgggtattagaaatctagagagttggaagcaaggtgtgtaggcaaagtcaatccaatctggcttagattccagcctctgttccttctcagccatgtgaccttgggcaagtcacttctctgagctttagtttctgcctttatgagacaggcattacagcagacaccttgaggaattactgtgagatgaagagtaaggtcatgtagtaggtactcaataaataatagctctgatcatttcctctcgttatttagttcagcattctgttttcatggccatgagccatcacagtgagttgcatggatgccccagtgtttcatttttcttcacttctccaaagacagacataatttcttaacatttattgactagaaagagacagaaagatgaggaaagagaattttcagtttggaaggtaaaatttcagataagtaatgagtctgtgttgaggtttatactttggtagatatccccaagtattgcttcccctgaagggaatactttgagggtattattgtgaattatgtctgccatgagcctgactggtggtgttagccctgcaacaagagctgttcatgttgacggaaatcaggagactttacatgctcaatcttagttcttagctacccagtaaggtaagtattactcactttgattcagagatgatgatgagtctctgagcgtagatgccctgctggtatcacgcagatattaagtaaaggagcctgattcaaatccagacatgtctaggcttcttaacctggggtctgggttttagggagtctttgaaccccctgaaattgtatgcaaagccttgtatgcacatgcagttttcaaaacattgtgtttcaatgcagttttctaggaaagagcccagcactttttcttgttttcaaaggggccagtggccccgaagtggtgaaaggagaccccctttcagagacaaaactatctccacttccctacactaggaaatgactagtacacagggaagggaagggacttgctcagcaggaaacagcaacacattaacttgtaccaacttaacaaatactaactaggcacatgcttacataaggaatcaggaaagaatttgaacattcattcaagctccctcccactcatccatgcatccatgcatccatgcatccatccatccatccatccatccatccatccatccatcgtacaaatatttattgcatgctttctctatgtatcaagacagtgaaaaacaagggctttgtggtcagactacttggattctaatcctggctctactgtttatcagccatgtgaaaccttgggcaagtttcttaacctccgtgagtcctttttctctcatctgtaagatgaggataatagtaaaacccacctggtagggttgttgtgattaaatgtgttacttcctggagagtgcttagaatcgtgctacgcagagtacacactgtatatgtttgttttgacttattgttgatgctgttgttaatagtaggtgtttactaggttctgggaatatagtcatggataaggcagaaaatgtcctgcttttatgaaatttacatgctggagaagaggaaagataataataattgctatttatttatttttgagatggggggtctcactatgttgcccaggctggtctcaaactcctgggctcaagtgatcctttttccttggcctcccgagcagctggaactataggcgtgcacaactgcacctggttagttgctatttattgagtgtttctgggctctggactaagtgcttcatgtattttcccatttaattctcaacactgccctttgtaggaagtgctatttcctaccctttccatcttacagatgaagaagctgaacccagaaaggtcaaactgtttgcatagaactccatagcccaaggtcttaaccattacaatccaaccccctttttttgtattcagaatggcggttagggctaacagtctctcaggacttattcttcagtactttggccaaataactgtctccacttttagctgcctggtgcctgctcctggcctcactgctgtctctcctgtcttcacagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccgacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaatttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtacaaggaagttgaacacccattttttttttttcctgttctttctaccgactgaatagaggggataggaattggaggaaacaggaagaggttgtcttgcatgtgaatttctcacctcacgtgatttctcatgcccatcgcaggagaatttgggatccattgtccttgagtgtgatgaagctgaatatatgatccactggtttatatccttggaatgaggttacttgttttaatggaatttgtgtaggcactggagaagaaaagtctttaggaattccaacctatttaaaatggtatcggtcatattatatgtaacacctaatgtttgggtttttcaagaatctctttctctgaattaattgttggagccaggcgttttgggggttctactgcaaataactttatgaaccatcagtgaatcagatattgattttaaatccatggatctaggatttgtgaacttgagctctaaaacacatatgggacagaagagagcagcaaattggtgagtacatttgtgcagcagatttgttctgtttttgtaattttgatgcccgcatccctcaaattatcaagagctatcaaatatgccacatccccttgaaaaagaaacaattggct

SEQ ID NO: 11772 - DNA, 61922 bp, Human
  misc_feature (1)...(61922): n = A,T,C or G
aagttaaggaggaatattgtaatacctagagcaaacacacacacacacacacacacacacacacacacatgcaaacgaggtgtagctaggaagccagtagagaaaaaaaaattatcccaaaagaaagcagaaaaagagaaacagagaaaccagccaaaaagatagaacgaataacaagatagtaaatgtaaacacaaccatcaattactatactaaatgtgaatggactagctcctttgccttccctggggctgggagtgcaggatggactcacttgcacaattatgtcatgtttgctagggcttgggctagggttgtggacttagcatacttgctgaggccagtgcccaccccaagtggttgctgacagcagggataggctaaggagacacctaagtggctggagattggttttatatatatgggaatggagcagataactaaatacttaggcagagatgtaaccaggccatgtgacctgaactttgctccagggcattgacactgctgttaaaatgcttctggcctagaggccctctgcagccaggggaggtagatggagcttcagcctgaaaacccaggtcagagggcccaagtaccctttgcagagctggcttttccccttgcaaattgctagtgacgcttcagctgatgtgtgttactattaaggtcctagtgtttgggagggtggggcaggaggtggaggattgtcagaaaaaaattacatggaaaaagatggcatctgagatgttttgaaagataagtggaattttccaagtggaaaaaggaaggaaaatcagtcagataggaaggcatggagcattggggaatgacaagtatcttcttggactagggtgggagatgggctggagagatgggtcagggccagttgtctggcatcttgtgtgtctcagaagagggtgggcacgctgcgtagggaagcccagggccactctgaaagccctaaaggggaactgatgcctctggccttgtttttatcaccatcaggactacccattgaggcaggctgcactaccagctacttcctggtgccctcttgctcatagccatagtattttgcctctctgagcttccagaggttttaagtctggggaagacccagggactcaaagaaagattggggtgggagataaggggccacagtttgggggagtcaggcaggaggcctttgaggaaaatagataaagtcccaaagcctgtgagtgtgaatttggaggcaatatgctgtgttctgaaacgttttcagacactggctaggtgcaagcaagtgtttgtagggcgaggctcttcatggacctatcactgcttacgcaagcttgggatgtggtcttgccctcaacaggtaggtagtctaccggaaaaccaaactaaggcaagaaaaaaattagtgaataataaaggactgaaccggttcagagaaggcattcagcagatgtttgccagtcaaatgaattaaagtgtgaatgaatgaaactcgaggtagtgggtgaatgtgtcccaagaatccagcgaaacagggtctcccaggaggcgggactggaagggtccggagaggggccacaggctcctggcctttctaagcacaccaagtgcccagtcgcggacccccgggaccaggatgcgctgacgacccggctggcaggcgggtcctcgtgggcgaggcgagggaggcggcgagagaggagcaatagtttcccaccgctccctctcaggcgcagggtctagagaagcgcgaggggatctagagaagccggaggggaggaagcgcgagtccgcggcccgccccgttgcgtcccacccaccgcgtcccctcccctcccctcccgctgcgggaaaagcggccgcgggcggcggcgcccactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcgcggccgcggccccggccgctctgggcgactgtgctggcgctgggggcgctggcgggcgttggcgtaggaggtgagtgaggctccggctcggcagcgtcgcagctgccccaggatctgcgccgcggtcaagttgcggacttggagccggcaaacgcggagggctggtcccgcgcgtctgcgctgggaatgcacgtgtcctggctggcgcggtcggagccgggagctggggaccttcctggcccggcggtggcggggctgagaggtgcctggtgcctgggagcgggtcctccgagacgccgaagccatcagccaggctgagcgccttcccggccgccgcggcgcgcacggtgcggtgggcgcatctctgagccccgcgctcacgcggggctgcgcgcgtcgcgggtggtcctggtcgggccaaggacgactggcccaggagccaaggcgaggtggggcttccgggggttgttcccgcgccttggcagagggatgccgctgtagcttcctgggtgagagcgtgcgcgcgcgcgggtttgccagtttccccacatttccaatttctcctgttacgctttctccagaaggttttttcttttccttttttctttctttctttcttttttttaccttcaacttggcttcctgcggggttgttttggagcaggatgagggctttgcctcctccagtgtccccaggtggcagcggtgcctctgctcccagggcagaccctgcacccgaaaaatctctagtgtattcggggagccatgaaaaggctcccttgggccggtgggatccttggctttgtctctggctgctgcgcacaccgtcagccgtcagggcaattggcattcggcctctttggtactggggacacaggtggagggatggagcgggcacagcccggggttgctgcccgtggtcctctctgagtccttggtgattttgcctgggctggagagaaaccctggctcctggtctgctggggccgcctctgcctcagaggatgacacaagagtgcatgtaagtatttttaataaaaactgtagtactcgtaaaacaatctacaccctgcagaagggatttgttattttattttattatttatttatttatttatttatttttgagacggagtcttgctctgtcgcccaggctggagtgcagtggtgggttctcggctcactgcaacttctgcctcctgggtttaagcgattcttctggctcagcctcccgagtagctgggattacaggcgcctgccaccacggccggctaatttttgtatttttagtagagacgcggtttcaccatgttggccaggctggtctggagctcctggcctcaagtgatccgcccacctcagcctcccaaagtgctgggaatacaggcgtgagccaccgcacctggccaggatttattttaaaaagggaagatttgttgataaattcacttcaaagataaactattcgaaaatactttagtgattcccgtcaagactcttctgtgtatgtatagacgtataactcattctggacagggcaaggatatctttttttgtttgtttgtttgttttgagatggactctcgctgtcgccaggctagagtgcagtggcgcgatttcagctcactgcaacctccgcttcccgggttcaagggattctcctgcctcagcctcccgagtagctgggattacaggcacgcaccaccacgccctactaatttttgtatttttagtagagacgggatttccccatgttggccaggatgatctcgatctcttgaccccgtgatcagcctgccttggcctcccaaagtgctgggattacaggcgtgagccaccgcacccggccaagggtatcttgaaggagggattacagttgatatgtagaggaatattgcagtggttattgctgcatttcctatgtgactgggactaaaacagatcagctgatagtgttagcgtgcagtgagcagtctgatgactatgacacagaaataagaatctccagcattctgccctgggacatgtggagccttgggtcagatgctgctggctattgatgccgggaatggagaaatccaccagggcaactcagtaaaaataaataaataaataaataaataaatacataattaaaaaaagggtatccttgtcctgtccaggatgagatgcttgcttccatgcacttacgacaatttttgctgtcattaaaaaattttcacattcacagtcttctaaattcactttggagtgtattggattccactgcattgacatacgtaagtttgcattaaaagatcctttaagatatctggtcaggcacggtggctcacgcctgtaatcccagcactttgggaagtggaggtagaaggattgcttgagcccaggagttcgagaccagcttgggcaacatagtgagacctaatctctactaaaaattaaaaaaaaatccttaggcgatctgttcacagattaatcttgtgattggggcgattccagaagtggtaatgggttgtgctgagctagccccacactctctctgagaagcagtgtacagtagtgtttaagggcaggggctctaaagtcagacttccagagtaataccccccccccccaacctcacaaatcagtttctactatatttatatctgccatcccagtgttggtggtagggtcttcagatccctggggaagcagatggtgggatgagagtaggagagttgtgttgggactccaagtgttgaaggggcacagaaagagctgagtggcacagagaggttgtcccagagtagcggagtctgctttggggagaagagagattgactgaggatagcatcaagtttttcattttatgtacaaagatgatctttttagcttcacccaggaagtatgggttttgtgtcttcctcgtgtttaggtttttattctgacctaattaggtctaagctgaggtgcttatttctcttctggagtttatatcctagaagctctccaatcgaagccctctgcaggtatcctcaggtcctggagaaacacagcaggaaggcttgttggcttcggaaagggagggctatggtttaaagccagtaagatgtgggtttgattcttgactttgtctcctgtaggctgtgtggccttaaataagttacctaatctcttgagtcctcagtttcctcatttgtaaggcagaggaaacaatgcctatgattatgctgattaaatgaaacagaggcacaaaataagtgtttaatgaatgacaactactattgtcattattcttcctatccatgctatctgccatgtattggaggcaaaagctgttactacttcatgcatatgcgctatgcaggcttccagaatgaaactgatggggtccctttcccccacatatgtgagagggggtccctcttatttcaactcgttcctcattgctggtttggcatatctcagctactctaacccggcaagaatccacagaagaagccaagaaggaaaaaggcttatacatttgctttacccataagaaaacctcaagccctgtatctgaaaaaagaggaagataaaaggatctataagacttcaagttccatgagaagagggacatgtctattttgttcaatactctatgcccactgcctggcacataggcagcaaaacaaatatctgtggaatgctatgtaaaggcatctatagatgatgtgcctccctttaagaaacccaatatttgaatatttgcactcattcatacaagatcctcaagtgctccgtttggataatctggagggtatgaaaacatagccaagatcatgaattctttgggcatttgggccgctgcactgttgcaccatttagacctgtgatctgagagtgtgaaaaactcaagggatcctctgtaaagtgtctgcctttttttccctcctgggaggagccgttagaagggcaacattctcctttctcccccttggacgtgtgggtgttggggcaagggtgaggagtgacagaggtctcctgggaagaccataagatggggcaagcacaccacagtgaggagggggagtctggctatgactttagaatttcctgatcgaaatttctcctctaaagctccccaccctacttgggatctgaggttatcatcccctcccagtcccaagaacccttcttcccttgttggcagaaatctccaggaagcatgcccacaggaaccacaactcatgaatcagaagacagataattaaccgagggagtgactgagcagcttcagggatgaaccgcttcgttttacccagccctctctgctgcccacagagtgggctgctccaccccatcgcctctgctccctcttcctgaaccttggcccttcctgagtgggaccttcattgtgcctgatggagctcaggccactagtggaaatgaaggtgggagcagggaaatgactctgtttaggggaactgcctattccccgtgtgggaactgctggcatttattgaaacgtgagactctccagcaaaaaagtgatagcatctgcctttctgtccacacacacagtctcaccaaaaacactctttttttttttttgttagataattcaggtataatttatgtacagtaaaattcaccctttttagtgcatacagttctatgaattttgacaaatgcatatagtcaagtaaccattgccatcatcaagatacagaatttttccatcatcccctaaaattcccccaagctctttttttcccttctttttctttctagaggcagggtctcaccatattgcccaggctggtctcgaacttctgagctcaggcaatctgcccacctcggcctcccaaagtgttgggattacaggcgtgagctactgtgccaggtgcccccccagctcttttgtaatcgataccctaccctcaaccctcgtcggttgcaactgctgatctatttcctgtccctgcagttctatgttttacaaaatgtcatataaatgaaagcatgcagtgtatagactttcagtctggcttctttcacttagcacaatacatttggggttaatctatgatgctgcatctatcagtaactctaagacattgtctgaggccactccgtcatcctccgtgttggaacagttaccctgaaagcagtgggactggatccgttaaactttggaggtgctccccagctttcagcttctaaattttataattggatagatgtatttagctatatataagtcattagattttccatgtgctaagtagttaaagacttcaggatactagagaggattctgtagcaaccaacacttattattcttgctcataggagtaacagatattttgtggccaaatattgtatgtcatgatgcttggagtcagaagttgttaagtaaacctgggggctattctacctttttacatttttggtagcatctctgaaaaaacaacccacttgactttttttttttccttttttttgggagggtgggtgggtgggtggctttttggccaaaaccagaaagcttgctagacaaattctaacactagatctaacactagatgtcttatttctgtttttctgtcatgttcccatgaaaagactatttacttacccccctctctcggttttatagttgagttagttcaatttcttagttcagttagtgaagatgtttaaatattcaaggagagaaagaaaaagaacaaggtgatacacattttaaaaaagtcaaaataacaaatattgttatttcttggctgggcgcggtggctcatgcctgtaatcccagcactttgggaggccgaggcgggcggatcacctgaggtcaggagttcaagaccagcctgaccaacatggagaaaccctgtctctactaaaaatacaaaatcagctgggcatggtggcatgcgtctgtaatcccagctactcgggaggctgaggcaggagaatcgcttgaacccaggaggcagaggttgcagtgagccgagattgtgccattgcactccagcctgagcaacaagagcaaaactctgtctcaaaaaacagaacaaaacaaaacaaatattgttatttctcaaataggttcatccacataggatcattgtcagtcgttaaaattgctggttcccttctaattctattcccctataatgttcatattaatcaggtggtgtgttctgtttagacatttcccctcgcatttatgtttatttgtgtgtgtgtgtgtattcctttacttaaacccatgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttcccaccaccttcaactggaactcctttaactaattaacaatttggagttcatgtaaggatttctttgggaaaaaaagaagatcctgctgttaaaatcaagcttgaaaaactttgcactagaagagagctccagaagtttggcaaaagacatattcagtagccacttaaaaagtccctgtagtcaaccctacatctctttgctaatggaaattttggatagagaaacctgggtctgtgagatccactgatggctccagaccccaactttagccatcgcacgtgttgaactccaggttgagcctttgctggagccgcctgcaaggagcatgtttgaccaatccccagtggaggggagggtggtgtttcctttctgggacttccacaagttgagaacagaccatgctgccctgggcagttcttgaaggctgtgagagtgggcctgacaaagtttattccttttttttttccattctcttttattattattattgtttgaaattgacaaataaaaattatgtatatttatgatgtacaacatgatgtcttgaaatatgtgcgcattgtggaatggttaaatgaagttaaataacatatgcattacctcacatacatacttctgatttatttgtggtgagaacacttaaaaatctcctcccagcaattttcaggtagatgacatacggttattaactatagtcaccatgttgtacagtggatctcttgaacttattcctcttgtctaactgaaaatttatatcccttgaccagcatctcctcatgcaaaccataccccaaagctcatttctgtgttcctgctgagtttgccattccaagaggttttgatgctgaaggtgcagtttgtggaaagcccagcagactctggggagcctacatttaaataaatgcaaatgtcgacagggaggcagaacagaggacatttcaaattagctttaattttcttttagcttataaaagtaattaagcttattatttaaaaaaaggcagctcagaaatataatgcagaaagtaccagtaccagttccttgtagtcttgtccttaaagataaccactgttgatagttactgcagagtttttttctatgtatttgtcaacatatataattatttatcattattgttatttctcaaataggataatcaataataggatcattgtcttttttttttttttttttgagatggagtctcactctgtcgcccaggctggagtgcagttgtgtgatcccagctcactgcaacctccgcctcctgggttcaagcaattctcctgcctcagattcccgagtagctgggatcacaggcatttgccaccacgcccagctaatttttgtgtttttgatagagacagggtttggccatgttggccaggctggttttgaactcctaaccacaggtgatccacccgcctcggcctcccaaagtgctgggattacacgcataagccaccgcacctggcccattgtctcttaataatatactctaggcatctttttatgtcagtttatggctttccattatttatcccaagagctataattctagccataaggcatactctttgttatatggatatatcagaatttacttaaccaattccctgttggcagacattgggatcattcccaattatttgctactacaaataaagctgcaggggatatccttattcatttattatgcacctttgttcaagtgtttctacagacttaatttcttgaatgaaagttggtgggtcgaagggcatgcgtattttaaatttaaattttagtaggtgttgtcaatttgtcctcccaaacggttgaaccagtttgctttcctaccaagacaggctggcagtaaggactggtgttagcaccgcggcctgctgtccacacccataacacatgagctgggggaggaaggctgcagaactggacagcaggatgccaaggaggtcaccaatagggcacccctgggctgagcctcggacagcttggtacagacctgcttcttctgtatactgaatgaggtggggtcgatgctaataaaaatttccagaactcttgagatgcagcgtttgagtcaaatatcaggccatcaggaagaaatggccacttgtgccttgtttgagggttctcatgccttgggttgctaggcttcctagggtatgagtccccctgttgatgttttctggctggaagagtggatacttccaggactggcagcaccttgaagatcatcaaatttgacacctgtttgttttacaaaaaagcaaaaagggagttcctgagaagtgaagtgacttgtccaagatcatacaactggctcagtggcattggttgggtctctccctggggactcttgtctcctgcccagagtgatttcttcactatatcctgttagagacaaagggccctttcacgtctgaccctgaggtggaggcgaggggatggggattcctggtgtaggaagtgactagagtgaaagtaagggggaaggaaatgaacatttattgagcatccactatagagggttctttcatacgtgttatgtcatttaatcctaacaactcgggagcactggggaaaggaagcagctgtttggagtctccggtgcttggccgatgtggctggttagacccgttaaatactacagagcagttatcacttctcgactatgaatgtgacatagactcaaagaggcactgggccttggagagagcaccagagagatgaagggatgtacttgaggtcatacggccagaggaagggcaaagatggctttagacgtgaggtttcctgctgctttgcatgctttttctgccatatccatctgttgttttactgctcctgccttaccacatttctcaggagctgggtgttaattttagaccacaaccttagagaagacaggactctgtccctggaatgggctttatgcagtcttcagcacatggcgacctaattaacctcattggagatgataaccagacataatgtggcttcatttacaaggacaggacctgccctagatcttcccattaacatcatcttgaagtgtcagctccacagagagacctttcctgaccacatgctttaaaggagactccttccctcattgcttgctattccccgccccccccacccccaccctttcttttccctttgaggcagagtctcactccatcacacaggctggagtgcagtggcacgatcttggctcactgcaaactccgcctcccatgttcaagcaattctcctgcctcagcctcccaagtagctgggattacaggtgcgtgccaccatgcccagctaatttttctagttttagtaaagactggatttcgccatgttggccaggctggtcttgaactcctgacctcaggtgatctacccgccttggcctcccacagtgctcagattacagtgttagccaccatgcccggcctatcctgctttattttcttacagcatgaagggtcaatgaaaggatatggccagtggtcaagacatttgaactttgtgtacagggaatccccttgctcagacaaaaatccttcctgtttttcccttgtgaacaaaagttctctgaaaaggaattgggaggaaagactttattccaatgaacagtttggaaactggggaaactcagctgttggtgtcagaattgggggtttataatgaaagttcctgcctaggatcctgatgaggtccacttatgcaaatgaacaattccaacttgcttagttctgtttggttgaaacaactgaggcctgattggtcaaggcagcagagccctgactggttattttaggttagctctggaggtcccaaagttgaagagaggtgttgattttcagggaactcaaagtgggttgtgacctctagtcagcaaatggcagctttgctctgtttaaaatttaggcccacttagccactccagatctatcttgaaggactggctctttcaggttcacatttgttcacaccctcatgccccatgagccatccatcagcaagtctttagatggaacgtatctagagtctgaccacatcagtggctccgctactgtccaaatccactgccatctgttgcctggattattttagtacatttctaattgaataataagtctctttcctttttgcttcccttctttctgtcttgcactcagcagccaggatgatctttttttgctcacctctgctcagattcctccagtggcttcccactatgtggagaaaaaagccacactctctaccatggcctatagcttcctagtgttctggtccctaactgctcctctaacctcctctgtgcttttctcttcctcctttctctccacctgctatttctttaacaggctgatgtccatccagatcttgccttgggttctttctggaatgtctgtgccttggatcgtcccaggattcactctttaacatcattttgaaatgtcagctccacagagagaccttttctgatcacatgctctaaagagagtccttccccttattgcttgttattcctttatcctgctttattttcttacagcatttgccactgtttgaaattgtgcatttttgttgtgtattttttgttaccatcttcctcactaaaatgtaagcttcacaagagcaggggctttgtttagtttatcagtgtgtctccagtgcctaggagagtgcctggcacaggtagatgctcaatgaatatttgtcgagtaaatgaatgaatgaatcaatgaatgctgacaccattgatatatataggtagaaaaatgtacagctaaagtaaccatttttcaaaccttatccatacgtggattaaatgcaacaaaaatttcatttcatgctggctttttttcaatcatgcaaagtatttcacggcagtgttcttcaaaatcatgccatatacatgatggagatgcaaatccattttgtattagtttcttagggctgttgtaacaaagcaccacaaactgggtggcataaaacaacagaaatttattcttgttggaagctagaaatctgaaattaaggtgtcagcaggcccatggtccctctgagactctgggtagaatccttcctccttcctatcttctggtgttggctggcaatccttggtgttccttagtttctggctgtatcactccaatctctgcctcatgtggcattctctctatatgtctctctcttcgtgtggtgttttcctcttctcataaggacatcagtcatgttggattagggcctaccctaacgacatcaattgatcacatctgcaaagacctgatttctctgtaaggtcatggtcatgggcactggggtaaggacttcaacatatcttttttggggacataagtcaacttataacacattttaatattggtggaggcaagttatacacaaatgttttccaatgttaaataccgtacttaactggctctgatatacttaaaaacagttttaaatctctaaaatcaggacatatactatattcatagtgttagatttgatgaaatatggtgcctgggttctctactgctttgggtgatgcttactggagctttttgctcagagcacagaggtatgtgttaccctaaactccacctccctgtctccttctccttccttgggttacttagctgatgctacatttaaggaaggaccaaaattaaaataaactttcttagcaacttgctctagataaaccacttgtgcctatgtaggacagtaagcatgagatttttttttttcatgagtcacatggccaggtgactacaatgaggcatcatgtgagtcacccactgtccccatggacctaattgggaagtgagcagtcaaaggtcagtggcagggctggggacccagattagaactcctttctggcagagtgatagatgtccatagtgttagtggaacatcctcccttctcgataaacacctcttactgtgacttagccctctcctgtagtcccctgtcctcattagggtggcctgttcctatagtccagcatcctgtctcactggacaacatgtcctcaaaatagcccccattgacgcattatgacttccactggatccaattccctcccttgtttcctttgttcttccatttttcccaccctttgtctctcttctgcttctgtgattcaagctgatgtgccaaaccacagccttctacttctactttccaggcaaacttcttggctggtcttgattggattaaaatttttattttcaaaaaacttttttgaggcagggtctcactttgttgcccaggctggagtgcagtggcacaatcacagctcactgcagcctcaacctcccaggtccagctgattttcctgcctcagcctcctgagtagctgggactgctggtgcatgctaccatgcccagctaatttttaaaaaaattttcatagagatgggggtctcactatgttgcccagactagtcgccaactactgggctcaagcaatcctcctgccttggcctccgagaatgctgggattacaggcatgagcctggattttcgaagactaatattcctaaccccatttagaagccagatctgacaagtaaacatttcaccctggtgtgatactttctggctccacgctcccacgactccttctgctcagggcatacttaacgtcatgtctagtgtcccctagaatgatgtcatcaaggaaaaaaaagtattcacctgccctaaacaatttgagactcaggataaaaacaacaataaaaccaatataaattacagcagcagcagcagcagcatttattgagtactttctgtgttccagctgttgtgctcagagttttacagggtttggtttatttcatccttacaaccaccctgtgaagactggggtcaatccaccttgtccctggttctggctaacctgtcagaggaaaggggtggtaggaggtaggagttgtttgttctgtaagtgacattatggtgaagattcccactttagcaggaatgagtctgggccccagagaatgagcaggaacataggctttatgaatgactggaaacagaggcccaaactccttccacacgttcaggagggaggggtgggctcagaacaacaactcattgaatcagcatgggctcagtgcagagacttctgatgagtcagtcacttttaaccactgcattccagggaatctgcctgggtagcaggacttggttgggggtatcatggggggttcattggttctcataaaatcaacctgtgattcattaaaaagagtggataaagggacttggtaaccatgactctgcaggcatgatttcctaaagaacaaatcccagcacctcattttatcctctggggtcagggaccattagttcactgggagggacctgctgttatttattttgtatcttgcaaaactttctattgtggctacaagtcaaggactcatagggaaatgctaatttgagaatgaatgggtggttaaatgaatagactgggaaaagtcctaaaaagtaatctgacagtgtctgtattagttcattttcatgctgcttataaaaacatatccaagatttggtagtttataaaggaaagaggtttaattgactcacagttcaacatggcttgggaggcctcaggaaacttacaatcatggtggaaggggaagcaaacacgtccttcttcacatggtggcaggaaagataagtgccaagcaaaagggagaaaagccccttataaaaccatcagatctcatgagagctcacttactatcatgagaacagcagcatggaggtaactgcccccatgattcaattacctcccatcaggtccctcccacaacacatggggattgtgggaactacaattcaagaggagatttggggggtggggcacactgccaaaccatatcatttcaccccaacccctcccaaatctcatgtcctcacatttcaaaacacaatcatgacttcccaacagttccttcaaatcttaactcattcaaggattaacctgaaagtccaagtccaaagtcttatctgagacaaggcaagtcccttctgcctatgagactgtaaaattgaaagcaaattagttacttcctagatacaacgggagtggaggcattgggtaaatacagccattccaaatgggagaaattggccaaaacaaacaggctactggccccacgcaagtctgaaatccagcaggacagtcaaatcttaaagctccaaaatgatctcctttgactccatgtctcacacctaggtcatattgatgcaagaggtggtctcccatggctttgggcagctccacccttgtggctttgcagggtacagcctctctcccagccactttcatgggctggcattgaatgtctgtggcttttccaggcacatggtgcaggctgtcaatggatctaccattctggggtctggaggatggtggccctctgctcacagctccactaggcagtgcccgagtggggggctctatgtgggggcctcaacccatatttcccttgtgcactcccctagcagaggctctccatgagggccctgccttgtagcaaacttctgcctggacatccaggtgtttccatacatcctctgaaatctaggcagaggttcccaaacgtcagttcttgacttctgtgcacctgtaggctcaacaccacatggaagctgccaaggcttggggcttgtatcctctgaaaccatggcctgagctctatgttggtcacttttagccatggctagagtggctgggatgcaggtcaccaagttcctaggctgcacatagcagggaggccctgggcccagcccaggaaaccattttttcctcttaggcctctgtgcctgtgatgagaggggctaccatgaaggtctctgacatgccctggagacattttccccattttcttggtaattaacattcagctcctcgttacttatttctgcagctggcttgaatttctccacagaaaatgggtttttcttttctatcacatcgtcaggctgcaaattttccacacgtttatgctctgcttcctgctgctgtatgctttgctgcctagaaatttcatctgacagatcccctaaatcatctctctcacattcaatattccacagagctctagggcaggggcaaaatgctgccagtctctttgctaaagcataggaagcatgacctttactccagttcccaataagttcctcatctccttctgagaccacctcagcctggacttcattgtccatatcactgtcagcattttggtcaaagtcattcaacaagtctctaggaagttccaaactttaccacatcttcctgtattctgagccctccaagtttctaggaagctccaaactttcccacattttcctgtcttcttctgagccctccaaactgttgcaatttctgcctgttactcagttccaaagtcacttccacatttttggtatccttatagcagcactccactctaccattgccaatttactgtaatagtctgttctcacactgctaataaagacatacccaataccaggtaatttataaaagaaagaggtttagttgactcacagtttagcatggctgagaaggcctcaggaaacttacaatcatggtggaaggggaagcaaacacatccttcttcacatggtggcaggatggagaagtgctgagcaaagggggaaaagccttttattaaaccatcagatcttgtgagaacttactattaggagaacagcaacatgaggataatcatccctgtgattctattacctcccactgagtccctctcatgacctgtggggattatgggtactacagttcaagatgagttttgggtggagacacagccaaaccatagcagtgctcatatctcccatggtcctcttccctcttctaacccttcttgatgtcttcttgtgcttctctctcttgtgaatatcaatggcatttatgtccagaattaccccttggcatgccaattcccatggaaactccagaaagggagggagatacttaaaatagttcaggctgtgctcctctcagaagtcttctgataggggaaaaaagagaggctctgtccacatctgcctgggaagagagcaattataaggctaagagatggccaggcagctcatgcagggagaagtcttgggttgcattgttcgttgtgaacattcaggaattctgaaactagcagccacttttctttcattatagacattgcatggctcagggctgccccatctcagaggtgaccttgatgctttaaggccaggcttggaaccaatgtcatcattcccactcatgggcctcacgcttacattctgaagttgtagtcaagtcggagagtggagccccagaggttattcatgggctcataaaggcatcccacttgtagaattttaaagttgggcaaggcctttgaagttagatggactcaaggctctgaggaaacctggggcttccaggaggtgcttcaaggattccgcatataatctagggtttttgggagaacaatgaaagtttaaattgcctgaggaattgttgtagcccatttacatgttttatattggaattctatgcataattttgagaaatgagctcagttgcttaaaaaagcaaagcaaaacttcatctattcccctacctttcattttgccccagtgcatatttactgagcatctccactgagtaagaactggagctgagctgggcagggcagagcaggtctcaagggacttaaaatctgttgggtggcagtgttgttaaggcagacacataaattattatgatgtggtaggaatattagaattgaagaaatggaggctgagaggagttaaatgattcacccatggccacactattagtgggtgactcgattaggatgacagtctactcattgtgtgtacccattctgttagacctcctgtcccccaagtaaggtcctgaaatgggtactgttaaagtatatataattttaacagagttaaaagtatgatttctacacaaatataaagggaatatgtgtaaaagattttattcaactttagtaattaaagaaccagtaagacgttaggagtagttcaaaaggaatttcaaagaagggagatttatggttgatcagtcaaaggaatgctgaaatgaattagtgaatagattgaaaattggttaatattctgcaaggcaatgaaccttaacctgtgggggataaccttttctaccagacagaaatcattggtattgttgttggataagaataatatacattgttctcttatctaaataatttaccttgcacaccacaatatgatcatgattagattaaaatgttgtcttagccagttctagcagctataacaaaatgccataaactgggtggcttaaacagcaaacacttatttatttatttattttgagacagagtcttgctcttgttgcccaggtggagtgcagtggcatgatatcggctcactgtaacctctgcctcctgggtttaagtgattctcctgcccctcctgagtagcctcccaagtagctgggatcacaggcgcccaccccaatgcccagctaattttttgtatttttaatagagacggggtttcaccatgttggtcaggctggtcttgaactcctgacctcaggtgatctacctgcctcggcctcccaaagtgctgggattacaggcatgagccgcctcaccggggctatttttttttttttttttttgagatggagtcttgctctggctcaggctggagtgcagtgacactatcttggctcaccacaagctccgcctcctgagttcatgccattctcctgcctcagcctcccaagtagctgggaccacaggggcctgccaccacacccggctaattttttgtattttagtagagacagggtttcactgtgttagccaggatagtcttgatctcctgacctcgtgatccgccggtctcggcctcccaaagtgctgggattacaggtgtgagccactgcgcttggccattttttttttaaaagaataatatacattgttctcatcaagaattatttcccttttttttgagacagagtctcgcactattgcccagggttggagtgtaatggtgatcatttccgtttttatggttttcaataggtcaacatctactcttacagtattgtaaaatatcctgattaatagaagccaaataataggtacatactcttagaaaatcagataatccctaagcatggtgggtcagctagtcaacattctgcattacattgaaaggacatttgtattttctttgcctgtttccaaattttatgtaatctttctttctttctttttttttctttctttctttccttctttctttctttctttctttctttcgttctttcttttctttctttctctctccttccttcctttctttctttccttttttttcttttctgagatggagtctcactgtgtcacccaggctggagtgcagtggcatgatctcagctaactgcaacctctgcctccttggttcaagtgattctcctgcctcagcctcctgagtagctgggattacaggagtgcaccaccacgcccggctaatttttgtattttttagcagagatggagtttcaccatgttggccaggctggtctcaaactcctgaactcaagtgatccgcctgcctcgtcctcccaaagtggggagattacaggcatgagccaccacgcctggccataatttttctttacaatattgtgtgtgtgtatacaccctcattttctgagtgtgtttttgtccaggtgttgggaaggagggaattcagtcacactgtaataaaatgaatggagacagctaaatgagaagttttggggacactgggaaaacatcgcaatggtcaggctgatttctccaaaataggttcgctggtcttaccagctggggtcaaagaggtccctttggaaaactgcatgaaggagctgtcagggtaactgggtcatggagaggaacagatccctcacattctgctccttatattggaaaaaacctccttaaggcactgcaggaagaagggttcacctggctggagcaggaatgctgagctaggcaattagagaggacagtggcttctgtctaagcagatgcctgggtttggcttcctggctgagcttctcaaggtgattttggttctcctggttgtttctgctcctcctcgtagcctttgctctgtcctttgacagtatgaggactgttcacatttgaatagcaccttatagtgtaccaagtgcttccccttacctcactgaattcttgtacaaatcctgagagacagatattgtcatcccatagaggctagttgagttgcccaaggtcatgaagtagttagcaggaagaacattcagaattcaagcacaaaccttccaactctaaaattccatgttcttttagtgtatatcagtcagccttttctaacatttctgcacttcctcctagagcattttgtggttggattccaagatatatgcattgagaagcttgagaagatttcagatttgcttttcttttgccagtcagtgggacactgccaccaaagtcacctcaccctccacgcccccactgtatttaggctatgtgttaatgttagtgcatctgggccttggatcccctgtgtagtggctgtgaatatcactagaatgactgaagaggggatacattgccatttttctgggccccggagatattttcatttgcacaatgtaggtgtcaaaccagttgttaattaaagcctttccatcagttacgatctgagacttgcgtccatggctcagccttgccctgtcacttgttaccactgtggcctcatcagttgagagcggtgatgagtttctcctgattttcctcctcctccttcttcctaaccaataacctgtatttggtagacgtctgtggtatggttagggtgtgtttgtgtgcacctgagagctgtaaacctggacattgggaaagttgggaaggatgaggcaggcaagtaccttcactgagccaaatctggtgctaatgcctttgtctgtctgttgcagggcccaacatctgtaccacgcgaggtgtgagctcctgccagcagtgcctggctgtgagccccatgtgtgcctggtgctctgatgaggtaaggagcagataccagaccttgtttcttctccagactaagctgcttttgtgcagaaacagacccatgaagttatcacctccctcttgaatacacatgccccttatcccttctaagcaaaactttgatgaatttttcccattgatgcatggtgaggagctgtcatggggatgttgctgggaatactaacccaagtctaccatatagcccctggcccttgccagtttggctcgacctcctgtcctctctgtaaccactgctgccctttctcacactttgcttgctttttttcctaagaaaaacagtttattttaaattttttgttagagacagggtctcactatgttgcccaggctggtcttgaactagacataagagatcctcctaccttggcctcccaatgtgctgggatttcatgtgtgacccaccatgcccagccctttgcttgcatttcttggggtggaatatcccagggaagcagggcgtcaggtctcaaaaggagaggcagcaaggggtataggtacggatggggttgggaggggttgctggcttacttctttttcctagaggttaaaaaaggcaaatagaagagaaatcttgtgcttgtgtgtggtgatgtttagtcagaaaatcttttctcttcccttctctttgatgattgggccccgcggctttacatttttctttctcttcttctttccttccttccttctcacaggtgttgaagaaaggagctgggcccacttggtgaggatggaagggggacaggaaagggttagttgtgtctaggcagagggtttgttgtgtctggggccctagggaatgagtgtgtctgagggaatggctatgtttgtggctgggatggaaatttggagctggcaagagctgatggggtgggggtggaagatgaatgtggttgaagagattcggtgattatagagtctcaggctgagtcactggcctggccagcaggtggttacctgagttcctggcctggctgcggctcagctacctgaggcttcctctgtcccacaacaagtcccagccctctccagttttatgaccgctccaatccagccctcagtctctctgtctgcttctttttcagatctgctgagtttcctaaaaaggcaacctccctggccgcctggggggaggggcgggagctgggaggctgtgtttatcaccggccaggagggctgccagagcagcagaggccagctccgcacgttgctttggcctctttgccgttcagcacgggaactgcttccagaggcagctgcccaacatctgggccacattaacttcatttagcaaatgaaacattccctggggctagggaaggggtgtaaggggggcatggatgagaccttctcccccacccccgcaggttctcctcccctctgggctgagcgggctgctcagtgtgatgtagcctcctccctccttattcactatgtcctccttcctcccatcgtgatattactaaagcttcttttaccaggaagttgcaattctgcaactgaatgctggaagaagagagagctgaatggggaggggggccttgggtagccgaaagccttcaggagcagaggaaggtcaggacagaagccctagtgtcactcaaagggtgcttcccccttttcctccttccctcctttccaacccaaagcaagagaaaatgcaggtatctctggcccagagaatctggggaaaaagaaaaccttcttggagggtctgtcctgctccctatcccccatttttcatccctcttgatctgtatagggactagccatgcagctgaggtgggctggggcctgaccagacaaagcccttaggtcacataaccagatttcaaagatgcaaatgtagaatatttatgggtgactgttgtgctccttgtcccctggggcaggcctggggagggcagagggaaaggtgcagggtagatcagagcatgacataggaccagcctaggaattaggggtgcagtcagtgaggaaatgggcgcagctaggaccaaagaaaacaaatggaaggaggtagaaagtccagtaagatattccctgggagaatggcatataaacatgaaaggaggcggggccaaggttagtgaaggactacaactatccctcagcaagagggaggagggagagaaggaagggtggaggaccccagtatgggacagaatgtggtgaccggggagggatgggaggtgggaatcctggactgtaacctgaacataaatgctattttgttcttgagaggagcagggcttcccctggataggccaagtttaactgctgaaaatgccttggacattgacttcaaaaaaccaaaggtgaactggctggtccattttttaggtaattttttgaataatcaaaccttggagagccctctgttcttcttcctcccctgagttggctgttccaggcaagctggcagtgcctggaaaaacaactggttgggctcggctttccccttggtcctagaggaccggagctcttgggtgtgtatagtgagagcttggctgggtaagaggaaaacagccaacgtggatgagcacggagttttgggcccatctgcatagggtgtgttcttggagggttggataccgacgcgggttgggttgctgtgctctctctggtccataaatctagcaaagaggcgggctttatacagagactcaacgcgtagtcttagtctcaacagtgacatgctggagtctagaacctcccaaactcatttggtgttgagaattgcctgaggtgcttgttaaaaataaagcttcccgggatggatcctgggtctgttacatcagaatggatatttatgatagcaagtttggcaaacattgctaattgaagggccactggggttgggtcaaggtggatggaggtggagttaaggttgccagataaatacagaacatccagcctggtgcctgtagtcccagctactcaggaggctggagtgggagaatcctctgagcccaggagtttgaggcaatagtgcaccatgatcatgtctgctaatagccactgcactccagcctgggtaacacagggagatcctgtctctaaaaaataaatctagattacagaacatccacttaaatttgaattaaaaaataatttttagtataagtttgtcccaaatatttgctaaatttggcaaccctacagtggagggaaatactaggaattcttatataagcctgagtacaccctggaaggtgggccagcttcccacttagcctgacaaccaagggtgacagaggaagaaggagtttgagtctagcaaagtagaggaagactctaataggatttccttctcattttcttctctgcaactgcaggagcaagatataggccatgatttacatttctttataatcacaaacataattttattctgacttgtcttctttctatttatttttaatctggaggacaaatgttcatcttgagagttttgctccaatttattattgtaaaaggaagtataatattaagagtgctcctcttcttgtaaacaatgaaatgtgaataccaacaactataaacaaaaatgcttcatgttcctcccctcctcctttctgccctcttcattcttttctctttgcatgttcaagtgatttcttgtcctcaccagatgagttaatcaagacagcaatggatgggagatgttttggtggtgctctggggtaaaaaaagtactggggcatattgactctcgctctccaagaagagtatgaaataatagtagttattgtggtaactgtaaaaaagagtcacctgccaggtgtggtggctcactcctgtaatcccagcagggccaaagtgggcagatcacttgaggtcaggagtttgaaaccagcctgaccaacatggcaaaaccccgtctctactaaaaatacaaaattagctgggcgtggtggcgcaggcctgtaaccccagctactagggaggctgaggcaggagaattgcttgaatccgggaggtggaggttgcagtgagccaagatcgtgccattgcactactctagcctgggcaacaagagcgaaactccatctaaaaaaaaaaaaagagtcacttatatttgcatttatttgcttatactgtgtcctaaagcaggggctccaattcctagtccatggcctgttaggaactgggccgcacagcaggaggtcagcagcaggtgagtgagcattaccgcctgagctccaccttctgtcagatccgtggtggcattagattctcacaggagctcaaaccctactgtgaactgggcatgggagggatccaggttgttcactccttatgaggatcaaactaatgcctgatgatctggggtggaacagtttcattctgaaaccatccccacctccctgtccatggaaaaattgtcttccctgaaaccagtccctggtgcctaaaaggttgggaacctctgtcctaatggatttcagtatagttaacttatgttgagatttttatattttgaaagcatttcacattcacagtcttcttttacttcctgaccaaccctgtgaaataggcaggataatgacaactattcatgttgtactttcccaatttccaaaatgggattaatggagaatggtaccaagagcgtgtgtcaccctcccaggagagggaggtaattcagccagctcgcagggcgctggctggaacctcccacctctgtgctcaggcccttcccctgggtcttggctatttttgccctttttgtgtaacatccggtttccctgggaactgaaactttaatatccacccctcccccttctagctttcttcctgcataacctggagacattctttctaccttctcagcctgggttaccaagaaagggaatgttgcccaagtatgttgaggtcactgccttggtgctcttctggaacagagggctctcgtggagagcttggctgacgagcaggcctgttatattcctgacctctgatgtcagcaaccacaaagggagggagggaggcagttttgtttttcagtgtttaatttttctaaggaaactcataacaaaccattaggactgtcagcacatcttagcgcttcaaaccctcttctcattaggactgccacattagaaaataggagtcaggaaactcccgtctaatgcattctctccctctgctgatggagcctgaagatgcatgaaggccttgctgctctcatccagtttgctgggctccggtccctgctgtcttcttcagcatctgtcttggtcctggaaaggatccgctcctcactgcattctgatttatccactgcctttttgggaaggttttctccctggggctttgtgggcagctagaatcagagataggattggggcttttttgagcaagagaaagactgcttccagaggaggaaggggtaggagaggtgggcagggacaacaggaggagtctgggcacaaaacctgaagtgcccaagttctccccaggtcattccgtcctcagccagagctgggtgcacgggagactttcatcttcctcagagttgtggaaggtctgtgatgtccctgttggagtatttgccaccaggaaggttaagtcttattcattgatttccatcgccgaggctggttccctgcctgcatacctgtgaagatgagagagaaagagagaagctgctggcttccagaaactctacttacttcttgcctgggccagggtagtcctcatgctgttgatgttgctcgtgtccccatccacgtggggaaggcttcagcccatgaaagggggatcggactggagagggagagagactttaagcattgggaagggttttgggttacagggtttttttgtttttgtttttgttttgaggtggggtctcactctgtcacccagactggggtgcagtggtgtgatcttggctcactgcaacctccgcctccctggctcaagtgatcctcccacttcagcctcctgagtagctgagattccaggtgtgcactaccatgcccagataatttttgtatttttagtggagacggggttttgccctgtggcccagggtggtccggaactcctgagctcaagttatccacccgtgtcggcctcccacagtgctgggattacaggcatgagtcatcgcacccggccggttacagggcttttgagtatgaatggctccttgtggcccagtccctcttctggcattatggctgccaggttgcttgagggggctgaggaggcagatgtcatccatccttctccatccctcgcacatgcccaccttgcatcctgttccctacctggggcattctctgttgtggctcctccctaggaccattccttccacacttttccttttccgtgccttgactctcactctatacggaatgtagtaaagcttattttatgatgataattacagtcagacaatctagctggcctctcagttctgccacttcctagctctgcaactttgagcaaattccttaatttatccaagcctcagattccttacctgtaagattgggttccttatttgtgaagcctccaaaccttaggtttctcccttgtaaaattataatagttccagcattatggaactgtcaggcatattgcaataatccatgtaaagtgctcaccacagtgcctgacatacagtaagtgttcaataaatgtcaacactagttgttctgggatattggtgtgggttatccagcagacatttggaagtgctggttggggatgtgggtaggggtggggttgaggagagcccgaaggcctagacattgtgaaataggtcccgggaggggttttccagcttcctggctggtcccctcaacttggtaaggagccctcatagacatgcacccacacagtgttggctaaattggctgaatgtcagagccggaagggactgaaaacactgtgtcatctaaaggccttgttgaacaggtgaggacacaaaatgacgtatctgaggtcacatgactagtcagtggcaggcctaggattgatcttctttcctgattttcagtgttctttccagggtggcgtggtccccttcaatactcaggtttaagcacccagagccccagggggccgtgggtttttggaagggtactcaatttgttctttgttcagggtgaaggaggacactgaagtgataggatgggctctggttaggtgcctggcccatgttcccaagtttgtggagtttattcataattagcttatccaggaagtacttgtcaagcatctcatagtaatagcttacatttgctgaggacttcctctgtgccaggtgctgtccaatgcattttatgtggattgtcttatttagcctgtgtgacatccctgtgagggaggtaccataattactattattttaagtaacttttattgtgggaaaatatacataacatagaatttaccatcttaaccattttgttttgttttgtgagatcaagtcttgctctgtcacccaggctggagtggagtggcacgatcttggcttgctgcaacctccacctcccaggtttaagcgattctcctgcctccgtctcccaagtagctgggactacaggtgcacgccaccacacctggctaatttttgtattttcagtagagacggggtttcactaggttggccaggctggtatcgaactcctgacctcaggtgatctgcccacctcagcctcccaaagtgctaggattacaggcataagcaactgtgcctggcccatcttaaccatttttaagcatacagttcagtggcatgaagtacattcataatgtcatgaaacccctcaccaccatctatctccttaactcttttcatcttgtaaaactaaaactctgtacccatcaaaacagtaattctctattcctcccagtccctggaaactactattctactttttgactctatgattttgattgctgttaagtactgaaggagggactgttattatgttcgtgttacagctgaggaaactaggcttggaggaattaggtgacttgccttagtaagcagttgtaagtgcaatgctgagatttactcctgtgctcttagccctgactctctcctgcctccttacactgcctttccctatcacatttgtggtaagtcctaggtcggatgctgggaaatgagaggggccaagacacacacagtccctgactacatggatctcacagtctagcccgtgtcaaatacagtagcttccaaactgttttgactctgacctacagaaagaaacacactgtactgggtatagttatttattatatgtgttattctccactctcctccaacaatataagaatttcacaaaacaaccctttgactatttgtacactttcatattttctattctattctattgtattttatttaacaaaatgatggttgacacctgctaaattgattttgggacccacaaatgtgtggtattccacagttaaaaaatgctggtctaccaggcatcttactgtacaggctctccttctagctacaactccatgaataggccttcttgatatctcaatttctcttttctttttcctttttttttttttggtagagacggggtctagctatgttgcctaggctggtcttgaactcttggcctcaagcagtcctcatgccttggcctcccaaagtatcaatttcccctttctgtacaacggtcctaagggattatcccaggaaagaccacaacaatttgtttatgctccaatgtacggggtaaactcttagctattgggaagtggtagggcctgcaggaggtagagagtcgccatagctctgattgctggacttctctttgggctcctgtcttacaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccaggtagggctgggactctttgcggggagagacctgaagcaggtgggcatagagcacaaggtggaggtctgaggaggaagtcttggggaagtagctcagaatggaaatggggtgggaagacaaggatgaggggggaggtgtgggcaagagaatggaagaaaataagagacgttaggacttgagtcagaagatctgaggtgaatctttactgtatcatatattagctatttgaccttggacaagttacttaacccttcagacatagtaggtgctcaaaaaatatttgtttcttctttacccaagtgcctgttttacctagcttagagctttgtgttgaggtgcaaatgagatatagaacaagaaagcgacttgtaagcccccctttcatggggaattgggacaggggaatgggggcagacacaataggtacacaagacctttagagggaggaagggttagactaaagacagaaattttgaagcattgattttgactttccaactaagtcaagaaggatttacctactatcaaggcatgtgttggatgcaatgggattcagagaagggtagggtgcagtttctgtcttttacagagtctgaagtgtagtaactatcaaaatctctgtgactcacagtgatagacccgtggaactcacaggattagaaatcccctgggatttagagaaagtggaaaattttagaatggaaaagaagaggttaaaaataggagggtcaagagattagaagagtaatagaattgcaaaggaagaggaaaagggaccagggctttctggtttgctttgatcatgcaatttcttagtcccaactgtatccaaatctgcttattcaatcttggtgggagaagaagataaaaactaacatctttctgccttccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgagtaagtccctcctccagacgccaggacagcatcctttgccccaggaaggtccaagtcctggttcctatttctagctctaggatcactttgttggctgtcttcttgccaaactatagctcctttctaccttggtctccctgtttggcaaatgggctagcttgtggatctggagtgttgtgtcaatggagcctaaggctgtttggagaacctagaaagaaaattcatcagcttctcagtcttggtaacaaataaatagaaggcaagagagaatgggagggaaatgacgtcaaaagtagaaagaaatttatggataaggaaaccgagaaattacgattacagaaggatcgattccattgttggcattattgtcttcatcaaggccgtgcatcctgcagggtgaaaacagaagaaatgaagtgctaaggaatataaaagagtggaaatgacatttgttggacacttttatagtctgtaaatggataacttgtgcctctgtttgacactttggcttaaaactgaatggcttatttatttaatcggtggagactgtgcaaatccatgtattagaataacttacaatgctggttgctgagcctgaaaaggtgtgaatttactttttagttttcaaagttacggccaggtggggtgactcacttctgtaatcccagcactttgggaggccaagatgggaggatcacttgagcctaggagtttgagttcagcctaggcaacatagtgagacccccatctctacaaaaattacaaaaaaattagctatgtgtgatggcgcatgcctgcagtccccaggactacagggaggctgaggtgggaggattgattgagcctgggaggttgaggctgcagtgagccatgattgtgccactgcactccaacctggacaatggagcacaactgtctctaaaaaaaaaagaaaaagttttgaagttatatgatgtggcattcaaccttctatctgggttgtaaggttcccaggcaagacatcagctattaattaaacacactattttgactgggggcagaaatgctcctgtcttgcatgatctatcaatttattgatggttcagggaccttaacttactgatggacttttgctttattgttactttaggaaagtgttaagtataaggtgatagtaatagcaactcgagcctcgctctggtctaagtgctttgtgtgtatgaacttacttaagtctcacaactcttatgggatatgtgctatcctggcccctctttcataggttggattgagaggcttgccaaaggtcccatgactagtacagagggcacctgggatctaagctcagggagtcttgtttccagctcaatctcttatcttctaggttagctggatgggggtaatgttgatggggagcttcagataatttgaggattttggagtctgaactgtctgggtaactgtggttgtatggaactggccttggcataccactatctatatttgtcccctctctttcctcccaattcccatgctgccttttccatgaaggtgtctgcttaaattatctcccatccctccccagtatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgtgagtttggaggacttggagtgccaggtgtggctggcatagatcaaaatgggaaaggaagtgactgaactctggggatttctggtgtaaaatgagatgagaactaagcagggcttcctgcagttatgagtagtaagttgctcctgatattcagccttggcttagatccactccctggcctgagctgacatttctttgaacctcagtggtctcagatgttcccaggggagagcatcttcccatcttcagagttacttcagagttaaggctgagttaacttaacctcagcaaagtaggcagatgttcagatgagatttcttctagcccagatcagctctgtggatgcacgtcagtttctagatgagcaatgtgactgtcattagaagagttaagtttggagtttaagaagatctcattcagctgcttgaactaatcagctatgagactgttttctgaagagaatgaaactcctgaactggaaagcttcagcttcggttccaaggactgggactgagacccttgttttgaagaaaaataagctgtccagccctttagccagggagcaccttgggtctctgttctctaccagtgacatggctgaatttgttttgtctcctctgcctttgttttttgttttcttttaacaggaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggtgagatctctggcaccacctatggtttctattcatgattgtgagggttgccctaatctaggcagagtctgtgtgaatatgaaaatggcagcccctccttctgggcagggtgcagggctcggttccagcttgcccctatcccttaccaactggacaccgtcatccagcatacaacctatataaccattagagatgtccctgattgtggtgttatcactgccttcactgtcaccagcatagcagcagcatcatgggatccagaatggacccaaaggatttttacaacccagctggaaagcaggtcttcctctccactctgattagccctttcttggaataccatactaacttgtggttattggaagaagacagaggaaaaaaaagagaaagattggccaggcatatgatggctcatgcctgtaatctcagcactttgggaggctgaggtgggaggatcacgtgagtccaggagtttgaaaccagcttgggaaatatagtgagaccctgcctctacaagaaaatgcaaaaattcgttgagtgttgtggtttgtgcctgtggtcccagctacttgtggggctgaggcagaaagatctcttgagcccagtagtctgaggctgcagtgagctgtgatcttgccactacactccagcctgagtgacagagcaagaaccacccccgcctttttttttttttttttttttttttttttttttgatacagagtcttgctttgttgcccagctggagtgcagtagtgcaatcttggctcacaagcttcaccacctcagtctcctgaatagcttgggaccacaggcatgcactaccatgcccagctaatttttgaaaacagggtctttctatgttgcccaggctggtctcaaactccttggcttaagcaatctgccctcttaagcctcccaaagtgctgggattacaggtgtgagccattgctcctagtggagaccccttctcttagaaagagagagagagagagagagagagagaggggaaagaacataaaaggcatggtgaacaggtcctacgaggaaagattaaagggccagagtcatttagcttgaaagaaagaaggctaaaggatgatttagcttatacatgagaaaacttcttataagttgttttatatggccatagaaggttaaacaagaggaaaatatttaaattgaatcaggagaaattactataagccataagagaaatgtgctgtaatgctctaggtatctggggcaggtgtgaactcttcgtctcctaaggacaatatagcaacttcctcatctaggtgacttaaaggtgtacctgtgtaaaggcaggagactgagctgaggatctaatgagctccctgcaaggtctaggatcccatggacatgttcacgattcaccaccgcccccgcacagtgtccttgagttccttggtgtcagccatatccaagtcaagcactaccagacaatgagtcagcaacatttgacccctaatctatgcaaggcactgggccaggggctgagggaggtaacaagactatgtatggttctatccttggggagtttttggtctacttgaggagaaaggatatatatatttacaataacacaagatgcatgattagtgccaaatgggtgtggcacagccaatgtggctatacgtatccaagggaggaaaggtcatcatgagctgggatggccaaggaagtctcctgaagaaggtgggggctaagctaggccctaagaaaggaggaggattaccaacaagaaggccactccaggtgggagacagtgggccagatcactgctgagtggaagagggagagaggtgagcaatatttggaaagaaagactgagaccacacggtggaggatcacgagggccaggccaaggcatttgtcagtagttccaaaacagaggcctaacccagtcccttgtgcacggaagcagctccatagtattagtgcattaaattcaagcaggaagaaagaggtgcttagttttgacaccactggcctgtacctcttcgtctatccctggagttcacaagtagacttctgtgctacttacccttcttatctcactgtcaccccccttttttttttagagacagagtcttgctctgctgcccaggctggagtgcagtggtgcaatcatagctcactgtaacctccaactcctgggctgaagtgatcctgcctcagcctccccagtagctaggactataggcacttaccaccacatctggcaaataaaaaaaatttttttgtagagatggggtcttgctatgttgcccaggctcttgtctcactttcagcatgaagtgaaatggtttaagcaccaccacactctgagccacagcccaagcaagataagttctaagctttagaccctagagatgtacatgagacgtcattaacctctacatccttcattttcctaggattatccctctttggggctgatgactgagaagctatcccagaaaaacatcaatttgatctttgcagtgactgaaaatgtagtcaatctctatcaggtgactgtgccttcgggcttcctggagtgggccctgtgatggtgggtgccccaggtagccagcctgtgctagcattggatacagtccccaatcaggaaagagtctcccctaatccactccccaggagctaaagattgcactctgggcctttttcctgcaatcttgaacttactaggtatgtgttggtgtttgtggtggtggaggggaggtggtgaggggtgtgagaggtttcctctacttttgctcagggctgaaaaactgctagatatattcctggcagtgacaattgaaatatcccgtaccttcctccaatcttcatctcaggactctcagtgggatttggggagggcttttggagaccaccagcttcctttggtaagctctggacatctttgttttcctttctagaactatagtgagctcatcccagggaccacagttggggttctgtccatggattccagcaatgtcctccagctcattgttgatgcttatggggtaagtgtcttgtgctgggaatagtcccgcggagagtccatctcatttggcttacacagcagggctcagatttgtgagtcccagttgccagtctaccacacggtcttactgccttctccgtgtgctcccagagcccaggcaatggcccgctctagaagggatgcagccttctgagaaggaaggaaggaaggaaggaagagagaaagaaggaaagaagatggggatggggatggtgattagatggagaaggagcagagccctggaattgtgggggcagagtgagggaaaactgggctccaataacagggaaaagagagagctgagacatggggaaggtgaggttgatgaaacattaggtagaaaatgccactttccaaggtgaccagtattggcactcccccttttgcaacatctgtgaggcctgcaggagggtgtagctggtacattttacccagactcacctagacgcaagtggagatggaaagagggagcaggttcctgcgcaggaaacagagtcctaggggtgctccggcagcttccaggtcaaaccttggcctctggcactgctggggtgagtccagagctacttgccagatttggcttgggatggaactggctcttgccatttcccgtttcctttcagttcaatttcttgtcttcttgtgcccctttctgctcagaaaatccgttctaaagtagagctggaagtgcgtgacctccctgaagagttgtctctatccttcaatgccacctgcctcaacaatgaggtcatccctggcctcaagtcttgtatgggactcaagattggagacacggtgaggtgggctgggcagggcctttgtcctggagcatctgtgggcacccaaccccctttcttccttttgtagtgactaaaaatggcccccttccaccagaaaaaaaatatgggcaagaaaaatacgtttcctgaaagtcattctaagttagatgtaatggatccaccaatcttttcctctgaggcttctgttgcgtaagccatttctgttacgtgaacttcactctcaggaatttgaaaaacttacaatttggttacctttgtttgtgtatgcacagttgattgcaaaggaaaatatttctttaccttcagtccctcaccagtcgccagcctttccaaggtaattaatacctttcttttgtaaaacgacacaagaaagtaaaatctaaaatgtaaaacactccagtctctccacgactttccttattggtcgtttctcctccgcttctgcctaaggggagaggggttggtgggaggggaggaaggaggggaagaaaatagatctttggatacgctgatcctttctattgacctatctgtctctcaggcacttgtgcaaacatcccatgttagaaatattgtcctgaaacatgctttattgcataagctatgaaatgtgtgggaactgaagtagatcctgagcttatgattgaccaccatgtgggattgtgtggtgcaaaatagtgctttgtgcatcttgctgataattataatcaggccaaagcagggtgtttatatgatcacaggttctgttcagtttgagctggtctatttcatatgtggagtgaaaaaacagccttttattatttattgactgtaaaccatgtctctgcatccagctagatatgtcacaacgatactattcccgtgcttgtgtttttgctttgcagaccttcatatagggaaggctgaggaactccagattgcaaaagcataagacacccaatttgggtattccttggcagggcagggaacaactttttttttcctccagagctggagtgttaactgggcccaactgtgtctaaatacaatctttctttccatccaggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggtgaggagaactgcagggccccctgtcctggaacccacaccccctcatatacctgcaaccactggaaacataggtgaaggcctgagatgggtctttgcaggcagaggtgtaagtcagtggttcctaatctttttgagtataaggaccaatccccttttcacgttaaaaaaaaaagttactgatagatggcaattaaatttttagcatttatagacttagaaaacacatgtcagaatatgtagtaaggttagtaataattttacatgagtttatctttgtatcacaagagaccgggaaaagagtagtatatatgcaagacattggagtgtgcttgaacaatgtctggaaaatggtgtaatgctcttgttaatgttagcactattttgttaatcactgttactactattggtgctactgttattttttggattctagatctttgctatccaatatggtaggctttagccacatgtggctatttaaattaaccaaaattgaaaaattaaaaattcagttcttcagctcatcagtggccacatgtagctagtggctgctatattggacagatctagaacatttcaacgtgatagaaagttctcttggatagcactgccacagagagtccctgctgacagattggggattataattttaagtccttctactcagcagggtactgagttgtccttctcattgcaaaattcagtaaaatcttgaggcccactgataatctcaaactagtttctccttgccccaagaaccactcctggggtactttcccagctagaagttgaactaatgttaatgtagtctttatccgcagacatgttggcaacactctcagagggcaaatagtcttgagttgttcctggggcactgaggatgggtttttactgggccataatcactgtggcttaatccctcttgcgacagacacaagttggttgggactgggttacgggtgtattgtgtggccaaacagagagattataattgttttctggggatgacccttgactcagattggcttcattggcattggggttcttttttttttttgagacggagtcttgctctatcgccaggctggagtgcagtggtgcgatattggctcactgcaacctctgcctcccagttcaagcaattctcctgcctcagcctcccgagtagttgggactataggcatgcgccacgatgcccagctaattttggtatttttagtagagatggagtttcaccacattggccaggatggtctcgatctcttgacctcgtgatcctcccacctcggcctcccaaagtgctgggattacaggcatgagccactgcgcccagccagcattggggctctaatcagttgagctaatccatgcagatactcacttcgatactgatattaacctttaaaaaagctcacttagaaaggtcgatctgtgtctttctaaagcatgtcagtaacataaaaatgactgctttttttattatctacgacattgtttcctttactcatgctgtcaaaattttagagagagtttggaaggaagtgttatcagaatgattaggggagagcaagagatcagatacacacagatgaaagcacaaacagcaaccatttgaattagggggtgaggcaggagtttcacttcattttactatttaaagtatttatatctaattcaaagtaccaaaggaaatgggtaaatttgaagtgggagacccctgggaagaaggttggggactgagggagagagggtggtcccaggagaggagtacggctggaccacgggggcacccccagtcctcctccatggcctgatggttcctggtctggtgtgaggcactgcggcaggatcccagccagagcatgtttcttttggctgctgccccactaaagccacaaaacaaagctgactgggtcagaagccccagttcctgcctctcaccagtgcaagaacagctcctcctcagtgcattccagtctaatccatgagggaaccagggcagccattgccgcctccctctaccatgtcttgctagggtgtcaggtgcccacccagcctcaggtctagaccctgtggtgccatcatcacatcctccagtgacagatactcaggggcgcacatcattgagcacttgctctgtgccatcatttggtccatatgagtgaacaaggggtcatgcatgatccctgacctctccaagcttaaagccccactcaccattgccccttgccagagctgctggctctatgcttcattctttgctataagcaggggctcaggaggcaggtgttctgtgactcggccatttccctagcccatggcctgtaagcatggcggctggttccctggccatccccgttgtcccctccctactttgggcctggtcttcatggttgctcatgatcaacattcctgcctcaaacatcaagaagtgcatcatcctcaagggagttttccacttgccacagccacagatcagtcaggcagcttctgtgagccagattctgtgctgttgtggagtaggatagagaggcgtgaataagacagttaaccaaggataattcccaacatgaggttgaatctgacagatccaggaagtgtggagtgctcagggaatgttataggagtccactggagcgagacttgactggggacagggtaggcctgggtggcttcatggaggaggtgggatgtctgacagatctcagaggaggggcaggctcaggacagacaggagtggagcgagcatcagcccagaaggtctagctgtggggctcgtgttcccaatgaccttaagcacccgttcctccctcccttttctggctcccctccctttctcctcttccactcttcatttcttactttactcctctgactttccgatgaacccggactcagcctcccttttgctggaagggtgccagtcctgtgacattaccacactgtggctaccttttaagggctaaccctaccaaggcttggggtcagcctgctggctctgacctgtcacttccactcccaacctcactccctggctggcccatcttgtcaaagatcactttgtttagcctcacaaaggaaacactatgggacaagagtttctgaggaggcggaggcctctgagtgctgccaggcccctgtggtgtcggtctttcccatccaggagccgtggccaaatgcagggtgtagtgaaaggccggggggcgggtgggggggcagctctgctggctggcgcactcctcccccagctgctgtgaggttggccgatagcagctcacagctgccccttctgtgaagaactgccctcggctgacaggagctgtcttgcccctagatgttggccaatgactgatggagaaggggttactcaaggctagactcttcgcctcagggtgggcctggctttgtggtgccattcacgtaggatcaggctggagggcatctggctgagaccacattcctgccagctctgcctcttgccatgtcctgtttccctccctcctctctacatcctcagcgagtcccttaaataagatcctcatccaagctgtacttctagggaacctagcctcgggacacagcctttctgctttccccacccttctggcagcccaacatctctactttccagatatacttggcagctggggcagcttgggttatgtccgccatccttcctgggaagcagacatttctttccatgcccagcccatagtgcagtggcatgatcatggctcactgcagccttgaactcctgggctcaagtgatccttctgccttagtctccgaagtagctaggactacaggctcttgccatcatgcccggataattttttaaaaatttgtagagacgggatctcgctatgttgcccaggctagtcttgaactcctgggctcaagtgatcaacctgcctcggcctcccagagtgttgaggttacaggcatgagccaccatgcttggcctttgaaggtttttaagcaggtgagttacatgatcaagttgactcatactttaaaacggtggttctcaactgggaggaaggagctattttgtctcccagggcacatttggcaatgtctggtgatatttttgattgttataactggaaaggtgctactgatgtctagagggtggagctcaaggatgctgctaaacatcctaatgtacaggacagtcctccccaacaaaaaattatctggccccaaatattgaaaagtaccaaggttgagaaatcacattttacaaagagaatcctggccacagaggaattgacaatcacctggagaaggggagatgacttacttatctagagacaggaccaggctgaggacagggcatggaaatatctacagtgaggcccatccacccttcgcttaaatagttcagaacatttgactcctaaaatgttccttccttgaaatttctcattgagatcaagcctagttactggactttccataacttctttcttactactttggtctcttttcttcctccactggtcaatttgaagaatattccattaaaactggctccatcttctgttggttaaggccattttctctgtaagttagagacatcttctggaaagaccatattagtataaatagggaaaagcattgcttatgacactgcatagaggctaagcacttgggatctgaagtcacagtgacttcagtttgagtcctgaccctgccatttacaaggcatatggccttgggaaagttacttaacctctctgacctcaaagggttgttataacaaatgaaaaggataacatactaaagaacttgcggctgggcatggtggaccagctggccgggcctgtagtcacagctctttcggagggcaaggcacatggatcacctgaggtcaggagttcaaggtcaggctggccaacatggtgagaccccatctctactaaaaatacaaacattagccgggcatggtggtgcatgcctgtagtcctggctacttgggaggctgaggcaggagaatcgcttgaacacgggaggtgggggtttacagtgagtcaagatggcgccactgcactccaacctgggtgacagtgagactctcaaaaaaaaaagaaagaacttggcacaagcccacaagcctaggcaatataacaagactcccatctgtacaaaaacaaaaataattagccagctgcagtggcacatgcctgtagtcccagctactcaggaggctaaggtgggaagatcacttgagcccaggagtttgaagttacagtgagcaatgattgcaccactgcactgtagcctgggtgatagggtgagactctgtctcaaaaaaaaaaaaaaaaaagcaaataaataaaaagaaaaagaacttggcacagtacttgacacatattaaatgcctccttggttggtttggaaagtagatacacattctcttctctaaatgctttccaagtctgttccactgcactcccagatatgatatgatgaggtcagattgagaagggaaccaggtcaagaaagacaggttgtgttggtgaacttgaactgcgcctgtaactttaaataattaattaattaaaaaaatgttgaattgtggcaaacatttctccacctgttgagtgcagaggcaggaaccaggatgagtcaacaggggcatgggggaggccatcgggctacgtgaggtcattactagtgattgtctctactgctgttcaccttaggaaaatctctctttttttcatttaatttctcttattttctgacttcttttctctatggcattcatgggatttgtttaactgcactggccctcggcagtctgggaggtaggggatatttgttctctctgcttacttggctccgttggccaactccatgggttctcagtgccgtccctctgccccttggatgccccaccccatctacccatacattcagggtgctctgtgtgcactttccctctctgcatttggaataaccccatgccctggatctctcctttccttctttccctatgctacaattttcctgtcttgtgcatgtgccctcagagccctgcttctcatcctgcaaggtaacacctagctgatttgagaaatggaagtggtggctgctttgttagtgggacgggaccagctcttccaaactggaccctatgttgttgtctaacccaactgggtggccacgatgacgacaatggtagtaggcctctcaggtcaggtaggagaggcgagcagcgctgtgtcaggtcaaagggagagagttttggggcctgtgaggccttttgccatcatcaagtcacaccgtcaaggctactgagtgccctgtgtaggttcagggctgtggctttgtgctgtgtcagccaaactagaagggctaaagagcttgcttctagttcttagactagaaggaactaagtcttctaagcctcctaccctttctcttgcctttctcagaaggcagaggtattcagaaaagggcaagagagagggcaagaggcccaggagacttagttcctgagaatcttttgctctacagtggctccgagcaagtcctgccataccttgggacccctagaaaactgagtttgtccctgctgggtaggactcccctgggtggtgagccaattccctgccaacctggaggatcattatctgtgtggttgggagagcaggatggtcgtgtgtagcctgctgccatgggagtggagctctcgccagcgggtccaccttcctgggctgtgtgttttcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaagtgagtgtggagtctggagagagccgggaggctgggaggtaggagaggatcccctgactagaatccccagctctccaggtgtgtttcttgctcaccagagccttagggagaggagtccactccagccagatggctgtctctccttttgccaaaggctttgggcaagttggaatagagccaactgtgaaggagccaaagttgaacgagctggacttcgattgagaatgtcctctcctagggtgacatcctgactccctctgagctgggaggaaggctaaaccagtctgaggaacaatccagtgctaatgttctgattcagtgggagatgtgagggctggaattatggaggacactctgtgaaactactacaaacctcccactttaggggccagaggaagccccatcagcctgagtccatggcactgccattctgcttaccactttaagcagggccagatttacgagtgtgcaacctatgcagctgtatagggccctgtgcctacaagggcctcatgcttgttttaatgctctgccatcactgtcttgacattcttagtaatctttgaacaagggagctgacattttcattttgcactgggcccccaaatgacatgactggttctgactttatagttctcagaaatggcatagggttcaccatcctggcacagccctggatgggacgggaagtttaatgaaggacctgggaggcttctggctgccaggtgctgcctacaggtgagggggacactcccacccctgaactccacacttgccattcaggtccccaggattgtcttacaggcgcgcgcgcgcgtgtgtgtgtgtgtgtgtgtgttttaatggaggtggagcagctttctgaatgcatggagatcagagctggactgggatacgcttaggcttgctccttctttgccttaatcactgtgtcctctctccttcagagaatgtgtggagtgtaagaagtttgaccggggagccctacatgacgaaaatacctgcaaccgttactgccgtgacgagattgagtcagtgaaagagcttagtaagttcagcacatcttagagttgcacacacccaggttctaaatgtttctaattcaatcccagaacctatccaactcccacctgtaaaatggaagcgtgacttctacctcagggaatgttgtgcaggcttgaggaacaatggacacttgatgtgagctggtgtctctgagagttgtcctcctctcttactagtgtgtgcagccatccaccacttctgcttcccagagcccacagactcagcaagagcctgcaaagcaaagggagcaagtgcctccctaaggaagggaagagaatgtatcccattttacagatgaaaaaactgaggcacagagctgggaagtggttgcctgtgatagtcatcatcttagctcagtaggctagtaagcgtttaccaagtttacttaactaaaagtgttatgcagtgcccaagattttgcttaaagctttgcagtttggagggaaaccttcaaccttatggataggcaaccaaaagctttatctgaagtccttctgcctctctggggccccttttgaaataagacagacagaaatacaaacaatagggagaaaaaaaatcttgcctgcaattattcttgaagtattctctgtccttcatcttaacttaaaaggagatgatctttgctgctgtcatcacatctgatatagttatgtgggccagcgaggcattgagatggtactctagtactagagagatggcaatctctccatagatagcaatctcccatgaaggcagaaacacatttcagagagagccacagtaagacacagccagccagtcagcttcctggtgggcgtgttatagaaaagagtcagctctctgggccttttggctaatatcagaagtagggctggggtgaggttagcgatttggggattgagtttgaagaaacagtttttcctctggaggagattaggcttgctatgattagttcagagaggagaggctgctgagatattatttttaccatctacactaggtgggtattacaggctaattgataagcagttctgtacctccacctcccctctacctgtggtattatagtacagggaaaagagtgtggaaataagcatattaaaataaatgcttatttatagggaattttatagcttgtaaaagttataaagtatctttcatatacattatcttatttttctgtcaatagcctagtgaagtagaactacagtactattctcatcttcattttgagtctcaggaaagttaagtaactggcccaagcaagggaatggcaaattaagataagaactaggtcctgaaatccgtactcttttccctgtattataataccactggttttctgaagggttgttgagttcaagtctgcaagatgtgctttgagactcctgttcttgttctgcttcatcactcatttgctgtgtgacctgggtacatttgcttaatttcatcatgtgtcagttttactcatctggtttcatcagtatggggcacagtgcagctagtggagggtaacccctagtatctttgcagaataacaaactttagaattagaagagatgaagtctacaaaacacggtgggagtcagagaagagaggatagctctggggaggtatactggatcagaaacagaaatggaagaaatagaacagctgcataagcaaactattaagaatcactaagcaagcagagaaaggaaagagagggaagagtacacctactatatgttaggcactgttcactttatgctgtttagttcaccgaccttgtgaggtgggggtatcattttctttttatagatgaagaaagacttgatgaggtcaggtaacttacccaagatcacacaacgggtaggtagtgaagccaggatttgaattaaattgtgtaatactgttatatcatgtccctttcagaggaaggattaggaaccaaaaagggcctatgcagtacaaaatacatcagtgagtgtcagtgagtggcaactgccagacacaacagccaccttgaatctaggcatcgtgcacatgaggcacagggtttcctgtcacatacttccctggaagtcctgtgataggggtttggagtggtcccatcttccagtagttgtctcactttttattcctccattttccctactcccagaggacactggcaaggatgcagtgaattgtacctataagaatgaggatgactgtgtcgtcagattccagtactatgaagattctagtggaaagtccatcctgtatgtggtagaagagccaggtgagtgaaccctgacggctcccggccctgccccaggagggagagggagaaccatgttaggcaggaatctctactcatcgaagctgttaagcaaaacaggttaagcctgcaagtgataagttaggggccaggtgtggtggttaacacctgtaatcccagcagtttggaaggccatggtgggtggatcgtctggggtcaggagttcaataccagcctggccaacatggtgaaaccctgtctctactaaaaatacaaaaacattagccgggcatggtggtgcatgcctgtaattccagctccttgggaggctgaggcaggagactcacttgaacccgggaggcacaggttgcagtgagctgagatcgcgccactgcactccagcttgggcaacagagtgagactctgtctcaaaaaaacaaacaaacaacaacaacaacaaaaaaaaacgataagttagggaccgtcatctgggtgaagggcatttataaatacaaatattatcaagaaagtgacttgttaattgaggagacaggaaaatcagaaagcaggtaaggagaagaagatagatatggatctcattaatggacaaaatatatcacgcatttttttgaggcaatgatgtcaagaaataaagaatttaaattttaggactttacagcacatggcatctgcactattaaaattgagatggttgccaagagcaacttgactgtgcttcagaggaaggcctgatggttagaggtgttacctttccaagtttactgcaggatgtagggataggtttgaggcactaaggcaaggctgccctgaacactgaaagtacagtgccttctgggagcaggaggaatccatcccatcatacacagaccagccacaggtttgtcaccaaccaatgctgtcgatcgcttgcttccctttaacaccttcatggcctttgttctccttaaacaacaggttaagatgaattattagaaaacatttttgagtattcactgccagtagaccccttcccccacattaggagaacagaccccagatccatagacccacgtttcctatctttttttttgagatagggtctcattttgttgcccaggttggggtgcagtggtgcgaccttggctcactgcagtctcaacctcttcggctcacacaatcctcccatcccagcctccctgggactacaggcgtacactaccacacctggctactttttaatttttatttttttgtagagatgaagtctcactatgttgccctggctagtctcaaaactctgggactcaagtgatccccccgcctcagccccccgcaaagtgttgggattacaggtgtgagccaacacacagggccaacatttcctatgttgttgctctggaattctaggctccgcctccctgctcatctcccagctccaatcatttcctggctttgagtagaatgttgcagctggggcctcagacagtgggggagatgattctctttctcttccccaactcatgctcttgcagatgctctctttgaagggctaagccactatagggcagtaaagacaacactgccaaaagttttggcattggccaaatggaatttaaccacatggaatgggctcttgagctgggctcttatcactcccagatggggttaccaaataaaatacactaggtcccatgcagtatttggtacacaatgatagtaaaaaataatcatttatctgaaattcagatttgtcttggcttcctgctttttttgttttgtttttgtttttgtttttgtttttgttttgagacagagtcttgctctgttgcccagggtggagtacagcggcgtgatcttggctcactgcaatctctgcctcccaggttcaagcaattctcctgcctcagcctcctgagtagctgggattacaggcgcccaccaccacacctgactaacttttgtatttttagtagagacagggtttcaccatgttggccaggctggtcttgaactcctgacttcaagtgatctggctgccttggcctcctgaagtgctgggattccaggtgtgagccactgcacctggccaagcatcctgtgtttttgtttgctgaatctgccaaccctacccagacttctctgaccttgggtcatttgccattggtccaccgctgtggctggaagggccctccagaggtcacctgatcttgccttctgcttccaggaaacccaccccaaactcctttcaggacacatggttaacagattgttttcccctaaagacctcctggcaccctacctgccctgcccatactaatgtgcagaattaaagagattttactttgataattgagggtcagccctacccaaatcttccagagaatccataattgtttttcccagaactggggcccttcactcttgggaacttgaacactggaacctcacagcctctctccaggcactcatttaattatagacaggttgtaatttggcgggttgggagatagccagcttgagttatggtggtggttgtttttgtggtgtgtgtggtgagcattgggtatatgtttggcgaagaaggtgggagacagtgtggaaagtgggtgtgacttcctctccaggctcattagcaccctcatatataaacacctggtttcataacacttgaggttactggaataagatcacctattagatacctgacatttgtgggaagcagagctctgcagagtatactcagcctgacccccagaggggtgacatgcctctgttttagttgttgactggggttgaacaggaaggcagctttcaatagggttatgattttagatgactaagtattttgggaaagaacccaaaatattgtcttggctggcaggtcctggtctctaagaatgcaaaaaatgtcattaggttcacagccctcaggaatgtaaatatctgaaccaggataacagacacaaatacttacagtggctaaggaagcaaataagttagtgaaaacagctgggtgtaagaagatccgttacaacggtagctgatatttactgagcacttactctgtgccaggcattgttctgagtttttaagatatatttaatttaatcattcctcataacaagtttcttttaaagtcagtgctattactatcttcattttaaagatggagaaacaggaaacagacattcagaaaggttaagtaattttccaaagatcatgtataaaagttaagtgataagtcaggattcaaacccagggagtctggctgtaacatccacaggagcgcagacacaccaacaagtcacactgccttcctctaggagagagaagggagagtggtggggattctggtaaactagaaaacatgagttccaactaaaaggagcagctcctcctcagctctagctaactgctgctctgcaggaatataagaatctctctctttctgtatttctctctttctttcttttgagatagtctctccctctgtcatccaggctggagagcagtggcacgatcatggctcactatgaccttgacctcccaggctcaaacgatcctcccacctcagcatcctgagtagctgggactacaggcatatgccacaatgcctggctaattaaaaaagacaattttgtagaggcagagcctcactatgttgcccaggctggtcttgaacttctggactcaagctgtcctcctgcctcggcctcccaagtgctggcattataggcatgagccactgggcctggcctggattttctttttaaagagactaatatgaaattttagggggagaatctcctgattattcaatattgccaataaagtcaattttttatttcttattcatttatttatttatttatttattttgagatggagttttgctctgttacccaggctggagtgtaatggtgtgatctcggttcactgcaacctctacctcccaggttcaagtgattctgtgcttcagcctcccaagtagctgggattacaggtgctcgccaccatgctaggctaatttttgtagttttagtagagatggggtttcaccatgttggccaggctggtctcaaactcctgacctcaggtgctctgcccaccttggcctcccaaagtgctgggattacaggtgtgagccaccacactcggctttttatttttaattttttaaaaaacttttatttttgctttaggggtacatgtgtgggtttgttccgtagataaactgtgagtcatgggggtctggtgtacctattatttcatcacccaggtaataagcatagtgactcataggtagtttttcgatccccacctcctccccgtctccaccctcaagtaggtcccagtgtctggtgttctcttctttgtgtttaatttttaaaataaacacttgggtgaacccccacacaaaggtgtggctgggttctgtctaggggttaccaggtctagacttctgatttgagccactcagtgcagattattgctgtcctaatgattgtctccttaaaaaaattaatttttgaaaactgtcctatttccttcaaggaccttagttactttgtcaagaacacctttttcatagccagttcaagtgactcctgcttcattcacaaccgccctgctctgtgcttcttcctcacagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagtaagagacggggctgggcgttttctaaagtcattggtctgagactcttaagtggaagcagcagatgctttgggtggtcatgttcagccagtaccatcgtctttccattatcctctgttctggaaactgggagagatggtctcactatccccttgtccttcagcttccttcagcctcttagaaatagtggcaggatgtcattccatctcattctcttctttctcctcaaataaatggttacttccaggctgggcctggtggcgcgtgcctgtaatcccagcacttttgagaggccaaggtgggcagatcacttgagctcaagagttcgagaccagcctgggcaacatggtgaaaccccgtctctattaataatataaaaattagccgggtgtggtggtgcatgcctgtaatcccagctattcgggaggctgaagcaggaggattgcttgaacccagtaggtagaggttgtagtgagctgagattgcaccctgctctgggtgacagagcaggactcggtctcaaaaataataataataataataataataataaaataaaataaaaggttacttccaaatcagactctactcttttatcctgatttattccaattaaataagcatttactgagaactttctatatacttaatcttactctattctcttttggctcttctttcacatttcaacttttttcctcgaccctccaaatggctatttgactccccaaatgtccagagttaggctgcaagtttgttcccatttgatgttgaccccagagctttatactcaagggtcccaagaaactgagatgtttctgttagaacagtgtggaacatcctgtacctatgaggcccacaggaatgtgtttctttctctttttttttggagacagagtcttgctctgtcacccaggcttgagtgtagcgatcttggctcactgcaaccttggcctctcaggttcaagtgattctcctgcctcagcctcccaagtaactggattacaggcgccagccactgtgcccagctattttttgtatttttagtagcgacggggtttcaccatgttggccaggctggtctcgaactcctgacctcgtgatcacccgcctcggcctcccaaagtgctaggattccaggcgtgagccactgcgcctggctaagaatgtgtttcttgaagctaccattataggatttgttactttctgttggaaaatagtttgggaaacctagtgagggtcttactttttcctgataacatgacagtttgtggatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcccttccctttcctccttccttctttttttgagacagggtctcgctctgtcacccatgctggagtgcagtggtgccatcatggctcaatgcagcctccatctcctgggctcaagtgatcctcccacctcaccctcccaagtagccaggactacaggcacacatcaccgagccagctaatttttgtatttttttcccttgtagagacagggtctcactctgttacccaggctggtctagaactcctgggctcaagtgatcttcctaccttggcccctaaaagtgctgggattataggcataaaccaccatgcctggccatggttagtgcttggccagattagatgaaaacaaattaataattatttgagcaaaagctttcctctgtgttctgaattgcacctgatacatttctgtcccttgtccacatctcctatcactgtcacagggaatggaaaataggagaagggcaaaagagacggggacacaggggtgaaataggagaggttctatccccgaatgctgtggaatcactgaagagtgataggctgaatatagctccttagaaatagtggcagggaacaggtgtggtggctcatgcctgtaattccagcactttgggaggctgaggcaggtggatcgcttgagctcaggagtttgagaccagcctgggcaacatgaagaaaccccatctctacaaaaaaatgcaaaaattagccagacatggtggtgtgtgcctgtagtcccagctacttgggaggctgaggtgggaggatgtcttgagtcaggggaggtggaggtttcagtaagccgagattgtgccactgcactccagcctgggcaacaaaatgagaccctgtctgaaaaaaaaaaaaaaaaaaagaaacggtggcaggatggcattctacctcatctcctcctgttatttcctatcaattcccatgccaagaactaaagtgtgagcaaaatgaacattattctgtttcattgatgatgtattccagagaacggtgccttgggaaaacttctgagatgaattttaaacattcagggtagggaaggacttaaggaagtcactgtaagatgctattctgtttcctccacaggccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataacacggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgattttttttttaatttgagacaaagcctcactcttgttgcccaagctggaatgcaatggcaagatctcagttcactgcaatctctgcctctcaggttcaagccattctcctgcctcagcctccccagtagccgggattacaggcacccgccaccacacccggctaatttttgtatttttagtagagacggggtttcaccatgttggccaggctggtctcgaactcctgaccttaggcgatccaccttcctcggcctcccacagtgctgggattacaagtgtgaagcactgtgcccggccagtcatccatgattttaatggggtccaaaggcctctttttctttgttaagtattcctggttgaaatttcttttcttttttttttttttttttgagacagagtcttgctctatcacccaggctggagtgcagtggcacgatctctgctcactgcaagcttcgcctcccgggttcacgccattctcctgcctcagcctcccgagtagctgggattacaggcacctgccaccacgcccggctaatttctttttgtatttttagtagagacggggtttcacggtgttagccaggaaggtctcgatctcctgacctcgtgatcctcccgcctcggcctcccaaagtgctgggattacaggcgtgagccactgcccccggctttggttgaaatttcttaagtgccttcctcacttcctaaccaccttctctgtttgggtttgtgcaacagtaaattaaatgtactttccaaaaagaattggcctaaggctgctcagtgcttcctgtgttgttatttctgtttcctttggatgaaaagaataggtgtcat

SEQ ID NO: 11773 - DNA, 40261 bp, Human
ggatggtctcaatctcttgacctcgtgatccacccgcctcggcctcccagagtgctgggattgcaggcgtgacccacagctcgcggcccattttacttttaaaccgttatttagcacccaaactcagggatacttgggagtagaaattagaacgggacagataagtggggagactggtgttgatggaaacctcagtgagaaaagtgtagatgggattacagttgacaactggttgccttgatttaggataattggggaaagggaggctggggcacattgaaacacccaggttgtcgctgcctaccccagctgctaacatgaccagctgtaaacttgctctgttcttagaaacctcccttccaaaacatggattctcccgccagtgctcaagatgggacacattaccactaagtaagcacttttcttaggagcatttcttaggctgttaaaatgccaagactcctaaccatccttggtagctttgaacctatgtaaagaggtcagttagctgccctagtttattcctcagaatgatgagatttggcactgaaaatattgttcatactgagcctcccatcaaatgcaataagtagataaccacaaatacccacccttttatgctcataactcagcatgttggaaactattttcccttgacctattgccagcccatcacgccccacacccaggagaactcaagccccaaaccggccgctgaatagtcacgcttttctgcaggacatacctactattagggccaaaactttgtccacccttcaaaggaagtcgatgtttccatataaaggtcccctcaaatgcaacagcaagcccgtgggagaggggttagcagaggctacggccagcccacgggctttcttcgaccttgattatgaccaggagtgtagctgttaattgcgaggcttgcctcaaggtggaaaacagtatcggtttccactgccaccccagagaaggcaagttccgcggctggcggtgctggggacacggtccctcccaggcccatctcttgccacccagagagctgctcggaggccgcctacaggtgcaatcccggcactgcggccggggcgtcgggccggggagggcgtccaagcccaccagcatctccgccggcccttcccaaagcctgaacagggccccggcgtgcccgccgccttctacccccggtttccccgcgcctctgccccggcgcggtttggataggaagctgggagccctcccaggctccgcagactcggatttgggagggggtgggacgcggccgaggcttcccctcgaatctgcggcaagcctggctccaggaaagtttttcaaagttcccagcagcgtctgcccaggtcgcctccgcggggcgagcagacggcggcaagcgcgccagcctcgccgccgcctctgccgccagcagagcgctctgggcggctcgctcgcgggaagcgggccgaactcccggcgggcaggcaggccctcctcccggggcgaaagccgcagctgacgcaggcggttcggaaggcggaagctgccccgctccgaccgctcagtcagcgccgcggcgcctacacctggggccccgacgcgcgggcaaaggcgcacggcccggggcgcccgagggggcggtccccgctgggggcctccaggcgtccctgagcaacgatcccttccaagtacctccccgcactctcccttccctcctggcccgaagctcccgagggcgggggttggtgtggggccctggttcttctacgccgccctgagcatcccgctgcccccaaccccttccaagttcctcctcgcactaccccctccccagcaacgtgaaggggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtaggagcccttctccgggcctccctcccagccgtcctctccctcccctcgcggcgccctgggcggttgagccccgcgagcaggctcggcagccctcgagcgcccgactcctcgcccctgcgcccgagcggctgcacctgggctgagcgcgccaactcccccacgggagcccctgcctcctgagggtgacccctccaggccggacaggggcgcgttcgctccgctgttgccccccgggaagtcgtcggatttcttccgcactcgtgcatttttttttttttttgccccggaatcatgttgagtccttgaacgtagtttcgcaaaattattttcactcggcgaggagggctcgtcggggcggggagtgggagggagtcgccacctctatactcgaagaaaacagctttctcccgcgctgacctacctccttccctcgccggcaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccggtgagtgactactcgggaaggaggccgggcggagcctcacacccgcgcctggccgagccctgttatcccttgcgagagggatttaaagggctttggcttgaaactaggcgctaactggggaaatctctaggggtggcgggtgagggagccgggacactatagttagatctcggctggggtagtcgaggtgggtcccattcctgctgctatttgcttagtgcacaaaagtggggatcccagagggtttatgggaccaggctcctaggaaggccggtgtaaacttgcaacttgaagttcccagagtaactctcccggccccaagccaagagatcgttgtagctgatctctttgcttaactaattaaacctggtgcgccgtggaaggcgactcggcgcagttctggcctgcgaacgccgtccaaattggcaacctcccctttcccgtgaacggccgggagggcgggtgtgtccttcctggagggtgtgggggagtccgtttcccgctgctccccgggagattttagtgtgtgcgggggcgctctccaggttcggcttaagggccgggggcggccgccgcaggaggaggttcttggggccctcacaggagctgtagacctgggaacccccgcccgctgctggccccttcctgcccccgcccccgagtggtgtagctcttgtggcctcacttccagcggttcccgggctctggaacagctgtgtttgcagacttccccgggaagggcgggtgcacggcccccgcaagccttcgggggccgtgccaaggcttggaaggggtggtcttctggaggtagtgcctgagggtgtaagtgataggccctcatccccccgccccattccgcccccaaaggagctcgaggcccgggcccagctggcagatcctgcagcgaggcccttgcaacatcccaaaatgggtggaaggaagatgggtgcgattgcagaaggggaggaaagggaaatgttgggggtgtgccctctgcctggctcctgctgtccaggaggcatgactcattgccaagactggggcttggcctagcctgtgctgggagggtgggtggtgagagggggagctcggtgccccagagcattgctttccaccacgtgctctaatggggtgcactctgctgcctcctgtccgccggcttaggttgtgattctgggaggagacagaggggagactatctggctgtgtctgtgtatgaagcttggggtggctcttaaaatccacgattacaggagctggcattataaagtgccctctgctgtgggtgagataagacagttatcaaaaactgccatgaaaaggggtttataaaaagaaaaattaaaaccaacgctgtctgtgaagctctcttgaggtccaagggctgtttctgttgtgggatttcatttttaccaagagtatttatcttgtttgttaatcccctattagggagaactttaagctaaagagtctggctgcgtttaaatctggctggcccaagctgactgtgaatactcaaactgcccttgaacgtgtgtttggagtttagggggaaggggcctgcaggtggttccaccctcctgccggaggatctgtctggagcccctcgcttttcacaagaccataaaaggaatcttattagtgatgtggaaaagcagcagcctggctgaggctcattttggagagtagggtcagagggatggctaacatgaaaacaaggaggcttgctccctcgctggccaaggaaaagtgacctagaaaagtgcgtctgtccgcttttgacacttggtcagagtcctcaatggaaaacgagcggaaatagtgtgggagggtaggagaggcgattgatttgcatttgctggtgctcttctgtggtttcaggccccacgggtcaccaaccatgaaatagactctcggcttttctcgaatgggggaagaccgatggggcaccactgaaaatgtggttcttttgaagttgggacaaacgcatgtatcactcataaacaagtctccaccctgatgccccagaaaggcctgctgtgaaacataagatttaattctcaagagaaattggagtttaggtgtatttgtttttctgtatgtggttggagaaacggcacagtccgtaactttcaagaatgattccaggctgagtagaaacgtaactgaaacacttaagtagctgagcgagtatttaactagagggcacagcttcatttagtttggcaattaactatgtcttttaaaactgatttccttgaatgggaaataaatgaacttagtacagaattcaagagatagcaagaaaaggatatatggttaaaaacaaaacaaaactccaaaccaccttgggctcccaacccctagcaggcacaattaccatttgcatgagtcctcccaaatttgctgacgctgggtatcagcaaagggtgcaggggtaggtcagtgtagaaggtcatgtagttcatgctttttgtttggaattatgacccctatccaagcaactgttcatgttctagagaggacgaggaggaaacgatttggtcagatatgaaatacagtccatgttctggtgtgcatgtgaaaggctttgtagaggtggcccttcctgtcatatatcatatctgagtatgtcccacgtggtgtcccctgccccggctctggtcttggggtagtttttcaccactggcttctaattctcatactgttgctgctctaaggggcttaacttgcagcaactatctggattaatgattctcaaattgggggaccaagtgataagaaccattattgtgggaagtaattgggcttaacaggaaataatttaggaattaccacttataaatcactgaaacggttaatctgtacctcccaaaattagtgctaaatcccagtagtgcctgcttattaaaaatacattagtgtaattaccactactcatctccaaaagctttttgggaacttcagaaccccagttagctgtattgctgcatcggtggccccagagtgaaatgaatctagagaaacgttaggggaagaaattggggtatctggcttattagcctcatatttaaattccattgatcctattaaaagacttgctgagatcaactttttttttttttttttttttttttttttttttttttttggaaaatccaatgaaacgtgattcttctgtgtgagggatgccagctttggcccccttcatgcttcaggcctgaatgaccaattgccacgatgctaatcacagaatgtaattgacaggcccttacttttatgccttttgctgtcttttccagtccctgagcttctgtagatatggtgtgggcacatggagggcttaaggatggggttctgatttgacctgcctcctttctgcagccaggatttgcatcctgcccgtgtagtcagcatgtatacaaagaaagagcatgtgtgtacgtatgtgctcagagcaagggactttctgcatgtggagaaaacgccttttgccctaagaagtctacctcaaaccaaagggatgaagtgatgtatctgtgttgcaacactgggcttgggggaaagtgaagctgtgcttgctttgaaagagctgtgctaagtatctgcagaatagctgctccaaaaatggaatctttattccaggtacttggtttctaatttttttttctcttgcaggtgtaaccttctgtgttttctttctccttgttgtcttgtttcttagcaacttattcaaacctccagtacttataggaatttgcaacccaccagttccacacccgtaattctacagggacttaagatgtttttagaaaacggtgaaactttggcgtggaggctcttgggggagttcagtgggttaaaaggagagtcagcagcaacttacaggcatgcaacctcccagaaaatcagcaatctaagtgctgctcaaaatcttcacaccaaatagtggtgcctttggggaccttttagatagaagacgtggaaagtttagcatggagaaaaaagttacttaaaaaaaaaaaaacagtgtcaaggtaacaaggagccttcacagttcctgatctgaaaacaggaatgtgaaccagaggccttggctggattcatatcacccactggccccattgtagaagggccagaagttggtcccaatgtccggctttcaaggttagtgacaatgtaagaatgcatgatctctggatgtgcatacaattagcgttgtaatccataaatgcaaatactcctgcaaattcttccatggtaaacttctgtaaggcatgttgctcttccacctacccccatccttcaagcctaggatctaggctgctgagagaagtgactcttggcttcagcttttaaatatatatatatctctcaaaacttaatcttttcttccaactgttggaagatacattgggatgaatggaaagtggtgattctaaaatggtggtggaaatggaggagggtcctgggttcagaaaaatcccacctttactttggtgcatggcactgggtggctgtgttgtgacttctttgctgatttctgattaccgcatggaccacagcagccctgtgactgctgttttttttttttttttttttttttatggtgccagtgacatctaccattggtgcagtgcgtgtgctgggaagaaattccgcaaggtggctcccagtagttaaaggagtacataaatagtcaaacatgcagagtcctctaccagctcaacccagtttttatgcacttttggtaaataaacagaaaggcttcttgttcaggcttgctctgtgtgaaccagaccgttgtgcttggctggcttcttggtattctatctattaacctcgccacccttttgtaactggtgcatttaattatcagtgggatgcttttcaaacaggtaagggtaatgatgggaaagggggtggggatgtctcattgagagtcacaaatctggatatgagctttggggccccttggtgagcctttgagtgggctttgatgagaaaatcaccctttgtaaccagatcggactctattgacatgtcaagccctacagacttgattgctttctgtgcctgaagtcttagcctagatgctataggatagttgtcctttcttatctcactttcccaaaacccactcgcattgtgtgcatgagtacgtgtgcatgcgccacacatggactccctgcaaccttttctgcttaatatgttttgtgactggaatattttatactctggccacccagacacaggcaggacaatagagttggccgaattgactgaaatgaggattatggagaataatagggcctctccaaaaataatgctaacacaggacaagcgacaggaagcaacagttgagtcagcagagctcagggcccctgacgaaccccgggagccgactgactgtgcacaatggccgcgttggcacgtcgggcattcccaggatgtgcgtgccgccggcgggcctgcctgtcgcagcagcctggggttttggacgccgcacgcgtgccgtttggatggcggtttatttgtgtccgtcagcttggcaggaggggaggcagccgcttctcagggcttggtttggctgtcactgttgccaggaaaaggaagctcccggctgccaacacaattacctttgtttcttacatccccccttcttaatgtggcaattaagtgcttaccgctctgcccagtgccaaggtaaccgccatggagtgggacagggcagagaacacaaccttggcacagcagcctaagtgtggagggcgggaggaggtgcaggggccccagccttgctgggaacctggtggcccttggatgccttggggctttgatgccaggactctcctctaggtagaattccacagaaatcttccaaaaagcaattccgaaggctgaccattcctctttgatgccacaccagaatgggaaccagctgccaggtttccagatttccttgggcttggagctgggaaggggctgaagtgactcactttgcaaatccagactaaagatctgtttgctacccctccttcctgtgtggccttcacagtactgttctggaaaacataaggaaagatgaaagccaggtgactcttcggcagagtcttagttctgtagtctgaaatcaagaaaaacccaggtatttgcttttgttgttgttgttttgctgtataaacttaagtttgaacacttgcctttccaagccctcctgggatggaggactccgcctctactgggggtcagagttgcagtggctgcttgtatgtgacttcggcatagtggatttgctgctctgtggcctggtccctgctttgatgtggggtgcatgatctgggatctcagtgcctgggtgtatgttcagggatgtacagaggtcaagtgtgggcctgggaaaaattaaagttctctagcaactaataatcattgttaaattatcttgattgctgatctatagtgtggggatggagtgggaggttgagtgcctcctaataggaaccttggagggaatcctttttctctgtagggctgggcaggaggaatcctcctgccccaggagaccctaatcccctccctgaaacagacaggaaaaaaagtccaggctttgttgccgtcactgtagctccctgccctcaccctgtctctgcctctgagaaagaagggcagttcctggaaaatcacagagccaggcacgtagggctgtgtgcaattcttttctctccaggtggggtgatgtcggtcagcaacttctgaggttttcccagttctggcgaggatgagcctggtagactgcttggtcgtccaagttcttgtgcaagacctaaggatgctttcctctttgagtattaaactgagttagtactgccatgccagctcagtcccggcaccttcccttgcagtggggtttgtgggtattatgtgtttagcgcttgtgcaagtctgtcaaaactcctggtatcaatgcatttaatcagaggattaattacaacaatactgttgaagtggaggacgtgggcctcaacgtgaccagcaaatgaagggcttaattatacagaatcagccacacatctggcctcattttgactgtgctcttacctcaaatcagtagagaaatataatttcttgctgctcttagggaagagtcctgtaatttgcaggaagtcctaagaaacttaaagaggcagtaaataaggtataactttcgctaataaaatagtaacaacagcaatgaatttggacctgtggccactaacaggagagggctgggtatgtgccctggcttgcccggttttgcttgcttttctgagcattttcccacagttatcagtgaacgaaatggaatcctactctgctttgagtatgaaacatatttcggctgaattccaaggcagggtctatcacaagatatttttatattcagagatgacctgctgtgtcactctgagagcgctaagctggccttgagttatgaatgaaactcccttttaccctccctttttctctttttcctttatcttataggtgctttctcttctcttggcagcagtgtgcttctggtggcacagcacggtattatttaatctatacacgcttctatttcctatggcttggtttctgacacagcaaagcagggattcataacctagttcatgttccttgtctaccccacctgccttgagtacatttcttcagtgccaagatagcagaagcttcatttaaacgctggtgttttgtgagactgaccttactgtaaattacgaaggaaaattttagaaaaggagggaatttgctaatagcttaggtttggctgggggtggggaggtggaattctgagataagcttggaagataaaaggtgccttcagtttaacagctggcatcttgccagtatccagggaatttgtttagttagtagactctgattattcttggaatgttagatcttattaacagataagttcatcaataaatataacccatgggtgtgcggttgtttctccctttgtactttcttccctgggatctgcccccaactccaccgcccaagtgaggttgacttctttgtcttgcagagtcactttgcatctaccccctcctgtttcctagagttacccgatacttgtgggagccaggatggtctcacatagacagagttttcaaaggggttctaaaaaggaaaagggggcctccctagagactgcctcaccagggcccaaagtgtaaccttagcaataccccctcggtacaaatacctggttaggttagcttagaataaattctttgtgtgtgtgtgtgtgtgtgtgtgtgtgtgtgtgtgtgtgtttcctcatgcactagggtcagggtctggaaagttttgggaaactatatgctaaatactctcatatcatatagtgaggtggcatttcctgatctcaactttgagctgcctgcatgcatgttgactccagtgcgtccctgccaggtgaaaggagtcatttgtcaacctgggaagagtgctgacaaaggaaggggagttggtttggatttaaacatccaggaactcaatgcaacaaccaacagaatttttattttggcattatggttttgtttggtggggtattctgggaggccaagaatgtacgagattttggaaagtcgaccctgtttctgaattgctaaattgtttgtttgtcttgcagaggtcctatacgttgcttgtggaggcgtgggattccagtaatgacaccgttcgtaagtatcgcttctgtggacttttctctaaacacacgtggaagtgtggggcttggccaaccagttggagctggatctgtctccttagtacttagcatttctgccacctcttgccttctgttctcccctgtaccccagggtgaaccttcagtggaatgtattccttaacttttctaggatttttgcttggaatattaagtggccagaacagaatcccagttaactcattccctgattatgaaacctagattatcttcgggatagagatcttaatggttttacaactttaaaaccttgtagtctgctaaaggatcaaagtagtgactttttaaaagtccatttaaactttaagtgagtgtttaatctctcatcagaaagataaagccataaaggtggtgctgggctctagagaccgaccttgaatttcacttggtgggcaggtgagcttctagtctctccgggtttcccacactgctccacaaacctttcattgaagcgcaattccagagcttcacagccattacctgccttgtccctttctgaaagatggctctgttttcagtgcaggttgcctttcaggactgaggggttggttttggtggataagccatggaggatgtgattgaaatgacatagtctggcttacaaagtagtcttgctctttaattgtaactttacagtgttttcgctcacgagccgaaacttcaagttccctttttgccagcagagtttgggttgcggtcgctggaaaacttgatgcgcactgaaatctcttggtctgtgcatgaggaagagtggatccagcttcttgtcttggctctctgttctctgaatgccttgtactttttgcttttctatcttaccattttttttttgtttgctttcactgtgaataatatattttcatctttccttgccttgctttttttgctgacagaaaatggtgaatgcacaccgtgggtgcagtgagggcttggtgcctgctacgtgggcagcttccacctgtggctggcttattgggctacttggagccacagaatcattgctgagctccgatgtgccagagagtcccaggccatttgggtcactcttctagcttgggaatcttaagtccagctttttggatgtcatcctccctggagggggagctcatgaaagtccaaggttcgagtcttcctccccagagggctaccctgtaatgccgtgggggggtgtgtgtgggggtggcagggaagctctgtcagccttggctatggctgatgccagtcagggtcatagacacctgtttgttctcccctccctgccacaaacgttgaggactgtgaacattatgtcactgtgacctgcttacaatggtaactaagcgttaggcagaaggggttgaggaggggggagacataggctcttctgtaatagtatggtgtcgacatggtgttctttcccctcccttttagctattgaaacaatccacccggtagagtgaacagcttgaggttgatcctggcctgtgataagagccaggtcagtatacttgttagggacatgtgagagacctccccgccacactgcagcattcacagcacctttcctggacctcctgtcacctcgcaggtcagggagttatgtcccctgggaacccagggcttgtccagagctacccacagttgtctgcatttccaggtagcccgattttggggttctaggatgtttcatctcctgggggggtaatcaaatccctggaagaggacaagaaagactgaggtaggaataaagttcttttaaacctcaagggtgcccattgcaggttatcaaaactcacttggtgaaccctgaagagggagatgggtttggtggaaatggtttctccacttgcctatttggcctcttttatgatgcttccaaggaatcttgaattcagcacagtcaaaaccaaactcaggatcttctcttgccaaaagcagtcccttcccagggccccttctgggtgtctggcaccgatatttgaacactcattgccataagccagaaatatagaaggcgatctgtgtaccccctctctgttagcatccatacctagtccacctccaagttctgaaaaatctctccagctcttcacttgaatctgcctgccttctgccactgccctggtccaagtcaccatctgctcatgactgaacttagagtagccttcgtctggtccacctttatctgctctgactcacctctagtgctttctccattcttctgccatcctggtcttttcagagccataacatttgcttgtcacccttattatgaaaaaccaaccacttggtggccttctgttgctcttgggacagatcttcatgtggcccacaaggctctgtgcagcccagctttgtctccctgccagccttgtcttacacaccgtgttgtccatcgtatctgtagcctggccataccctagcagttgccttcctatcctcaactacatcacatgctttctggcctcaggacctttgcacatgctgtttatgctacttggagtgttttgttcctttcttcaccctcagccactccctctggactgcactccacagggcagaagctgaggatgttcagaagcccaaacggagttggctgccctgtgggacccaagcgagttgtaaacattctggcttcagatgtaaatcaaaggcagagccctgagttttagggcagagaattccttctatcagctctgcagtgagccctcacaggcagactcgggcccaaatatagcctaggtgctgtttatgtatttgaaagtatttaaggctggtccttctgtcatcggtcctccaaagtcttttattacattttgggactgtggtatatagagttccaaatttctttctcccctagagcaaatggtttcagtttactgtaatgcataataaacatgtaaacataaataggcacacttcagaccaggttttccctgtagcttagctttctcggctaaggcccccttccaggtttttgggtcggtgtggtcccaggttatgctcagactcgcccttcatcacctcctccttggcctgcgaggcggtcatggcttcttcgtgactcatcttcgtggcactggggattgcagggaggcatggtgatgtccttttccagtcacaaggctggactgccaaacgaactgccacagattcctttccagtgccccaagctgaaggaaagcgtgatcaggaagcaggcagcagacgtatttgaacccagacatgctcgaccccctccctgagcaggtgtgaaattatgtatgcagctccatagctccactgaggattctgaagtgatcctctgcacgacacttcccggaaataagtggaaagcttactgcatgactgaaaagtacatatcagtcctgcacccctaggattgccctggactcttgtctaaactgtttgttgttgataccagcctcagaagctggatgcctttaagccatggctagtgtgtttaaccgatcccttttatgaagatcttgtaagcgcgtggtaatagcccactatgctttttaactgaaccagcagagcaaacatagttaatggagagacatttttgtcattccttggcctctgtttatttgcaaaaacgagtaaagtgttacctgcctgcaagtggttcagtgcgtgccggggtgtcaggctgcaggtatgtgagcttgttcaaggcttgtcttgcccacgcagcagtttgagagccctagagggcgaacgctggggccctgttggaagcggtgtgtggatgaagccacccaggagtcccttctctcctggtcacttatagggcttgcatcactttttaaaggagcactggcccgaggcctagaaaaacagccatgtgggtgggtaagaatcacaaagacattgcaagtcagtcctaactgtctctccaagatggtcttgaatttgacaaggtgatgaagagttggtgctggcaggtttaagaaaacaaacacaaaaccaggttggggtgctgatttagtgccttgctgccttttcagatccctcccctgaactgctggcacctgatgtttgagctatttttgtacctgtctcttctcaaactagatgataagtggcctcagggcagggactacatactcctgagagctgcttgagctcgaggtgtttattatcctcagtaagcattttttttcaggagcatgacttggctcaaaaaaacaaaaagaaaaaagaaaccctcccctcaatttacctgtgtctaaactttggtgaattattctcccatctgccttctgggcagaggagaaaggtggaatgcatcaagttcaaggtcttggtatttaagagctggctttaaaggttgccatgttaacaattgtaaaaaaaaaaaaaaaaaaaaaaaaaaaagtaactcaatcgtctccttggcttccagttaagagttttgaaatggacaaaaagcttttctgagcaagacataaaaccctaaaaccagaaatgattgctgacctttatctggaataatgaaatttcttcaagagcaacattccatagggagctactgtctctcatatgtaaagagcacttgcaagtcagtatggcaatgtaatagaaaagttggcagagaagagaagctgttgctgttcacaggaacaaatataaatggttttgtaactaccagaaagggctcttgccatcacttagttaaatgctaattaaatgagatacctctttacctatcaggcatagattagaaggtttgataatgtacaacgttggcagtgttattgggaaacacagcttcctgggtggtgggaggacagactggtagtttgagactgtggacagaggttgatttgttgtgcacggactctgattcagcacttccatttctagagtatctcattgtgggaaccatacacaggcagatacgttcaaggaatgctcactgtggctttgtttaatagtaagaagcccaaacgactcacatgcacacatgtcagggactaggtaaattatttattggtgtttccagacaatgaaatactgtgtacccattaaagaaggtaaacaagtggtaacaggttgtctctgggtaggggcataaacttttcatttctttgccttttttacaacagatagaattttgtagcaggtgcatatgtttttattttaaaaagccaaaatggtcagggaagaaggctgcaatgtgaatattaacatgattcatcactttgtctctagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagaggtatgtgtgtgtgtgtgcatgtgcacgtgtgcctgttgcttttagtgtccatttatcaccccaccagcaggcaggtggcatgcggctatctcaggtggggtgggattttggctgttattctgggcctgcagtatgaagatgcggagtgtagaagatgctgttggtgccccatccagatcccctttactggcatccccatcccccaggtgctgtgttggctgccaacagctcacagctgctccttctcaggagactcgtccttggccaaaccagtgcatgccccattcctccagctcacagtcagtgattgacagacatagggctacaaagcccagcttcctttgccttaaaacagtagtacaatttgcactctagagcttaccctgggattaggctgaaatcagactccagttgagaccatgttcttgctcagctctttcccctaccccatctgcttccctcaattccttctacctatgtccagatccccttctcagactctgcttctaaggaacttgacccaaaatagatccagacaggactaggtcagcccagttgttgtctgaacaggctatcctataggaaatgatagcccctgcattcagggtagccttgcagcaagttttcactaggtgtctttgggggcatggctttgatggggagaggtatgtggttagctcaagctttcctattggtgtaggagtgggcccacttttagtctctgtgctgtctactgtcccagtccctttatagaattcagtgattccaattcatagcaacttgatgggtaattctgttaactgtataatatcccctcatgagcaataatgtactctgcttattttacatgataattaggtaaattgttttgatagactcaatttcaaagtgagtttttcaaccatgagagaggggtgggtcatgggggaaggaatttacagctctcccgggtagtactactgctttcttaaataattggagagaagagtttaaaaaggatggcatttctggaattcaaatgaaaaggggaattcattaacatattttagtgtgttttaaaaattaaacgacctaacacttagtgtgggttttttgtttggtgttttttttttttttttttaagataaggtgctcactttgtcacccatgatggcacaatcatggctcactggagccttgaactcctgggttcaagtgatcctcctgcctcagcctcccaagtagctgggactataggcacatgccaccacacccagcttttttattttgtgtagacatagtcttgctatgttgttgaggctggtctcgaactcctggcctcaagctatccttctgcctcaatctcccaaagtgttgggattataggcatgggccactgttgcctggtcttagaaactgacattttttagaagttacttttttcttttttttaaacgaagtagagaattgctctgcaaggatactttataaaagtctcaccagatctggccaccagattagcctgcccaatgagtccagcctggctggctctgttagtcccatggaattttcaaaccaggcatttggtatgggttgtttttttttttttttttttttttaaaggctgaggctcatctgaatgtgtcctggtgggatggggaaggattatctatacctttttttcttctaatgaaaagggtgtgggcagaatggaaactgaccaagctctgctcaaggagccagggtagctgtggtttagagaggctggacgaaggtcccccttccctcgtcaacttgtctgcattttgtccccaaacaatatcatgttttcagaatctgctaacaaggccttgaagtttaaagctggttttgttatttgggcccctcccatcttcctctccttacaagggacttgatatgagacctgttaaaatcgtggaatttgcagactttaatgcaatgggccattctcatgaccggggcgatgcaaggaacaggcagtgtgctgacacgcccttctctgttttttacagctatttgccgacaaggctgcagtcctaagcatgggtcttgcaaactcccaggtgactgcaggtaaatcaactggtcttttgtgagatttcttttaattttcctttatgtaagagaggaactgactttattgtgactatgcctcttttttccttggagaacaagaaagcttttttaaaaaaaaaattcagatagacacatccgaagcttattaaattataccagctgtctggtggaatgcacacaccacttctctcttggaataaaaagaaactctttgggcatagccagtgacttcatgtattaactgttctgtaaattgataacacatttttataatcttcccttatagtgctgatgggctagatggagggatgtgggcttgtttctttgcgtctctctcctcttccaccaaggctttcttctcccagccccctccccgacttttcccatcaataggcgaaagtccagcattctttagaatgggattagtccaatctcctggcccctttgcaggcgggagctgggttggtgctgagaggttaatggctgccctggaatcttgtcagttgagcctgatgaatgtagacttttgctgcagtcctttgaagtctgttcctttatggtccaggaacaatgcggaagccaaagggaggcctgccctgaccacttcacgatggcgggttttggaacttcttgaaatttatattacgcccgtttggaaaaggcttattttgggaaatattgttggtgtctgtggtgtttttggcagtcttaatgctttgctctccctcctcccaaattttaaggagtaacgctaaatggatcctttgagcctgtcacttttgcccccaaagctactctgacatgagtaaagggaatcttatgaaacatagtctaaaccagtatgtcccaaactaatgttatttggggctcttattaaaacgcaggtcctgattctataggtctgggctgagcccaggtttctgcatttctaacaagctcccaagcgatgctgctgatggaaccatcagcaatcactgcccccagacctcagtactcaaagtgtaacttccagaattaacaagggagctgttaaaatgcaggttcgtgggctccgtcccacatccatagaatcctagtccttggtttggcccaggagtctgcatttgacaagctggccacatgactttgctgcttagtaaattttgaggctactcctttaaagagaactatctgtggcctttacctttatgattccaccgctccgtctgttcccctcccatgcaagggggaacatggaactaaattaagaactggttgtcccgaattgtctcttcctacacttcagaaagatagtttatttcctggaaggctgaggggcttctcctgctgtctcccattggtggcgatggactgtagtatttaacagcattgctgtccaatgcggagcaggaatccacctaccttaactcttcctaattaagggtgttctggagaaagtcccaatggcagtgctattagtgattccaagcctgctgcctgctcagatggatatcagcggaggccgactgtgatttgtgctgctgtcatcagaacacacatacagctatacaggggagggccctcccagccagaacaacaggctttgtttccagaatttagccctttctctttcgaagtcccacctccctctccctgcccagacacgcactgatggccttatttacttaaggtgcgactttcccacacatcatttgcatagtctcccagcccagttttccctccctaccttgaaagaaagtcaaaacagaaccttcacgctgaggaagttcaggttgtgtcctgctgcagaaatagttgaatggcaagttacctgcaagttgtcttttggattatgtattacacaggttattttttttttcacccccacatgagaaaatttactggtttttgttgttcccaagtagactgagtccctttccctgggtatacatgcttgcttattgcaagcctgccaataatatcaaacttaattatgaatcatcatctgaggaaagtcacttcaatttctcatgagaatcttaatcatatattattaaactgggataacttggttggtgcctcttttagggtcagtatttttatttgttttcttttgaagtcatccatggcctcttgtggttgcttttttatgcttggggattgaggtctctttaattaggtgaggttgggtcctcagctgcctctccttgcctttatgaggcaacttgaagagggctagtgatcctgaatttggaagagaataagggaagacggtgagaatattgccatttcgtaatcagttccctcttactatctttcaggctaagaatatcagccttgacagaatggctacacccttacctcccactaacgtgggtgtccgcttttgagaaattatttagattgtaattttgttcttatcttactcctttagtcacttgtcacgttgacattccattttacataaaccagaatccagtgtctaactttaaaccacacattctagtgatttctttgcatgtgggtgtgcatagcttggtttcagaagttaggaagtggttagtcagtattctcaggggttaagttgactctcagccgtgggtgattagctattagctagatccctataattttcccatgacaaggatttgctagcctgcctcccgctcttgggaaaccgaaagcctttccttctggggagctagagggggcgggggttgttttccagagttacagctgagcagcttagggggttggcgctgatcgtggcttttcccaggtcccgttctggaaacatgttgcccatcccacccgcaccccaccctccaccctccaccctccacgctccaccgggaggctagttgatgtttctccctgccttcccccacccttgttaaagcttggctcttgagaaggcaattaaagtttcagagggcttgaaaattcaagggagagtggtttgagacgctgccccctctcccaccccagatgaaagttgttgtatttgtttttgtttttgcttggggatcagaggcactatttggccccaaaagagtatgattaatcaaggtgcttatataaaagaacctcaactccgccaatactagataaattaagcagactgctttcttttttttttcttttcttggcaaagcaagaaatcactataaattagcacacagtaatgggacacaaattatggagttggttccaagtgttgtcatttccttctccttccctatagaagtgggtttagagagcctactctggctttggccaagggagggtgcccctttctctccttgtttttttaaataaagcgtcatcgtgaggcagtttcctgctgcacttggtggcttgttgcatttctgtgcactggggtcatgactttctgtgcagacaaagagcagagtggcaagtgcagcgtctgcagagactttggcatagctctcttgtcaccgagagagtcctttcctctatagtctgtcgcaactaggtgcacgggttgatttattccatgccttcacctttggctcactcgtgtgagcctgagaagagagtggctttgtgaagggcatccccatgctggcctcttcccaaacagccctccttttgtcaggagtcggctgggaggggacctcagctcaactgtgaaaatgtttgtttatacggagcccctgatgagccttgggagtctaccttcctgtccccagaaacaaaacagaaaaagcctggactttgcagtcttccatttgaattgtacaggtgtctcttaacgttcaaaaggctaacctggaggtgtgctgtgtgtctccaggtgccagtacggctggcaaggcctgtactgtgataagtgcatcccacacccgggatgcgtccacggcatctgtaatgagccctggcagtgcctctgtgagaccaactggggcggccagctctgtgacaaaggtatggcccttagggatgagacccagggtgggatctgggggtgggatggcactaatttggtttctaattttattggcaggggcttttattctgaattctccttgaatgctgtgtgggttttctggtttttctttttaaaagacgactggggctagaaacatggtgggttcgccatcttcacaggcgtctcttagtgactccaggatctttttggcagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaagtaagtccaattttcagcctgtgtccattctaaggatccttgtgccaagataccacgctggggagaggtacctaggcttgtccagtgtgaatgtctcggtgagagaggggcgggtgcaggcctaagtctggtaagcagtctggtggcttgtgtgtttggaagtctcccagcacccccatcctgtcccactaaggtagcgcatgtatctgttcttggaaggaacgtcctcgtggaatcgcttgttcctttgcatctgcttcctggagctggccaccttccaattgtggttattcttcttgcagccatggagaggctgccttcaggggaggttgtcacttactactggattctgtcatagggccagggggccccagagaagaacctggcctgcagagttcctttggctgtgagacagggctgtatatcagaatcacctgggctgctttacagtgtaaatctctgggtcccccagattccctccagaatcggggagtccatggtctttgataaacttctggaattctgcagtgcagccaggtctgagaaccgctgtcatcagcaccccaggtgtggttatggatgtggatttctggggtcagattgcctgtgctggtcctaggcccccacctgtcacttgcggaactccagcaggccacagaagctccccgggccctctttaaatggcacagtagcaattcccatctccgaggttgtcataaagacacaaaagtgaatacttcataaattgttaggagttgtctctggtcagagcagaagtggagaatgcagcctctaggtgtgctattttgggcaaactctgtaagcaaatgagaggaataaggttttccacctgtaaagaactatttttcctgacttcttagctacttctgagccatgatgaaacttttctttaaaaataaagattaggcagatagagatgtcctgtgttcctcctgggcggatgctccgtcagtatccagctgtctttctcccccactgcttaggttggggattacatgaactggggcagtgggggatttaaagctaaaatcaaggcttcggccttatcgtcaccgtcccacttgtcctgctgtagctttccttgtagcaggtgtctggctcttcaatgacagcccctcatgtaagaggtgatgttaaaggatctaattgtcagatggattgaattaaattgtcaaccccctccttttcttgttgaccagacattgatgactgttctcctaataactgttcccacgggggcacctgccaggacctggttaacggatttaagtgtgtgtgccccccacagtggactgggaaaacgtgccagttaggtaagaacatccctgtgactgtaatttttataccaaggttggctttgattgtcaaagccattacagaagacgagcgtgtggccggcagtgtgagttcacactccatcatgctaagaagtaatttattatcaagagtctagcaggcctgggagaaataacttgaatgcaaatggactagctcttttaggccctgtgggaaagtcgtgggattccttgaaccatgtcaatcgtctgtccgaggagtgttcagctgggttccaaaaggggatgatctcatgaggaatgagctgtctgcattctttttgccacatttaaatcccagcaactaggctgcctgggttttgcacagaaatgcctggtggctttctgctgttttgttgggggctggttaactagcagctggaaagttatcaattagggttcttattggataatagctagggagagggatcagatgcttaaaatagagggaacctctagtatcttttatttagctagcttattaaaatgtctcatgtctcagacaaactctggcctgttctttttttttccaaggtgggggagatgggggttgaacttcatttctcatgctcatccccatctcctttcagatgcaaatgaatgtgaggccaaaccttgtgtaaacgccaaatcctgtaagaatctcattgccagctactactgcgactgtcttcccggctggatgggtcagaattgtgacataagtgagtgactttgtttccattttgattttcatgaaacttgggtagccgacttgctggtccgtactggggctccagtcctaggacttgagcagtagaaggaaaaccttagagtgggaatggttttttgagagggagtggtcagggcagcagtgaaaacatacactttatcaggctcattagctgcgaaaaccagccatattctgataatgtggctgaaacaatgatgtgaagtttcactccctcattctggaagaattagggagggtccccacccagcgtaataaccttatctcacggaaagcacacaggaaatctgatttgaaacttatctatcctgagctgagaaggcttttcaattaagcccaatttcactgtaaattacctctttaaaatgatgacttatttattttttagatattaatgactgccttggccagtgtcagaatgacgcctcctgtcgggtatgtaaatctttgcttaaatcaaaactttgacaattgacaacaaatctttagatttgtgcgacactaggagagctctgtccctgtgagatttaaaaatttgggtgaaaaaagagtctcttggaagtttcgctagggcttatgttaccccagcctcgtgggagtcattttgaaggcatgcacatagaaattcctctaaccactttcagaggtttagcatttggctatttcagtgaaccagctaaaccgcaacagtcatgctaaaccgctgaagccctgtgtttgtggaatacatagaaaaaaagcatgtgtctctctctccccttctcctcttctaggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcaggtgagtggtggcaaaacctcagatggccaagtttttagagcagagccgctgcctcctccgcttccctttacttttccctcagctcttgtgtctggaatttcctaacatctattaacatcctattgatgagagagtctctgctagacaaatgctggtggaaggagatactgacgaattattttcttcttagtgtcttcgtctttgtgttctttttggttccctccaccccctcttgtgctccctctcccactctgccccgttgtttcaaatactggacattggcagtccctacagcatagagatgtatcttacagggtgtctcctaatagaaaccgaaggaactgtcagattccagtgcctgctgccccagagaagttatcgtgacacctttgttttactctgatccctcccccttttcgctgttcctgatatttgcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaaggtacctcccttctcccgggacctggctgtctccagacttgctccttttgtccccacttactaccactgccccttgttacacttgagaagtaatgtattggtgaggaggacctctatagtgaaatgatcctgcctgtgtagcgggccgcaacacgtggaaacaatctattccggcctgccagtgggagagccgtgtctacaagtagcccaggggagagaatgtgaaatccatttagcattcctgttctggggtgggctgatgtgcaacgctgaggcaaatgcctgagaacaacactgtcaacagaacttcctgcaacggcagacagagggggatgttctgtatctgcacggtcaggtatgggagccccaggccatgtggactgtgactagtgtaactagaaactgattttatttcattttagttcatttaaatgtaaatagccacatgtggccggtggctgctgtattaggcagcacaacatttaaagcttctataagattgtccttgagccttgcttaagatcaaaaaggaagtaaataaagcaggtccttttgccttagcaagtgtttaccaaattgggtagatgtcaaaggtaggatgaaggggatccacaagcatgtgggttttcctggttgtgtggagggagaaaatgctttaaaactctttgcctggagtctcaactttgcctgtcataatgtgatgtggcacgttgccagtatcttggcttccctggggtgtgtctcattagccagagggtccctgtctccaggaaagtgggcttggcccaggcccttggcttaggaatgccgcatctgtgggtgcatggctgtgatctgatcccaagcctatcttctagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaagtaagactccctcatccgggaatggaccagtgctccccagcctgcccctgcccctgcctctgcccctggcccaccctgggatcattggtgttgaaagttttttttttttttttgagaccgaatttcgctgttgttgcccaggctagagtgcagtggcacgatctcggctcaccacaacctcggcctcccaggttcaagcgattctcctgcctgcctcagccttcctgagtagctgggattacaggcatgcgcaccacgcccaccacgcccagctaattttgtatttttagtagagatggggtttccccatgttggtcaggctggtctcgaactcccagcctcagatgatccaccccccgacccccaacttggcctcccaaagtgctgggattacaggtgtgagccaccatgcccagcagtgttgaaattgttttaatcagaaacagtaaggctggggagactggttgagacttatccttacatctgggatctaagactgaggtcgtgttcaatttaccagatcactctgcctcggagcctccatatctatgttggaacattctggaatgttgctaggttgggtgattcctcttttctgtaggagtttcttccccactttcacctagtaccggtgactaaatgcccatgtgagggcattaagtgggtaaggcactctctggaagcttctgcttgataagccgcctgtctaatttgagaaacagccctgatggagggtagcaggtggaggtgccaggtgcattgtgtcaggagggagccatgaaaactgctgaacagtgcttgtctatggcttcacaagtccttcagttctttttttgctttactttgtttcatagatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaagtcatatttctactttcatttccatgggacttccagaggcccaccccacatcttgcctaacttgtggcattcaaagtaacccagttgggagctcctttattcctggaaaagcctgattgtgttaaagtactacgactgtggctgttctcagaataggatgttggatgtaagcagtaggaaaggcttggctctcgcctgtcgtgaatggtcctggatctcgtcttcagccgattgtctcccctttgattctagatattaatgactgcagccagaacccctgccacaatgggggcacgtgtcgcgacctggtcaatgacttctactgtgactgtaaaaatgggtggaaaggaaagacctgccactcacgtaagtggtagttggccttggatgctatctctgggacccttccctctgtcttctgtgggagggggccactgggactcacactgaaatattttcctccaggtgacagtcagtgtgatgaggccacgtgcaacaacggtggcacctgctatgatgagggggatgcttttaagtgcatgtgtcctggcggctgggaaggaacaacctgtaacataggtaactttatgccccacgtgggatctgcagtgggcatggccacctgggcgtgtctgctggttggcccctggagcttatgatatttctctgggcctggttcttgcccctccagactgtttctggatactcagggagggtggtcgtgtctgctcttcttttatagcccgaaacagtagctgcctgcccaacccctgccataatgggggcacatgtgtggtcaacggcgagtcctttacgtgcgtctgcaaggaaggctgggaggggcccatctgtgctcagagtgagtgtcctccccccttgaactctcccagggctgtcggagcagatcctgacacccttggggacttgcaatggaaaccagaagcagagctgtttgatgtctgcttttgtatcacctgggtctgcattaatgacttgatgggatacagccctgacctgggcatgagaaagtcgccaataagataagtggagacagatggcgtctcagttcccagctctgggtctgaccagcagcctgtctccttccattctcacccccacccctatcccctaccagggcctcttcctgtgtacatgtgtcccacagcaaatgaaactaagtgtggtgcgggcctggttccaatttagcaaaggtattttgctggtgttaactacgactttatcatttgggtattaggaaaataagtggtggttttacttagggctaagaccgctttccctgttgaagtcctcactattaagttgtcttttctttgcagataccaatgactgcagccctcatccctggtaagtgtgacatccttttaagccagcactcatccactatcgtgtgtgtgtgtgtgtgtgtgtgtgtgtgtgtgtgtgtgagaatcacccagggattgtgtttaaaatgcaagttctgagtcaggaggtctggggtggggcctcagactgcttttctaacaagctcccaggtgaagcgatcctgctgccccatggaccacactttaattagccaggttgtgtcctcatttagagcagtgatttttcaaccttggctgcacaccagaatcacctgggagcttttaaaaatcccgctgcctgggctgcaaccaagacctgtgaaattagactttctgggggtgggacccaggcatcagtattcttttaaaattccccaggcaacggccatggggtgagagccactgactgtaactggtgtggtgacatgtgagtgattggcagccagagtaatggactgggaggttggtaaccaaggtggtctttgctttcttagttacaacagcggcacctgtgtggatggagacaactggtaccggtgcgaatgtgccccgggttttgctgggcccgactgcagaataagtaaggactgtctccgtctggttttcccaatggctttaccgcttcattccatgcctcaccccaagactttcatctttaaaaacaaagccaccattccctttaagtagctctcatagagcaaaggatctctctcctccagctgggattaagatatgccaggctggatcctcccaggtacctgctggtagttccctgggtggtgtagccctccttgttcttggggagagagtgccagtcacagaatctgatgattaatctacagtggggtcctgaagaaagtatgtgcatttccccatgactaacatgaaattatgggcaagcagatgttaaccacagctacactggtataggataaagctaatacaaacggaagggaggacgactgtggcttccagaggcttgtctgtgctgggtctgatcaggccctggagaaatgactaaaacaggaaaataggggcaggcaacgcagtttttcaagaggcttaaagcatattattttgagccttttctctacttttttacaagccctttctcttacagaacaaaaaaggtgctagagtagttatggtttgattcttgtacccaaattgtctgaaattttactggtgcttgaaatccaagtctgggattaactagtcttcagcactagatgggggcaggttgtatctgtttcatgtttctaaataaacagttggcaaactgtggcccaggggccgtatccagcccactgtctgtttttataaatacagttttcttggcacacagccacacattcatttatgtattgtctatggctactttcatgataccacaagagttggatagttgtgacagagactatataccccacaaagcctaagatgtttactgtctgaccccttccaggaaactttgccaggcttgctgtaaattgcactgtcaaaggaatcaaattaaaaattgctgcctcccaaaatggttctccactgttagaactcaggatggtggtggtctttgggagccagtgattggaggtttttgcaatagatctgtttcttcttttggatgctgcttacctgagtgaaaattcatcaagcttatgatgatatgcttttcttgtatgttatgtcaataaaaacaatctcaaaacattgccacacaccatcagtccctaaacttgaactccatttctcctagacatcaatgaatgccagtcttcaccttgtgcctttggagcgacctgtgtggatgagatcaatggctaccggtgtgtctgccctccagggcacagtggtgccaagtgccaggaaggtatgtgtgccaggcttcagctgcccatgggtcttctggggtgagcgagctttgcagtcaccatttgacttttcacaaataagccactgtgctcagggaagggaacacacagtgggactacaagggaaagggaacgtgaagagtcttccccaaaacaggtagctgttgtttttggtcagctgttgccacaaaactgtgtaccaaaccatcccaaactgctgtggcttgcagcaagcattatttttattgctcatgatatgcagcatgggcagagagattgcgctgtgggttgggttcagttcgaccagtggctgtgtctggggcatattcctttcatcgccagtgggtaggtgtgcaagaggctagtcaaaggctctgctcacatcacatctgccaatgttacattggccagagcaagtcttgtggccaagcgcagagccagcaaaggcaggaagtacacatgctgttactgtgggaagaatgatcttaacatggcaaagggcacaggcataaccatttcataacagggaccaaagaattgaaccccgatccggttcacagaaaaataaactgctcacccgtctccacctgtcagtttcagggagaccttgcatcaccatggggagtgtgataccagatggggccaaatgggatgatgactgtaatacctgccagtgcctgaatggacggatcgcctgctcaaaggtaggacatgatggctgccgcagttcacctgtgttctggaatcagggatgagcatgcctgctaagctgccagcttctgtttttctccaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccagtatgtaacaacctttgttttttttttgaatggtggatgtctgcttgcttgctttaaaggaggaatgccatgagctaggatctacttctccctagcttacattcctgttttataataaagtaagcttgaacttagccagcctcaaagagaacatctcagccttttgttcttcctctcaatcttacacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggagcaaattcactgacaaaaagctttgcagacacagattgtcgagtaattttgaagaaaggctgctttgagtattcctctgactctcaagtctgacaattgtttttccagtctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacaggtaggtgtcaagtgggactagtttgtgtgatgatagtagatgatctcattatactattcaataaagccatcaggtcgagggattatctggcagtgccctaccctcgcaggagctcccaatttaactgagaactgagggcagcctactttactaaggtcacatggcccatgggaacagaggtctgcctcatattttccttcccaacacactatgcaacgttccctgcagaacaggtattgtgctagatccgtgacaaagccctaggacactgcttgtcctttgtccttgagtttgaagctgtacaaagcctgacttggcattttggtgtcctgggacagcctagccactgctgagctctgtgaggctcgatggccccgcaggggtgtccaggcttccctcctgaggatctcgagcaccgtttcagccaagggagagattgggcatggagccatggcacgtttgagctgtctgtgctaatttgaatcggatttctagttctgaaaaccaactcctgtactgagctgcctcagtagccagacttaacaagacactgctctccccatgcgaagtcaaagagcctgtaggagctgccgctccacccagtctctccagggataagagtatcaaggtctacaggggcctgatcccagcatttgcttatcaagttgtgaagtgaccatatgcaatgatgaaaagggacttgtccctgtggcccccctcttagggataaagggcaggagaaccactgttggtattcttttgttcctgcgatgatgcttttttctttctttcttggagagttaattggttttgtgcctgccttacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcctgtagtgtcgaggtgaattgtttgtgagcaatcaggggaactggccacagcactgaaagggttttaaagggtttggaattggtgttgggaaacgagcagggagatttaatgtctgcctcttttttttccctggctacttagattcatattaatgtcctgttgtaagggtgtggtctgaaatgactcttgtgcacatttacccatggggtggtttcctcacggcacaggaggtggtagttgcaagcttctggtgttcgggctcatcactcatcaccttgttcccagggaatgagtgttctggcctcaccatgcagccttggagtgctggtgttctggtcttctgtgaggttccagagttgggctgtccccacctgtcacgggcaggagaactctggttctctcacttgtggctggtggaggccctgcccccgcatcgcgtggtggggtgtgggagaagctttgcctctggcacctctgcggaaggaataagctgtggtaacaagcacatggacagcttccagcagccgtgcagagtcaccaggactctgcttctggctaggaaagccaaagctcacccttctcagagccatcccccagcacttcaacattcaggcctgtccacccacgtccggttttcatacaactggcacagcagactttgaatggaggaaaagctgatggggatgtttttctttgttctcggggaaacattttttcttctaggcttggagttgtgctaaggaacatcttaagaatgaaagatgagctttaagtgtcctgggatccttgtgcatgagcagaggccatcgagggatttgggattgtgacaaccctaagagggccaacactgttttggctcattggggaggtggcctgaaggacccggacagcgaagagttgaggtttccatgacatctccctgccctagcgtagctccgctttctcaccaatgtctgccagtagacagctgggtttccacaaggtggggtcaaagggagggagaaatctagatcctactagccaggagacagtcatttcgcagcagtggagtcaaacactatcctgaagcaaaaccttgttctggtggtttgtaaacttggattctgcaggaccccagaattccttgggtagctgccagatgcttttgtgccaagaaaaaaaaaaaaaaaagttgaatgagtctctgcaattctttattccaggagggaagggatcttgggattcatgggtgttgtcttaactcaccttctgtctgggacacccctggtattgggagggcatagatcagcctcctctggatgtggctcagtgccaggactttaattgtgaagggtggattttccccttccttcaggaagaaggaagcaggcaatggtgctctggttatcctggggttaggaaagttgagaggaagggactcagtgcctttaccattcattccccaggaacgccctgggctctctttaaaggggccctggaagaaaaaattttcagtccagaaacttggctaactagaactctagcattagaatatcccatgaaactccaggaaagaacacttaaagctggtgtttttttaggatgggaagctctgtcctgagattctatacttccatgatgtagaatttgaatagaaagtggagggggaggatgtatcttaattgactaaaagccaaaggagactcagtggtgatttgcgagagggtttacagtttgaagatgcagatttccaggactggtccatgaccctattagaccagatgcaccagaagtggagcctgggaatttgaatttttgacaagctcgctcttcctccccgactcatgcactctaaaaattgggagcaactctgctaaagtgctacagtaccagctcttaactaattataatgtttttcttccttgttaaactgaattaaatagcctggaagccagtttgttgctaaattgccacctgacatcatttttaagtaaaatgattacaccgccccttgagcaa

SEQ ID NO: 11774 - DNA, 389504 bp, Human
gggtgtttggtgtcctaggaggagtctctgtcctgagcagagacagaggaaggcagggcagcctgctcagaggatgagcccagctattctgggaagcaggcaggaagtggcagctccaggtccgggtgtgagggcagtagtgcaggtcgtggtcccagatggccacggaggtgtcagcgtttcactcccagcacgtcacgccacgtccctttcctctgctttgttcctcctcagctgtgaactgtctgggactgggccaggagacagtcctgggatagggaaagaaaagaggggcttccgggggtggggagcggggctgggcggctgctggctgagccaagtggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaaggctaattgggatcggtcgtggtgcctcaggcctgtcaatccagtacactgggaggccaaagtgggaggattgcttgagcctaggagttcgagaccagcctgggcaacatagcaagaccccatctctaaaaaaaaaaattaaaatattaatactagctgggtgtgctggcacatacctgtggtcccaactactcgggaggctgaggtaggagcatcacttgagcccaggagttcaaggttgcagcaagctatgatcttgccactgcactccagcctgagtgacagaacgagaccctgtgtctaaaaaaaaaaaatttttaaataaataaataaaggtttgttggacatgttagctcacgcctgcaatctcagcatttggggaggctgaggcaagtggattgcttgaggccaggagtttgagaccagcctgacctgcctgggcaacatggtgaaaccccgtctctactaaaaatacaaaaattagctgggtgtggtggctcacatctgtagtcccagctaccctggaggctgaggtgggaggatcacttgagcccaggagtagaggttgcagtgagctcagattgtgccactgcactccagtctgggtgtcagaaccaggccctttctcaaaggaacaaacaaggctaacatgttgggctttctctgcttctgggcaatgtccgtgaaattgaagccgcactggtgttgttccacccttccttccagctggtctctgaggcccaggccagatgcttctctggttagcagcagattctaggccagagcctgcctccaggtcctgggaaggctggcacgctcagatgcactcctgggcgtggccttcctccgatcacagtgtgagcgaatctccctgcccatcactctgctcccctggcccagaccaggccatgcctcagggcttctgcacgtgcagttttctctgcctgcagggtctgtccctagctctctacccgattcagatcccacaccagctcctggggcagccctcttgccctgcctctccccgagacgtcaccctttctcttttccccattggtggtggttttatgtgttcatttacggtttattttctctctccctgtgtctgttatctgtctctgcacccctggagcccagcgtggtgccaggcacacactacgtgcctcctgggttgggggcagcagggacaaaagccaggcatgggatgtggctcttgtgggatgcaccttgggtgtgactgtcacggaaaaggaggagacgtggggtggggaagggggcagcccctactgttcctggcagcagggccagaattgagagccagaggttgccactggagggcttcctggggaggcagctggcaccgcctgattcctgtttctgaatgccctctcactctcccccacccccatggaaccagaaccacctcgtcaggcccagcagcccttcagggtcagtctctgcatgggtggtaatatggcttacctgagtcctggtcagtctgtggcctgggagtccaccctccatgactagtggtttgtggcaggtgacgggtgagtggtctccatgctcccagccgctgtgtagaggtgccaacctgcccctcctgccagagctgggctcctgttgggcgggactgaggataccgagacagaaataaaactgctaaatgcatctgttgttgaataattcaatgccccatgccaggcctgttgcaaaattagccacttcctccctccaggcccatgagtgactcctggatttggtgaaagccaggcctagtggaattgtggcccggaaggttctctgggagctgggaacctccatgcaggagcccaggggagggggtgcttggccacatgcgggcccctcaatctgccctgtggagcccggcctggcctgcagccccctgtgcagggaaaaacccgcggttttccctggtggagggcacaggtcagagcgggcatggacagggcatgaggaagcagtgcagaggaagcgtgagcatttgtctcgggccagctggagaaaggaaatggggctgcttcctggagggcagagacatcaggggctgcgctgtcgggctcggcgtgcaagatttgtgtctcatcccagggttaggtgcctcccaaatgccagggcttcccatgggccatacacactcagtcgaacaagatttgcacaaaacctgggccataagctcgctgagcacttggcctgcccagccggtgacaatgagaaccgcacatgctcagccttccctggactcagggccctacgggtgctggagccggggcgggagagggccgcaggctgcccctgcctctgcatcctccccgtcgatgcctggggccactgggattggcagaaaagggatgcccccgagatgggcagccaggagaactgtctgtctcctatcccaatatgcctacctccctctctgaatccccatttccccctcatccttgcccccacacacccagatttgcaatgggacacacggccacctgggatgacaacccctcccagtcttccctcaagacaagtgtggccatgaccgcatggggccagcagggtgtgagttgaagtgtcccgcagtggcttccggggatgtgcagccctgccctgaggccctctggccgcctcttgctctctgagcagggatgtccgtgccttgggcctgaggctgagctgggctaggtccctgggtgtctggggccacactctctggtccagcctgctgttacaggggatgcctcagggccaccactggtcatggaggctgggggcgcctgcctgtctgcccgcctggagttcaggtaaacaaccccactgaggaggcacccctagccgtgggagttggcgtgtcctgctccccagggcggtctgtccccttggcgagatccttgctgtgtcagcagagggttttcctggcccagggtcttggggagcagatgatggggctttaggagctctggctctgggaaggcagtggaccctggagcagggatcttgggaggatggagagttggcggctcaggaaggaggctgctcaagccccggcctgctcactgggaagagcggtccttggaggagagagctcccgaggagaaagccatgatgctgtgctgcgctctgggccaccaggtcttgtctggggggaatcctgaccctgtgtgatgtgagtgcagggactcccccaccctccgaccaggacctttgtactctcctggccgtgtcattgcacaactccaggggccgtcactcacctgagccctctttgctcttcttggctgttccctgatatggccacgcagagactatctctaagtgtcagttctggactcagctggaaaggtttcatgacctcaagggacccatgggacttgagggtggggcagctgtttgccctgtggatcaaaggggagtgtctgggatgggatccacctgccctgccctcaaagtgctgggcagtccctcagagccatagagcctagggggtcttgggccctcttccccagggcatggcccaggcacctgctggcctgaggtccctgctgggcccaaggcatccctgccgtgttcagagttccacaggcaccagtccaccatgctggggcctactgggagagacagccacccgcctgctgtcgggagcctccatcaccagagcctgggggtgtcccagccaccctggccgctgtttctctgcctccgcaccggcctctctcctgagttccatccatccctgcaggttgggttctcctctctcctctgggatctgcacaggttgccattctctctgcctagactgggcctccacctctgagaagccctcccttattgccccttccaatgggctgggagagggaggaaggccaggtgcagaaagagaattcacctgcccggctaaagccccacctgcctatttcaaggcctctgatgccccccggcctgcaaggtgtgtgcatggggcctgtcccatgctggctcacccagctgctcagagaggcaagtggctcccgggccccacagtgacactgggggactctttgtctccatttggggggtgtgcaggtcactcctggtgccctggtcagcttccccaacctgagctgccctcagctcctggcttggccctccacggagtgggagatgcccccctcccctgccattatcgtaccttacctcgctggcggccatggaggcagtgagaagagccgagggagctggccggggcgcatttccgtgcaggacactggctgcctcccagctcactcttagcctggtcatagagcccggcagcatcttgccaggtgcctgtggtcccagatcctggggctgccccatctctggaatattgaggtgtggctggggctgatctgaggatgaatgtggctcaggttgccgggtgcccttgacgcattcccatgtcccagtggggaaaccaaggctcaaggaggccacacagcagctccatttccagggacacccagtgttctctgtagtgggtaggaggtttccctatacaggagaccaagctacagcaagaaagacttggccgggcgaggtggctcatgggcgcggtggctcacgcctgtaatcccagcactttgggaggccaaggggatcacgaggtcaggagatcaaggccatcctggctaacactgtgaaaccccatctctactaaaaatacaaaaaattagcccggcgtggtggcgggcgcctgtagtcccagctactcgggaggctgaggcaggagaatggcatgaacccgggaggcagagcttgcagtgagccgagattgcgccactgcactccagcctgggcgacagagccagactccgtctcgaaaagagacttgggctagatgtgaggagggactttcccaagtagggatgaaccctgaggacccacaccctgagccgccagtgggtcgtgttgacctggcagctccagggcacctgaggccttcgctgtccttccgcacctcgcccccttcccgagtggaggtgctctgggagctctgcctgcttcctcaagtctttcttgtttttttatgttattttattttagatttgaggagtacacatacttgtctgttacgtgcgtaatggtggggtttgggcttctcgtgcgcccatcagccggatattggacgttatactcaataggtaatttttcaaccctccccctctcaccctctccacctcccctttggagtcccagagtgacctttctccgtctttctgtccaagcatcccatctgtctagcttccactcatgagtgagaacgtgccgtgtttggttttctgtttccggtagttcacttaggatcatggtctccagatccatccgtgttgctgcaaaggacatgatttcattcacttcttggaggctttaacgcctgccctgtgtgagggagggcggagcccctggcccaggggcggggaggcctgtccacccctcccacccgtccccgaggcccctgctgcccagcaagaccaccaccctctgctccaggacagcgcagccgccatcagtgggggtgaggggacaaggctgctgggaccaggcctcgcccaggcagagcctcgccatttctggggtggggggtgcacaggtgcatctggtctgcccagcccctcctcaccctaggcaggcctctcacagagacaagacgagtgtcctagggcagatagggccacatccatggggtcacttcagtttgtcctcccggcgccttctaaatatactctctgtgggtgtcttatcacagcccagggagccaggcttggtgtggccggccctgggagcacagagccccgttcccagcagccctcggccctggggggcttgtgctctgccgggccacctgcaccctccgggccccaggagaagctcatgcctttcctgcttgcaccccagagcctggccacccctgtcctctgctgaggccctgaccacctctatgtgtgccatggctgcagtgacagcccagaccccaggggccgggcatcccacagctctcctcactgagcccctgggcctatccgcccacgcccaggccagggctcctgctggaatctccctgtggaaggccaggctgcctggatgcccaccactccaggcttacttctgggttgtagttttcggggtgcttcgaggtgctgtggggacctgtgatgctgtcagggagacccggagtccagttctcgccaaccgctcgatgctgtgtgacttgaggcaggtcccttaacctctctgagcttcctcctctcctgtgaacaaaggatgggtccacttctcaggcttctcatgaagtttagaggcgacaggaggaggtgggctttaaatggctcagtcccagcgtcccctcatgcctgggaccgctgacccaccgggattcttgggggccaccatagagcctgtttttaaaggggatgtggcggccagctctgggggcacacgttcctgtttgaattctcaatctccgggctcaaaattggcccccagaaagcctttgagatggacagggagctggaccttcccaattcggttgcccttgcttgatgtttacatgccactgttgggtgctcctgattgtgtagcgggtcccctgaaaccaacacacaggtgcagacacccacatgccatcctgccagagccctgggttctcagcaggactctttgccgggatcctcatgctacggccaccacctgattttgtcgataaagttttattaggacacagccatgcccggccgaatattgccacagaggccacctgccccaccacgcctaggacatttcctctctggcccagaggtgtgccagggctgcactgggctcttctggtggggagggacattgttctggcccctcctgatctctcccccaccttgccacgaccccccagagtttgcctggtgtcaccgggaagcttcctggctgcccgagggtcccccagcacctgtccctctagggcctctgaagggctttgacgtgacactcgggatggcatggcagggccctcaagcacggctgtgttcaccccccaggctgctcctggaaaggagggatcagggcccaggctccacgctccgcactgaggtgtggtcgagggccctgggcgtccgggtgagatgggaatgagcccttggtaggtgccaggcggggccagccctcatccccactgcaaggcctgagcgtccaggagccccgtgcgcagctggacccatcagtccccaccctgcagggccgttgaagagggaatgcacacctgtcacctcttggtgcgggggcatccaggttcctggcgatggggatggggtgagatgcacctgatggacctccaggtgggaagctcctgggacaccctggagggctctggtgggagacatggcattctgtctgcaccgaagggggctcagggctgagaagccctgggacgggttggatttggggcgcgttccccagggccccacgcgtgttgagtccccgctgcgtcactgtctggcctgtggcgcctcacctctctgtctggcaggactcaggcagaatggaagtaaaggcaggaccttgtcccaggacatccaggcatgtggcgtggcaaccaggtgggatggcagggtttccccctggcaggatccccacctcctgcacctgtcctgacttggtcttctggggcagcccctaagacgcttcttcagggaagagggaccggtttggccagtgggaccatggccctgggagcatatgcctgcacgtcctgcccgctcacacctgcctgctgggggggccatgcctgcgcccgcagctcacgtcagagcccaccccaggaggctcccagcgatctgtcaacctgtgctgttggcatgcagcctgggggtgaggggtggcggaacgctgcctcagtaccacgtcctgctcaaaggccacttgcgagctaggctgagcctgtggtgtgcggtgggataggaaggaaaagaacagagtctaaggagcctaactcacttccagattcacccggaggcctgcatggaggaggcggcactgagacttcattcaccgagcttgagggtttaccctaacattcattcacaccatcagtcattcagcaaacacttcacaaacgtgcatcccacgcctggcactgggccttcggagggagggaatgcagctggtgggcccctgcctggggagcccctgctctggtcggggaggcagtggtggcagtggctgcctggcggtccatgaactggtgcaagccagagccggaggcctcctgagagcctggcagggaagcccaggccagggcctccgcagaaggagggtttggggtccaggcttcatgtggggggtcttgtaacatgggagggtagacgctgccttgggacaggagagacagaggcggggggaccaggggagtgggctgcagttggggtgcaggcctggtggccccggcagggggaccagcctctggggaggtgctgcaggcacaggagttctgtgtggacccagccgaaagctggcaggaagggacctgtttcttggggttcccagtccagatctgtgttggaaaaagtgtcagctgaaaccccaagaggctggggacagccttggtcctgctgtgggacacaggtttaatctccagatggctcctggataggcgggctggcggctgtgtctaacggggacagcacacttggggcttcgggagacaatgagggcagaaatcttacccaccggccacaccaagtcacccattgttgtgtcccttgggctgggatcccatggctttcaagaactttttaaagaaatgagactcagctgccgcggaacaagccacaggtaaagagtataagacagcgtgaggcatggggtggccacgggagccctgggccaaggaggcccagtctggtggggaggcgtccattcacccggagctggacggggaggaccaggctgtgggtctgtgaagcgggtgtgggatcacatccacgctccttctgtggtttgtgccctgttgtggctgccaggggaggggcttccaaggccctgccaaccagctgggcagtgtggacaatggcagacagggtgctgtgtgggggcctgaggggcaatggttggggggcagctgttgccgttctggtgagaagtggcggtccctgaagggctggggtgctagggagcctcatggacctactcccgacgtggcagctgcctgctgcagatgggccagccatgtcccgcctgtgccgggaatcaccacccccagctcccttctctccaacatgacagggttcgggtgatgccctgtgggctgaatggtgagagaggcgtccctgtgctgacaccagtgggcgtggacgtgaccctctttttaaaagaattttttcagatgcaattccattaaggatctggaggtgagaggatgaaaaggaaactctgagctttgagtacatttttaattatgttttaaaaattaagacatgaggccgggcatggtggcttacgcctgtaatcccagcactttgggagactgagttgggaggatcgcttgagcccaggaaatcgaggctgcagtgagccaggatcataccactgtcctccagcctgggtgacagaacaagactctgtctcaaaaacaaaacaaaacaaaacaaaaaaccaaaaaacaacaacaactaatatatgtttttgaccaatacctaattctgttgtttaagaattcaaaatctaccaatagtgatcataagtaatgtattaaatacttacatagtacagcaggtgttggcccccccccacaacattggtttccatccctggaagctgcaaatgtgacctgacatagaaaacacccctttgcagctgaggctgagggtcccgagaggcgtgattgcattatccagggggcccaagtccagtgacacgtgtcctcctaaaagacaggacagattcaacaaaggaggatccggccacatgctgcacagcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctggagtcggccagtctgggcacgtcccatgctgtgtctgagcctcagtgtccccatcgattggtagtgcctcctgaaccccaatccagggggcttctggggggcagcctgggaccagacgtgcctcaccagggcttctgtctcctcaccaggacttccatgatgtgacaccttccacatggggttcagagcggggaacctgtgcctagtgtccagcccagcgtggggccctcggtgtgggccagggctcacccctttgggaggggtcgggagatgcctggcccaggctccatccatgcagagccaggaagcaggtgaacctgtggggaccttggcgacctccaaaccctgctgaggctgcctgctgacagccactggtgaggggggtgacagccactggtgaggggggtgaccagctggtagctttttctgaggtgcagattcagccctggggaacagccctggcaggctgtgagacctctgcccctgggcgtccacatcccagggctctgagctcagcagccctggagccggcagccacatcagggatggagggagacctgctggtgaccagtgagtgagcaggggaagcctgtcctctccagcgcccagtgtttccttcctggggcacatgggatttggaggcatttggagtctcccaggatgacttttttttttaagcccctagaagtggtttggggtttaagcgtcaatatttaatctcttgaagttacacattcaaggccctatcctgccttcggctttaggttcgcttcacaaacccattgtctgcttatcagcctggcgaggtcccgtccccagtaggggtctttgaacattgctcgatctcattcaccagccacggggaacattttgaaccctctgatgcttgctctatgaatgttgtttgctttaaaaaaagttttttttttattgtgataaaatacacataacacacaatttaccgtcttaactctgtgtcaggtcacggcccagtggcaataggtacatttacatggttgtgcaaccgtcaccaccatccaccccaaaacttctctcccaaactgaaattctgcacccatgaaatcccactccctctccccggccccgccatcctgctctccgcaaccgtggatccgtcctccccatgtccacagatcccctctccctcggccccgctgtccgcttccctgcgacggtggatttcgctgctctgggcctttgcgcttctgtgactggcactgtgtgttatccggtgtcctcaaggtgcctctctgctcatgtccttccatgcatgatgctttcagactgacaaaactcttcaagtattaacgtaatttttaatgtttacagattcaagaaattaagcatacggtcacgagagtgcaaagttctgtgaaacgctccagtggttacacgccccggggtttcagcttcgaccctgggtgagttccatggtgcagtggcttccagctggagttctaagggcaccccttgagctgcccacgtgtctttgcacgtgaagtaggtggctctctttaaggttcctcaactttattgggaaacatctcagggttacaaaacgccccccatgggctaaagaggctgtcactcactgtgtgtggggcctgtccccgagtgggcatggaaggccagagtcccggcacagcccccacccggactggatttgcttggcgggtcacctggatcaaccaggcccatttaggagcaccactcaggggccctagtgtgtgcggcagggcaggtcatggagtctccagccttcagctcgcgttagccccaggccatctgagccgtggagcccacccaggcccgctgcctgcaccccgggggagccctcccacagcgtctcgggctatgaccctggcagggttcctgcattctcctgtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagctcgggtgggacagcattcaggggaccacatgagctgggggggggtcggtgtcttctctcccccaccccttcgctagcctgtcctgcttcccactccgagtccaaaacacgcataggattcgtcctctcccagggccttagtttcccggctctgcagagtggggggctgtgactgcctggccttggagctgaggcagagggggtggtaggtggccctgcagaggcaggaggggacacaggcaccccaggccctgagtgcctcaagggcagggaccccagctcggcacctgtgaggttcccagctccgcccgagacaagaatagataaagcggtaaataagataaaactctttttatctggagtagataaaagtaagctttgtcatataattccttctgaggctagcacggtatatcaaaatatcggaagaatcatttagccttcagaatatggcaaggctgacagccagcctggcccatgggcacctgtccccaccatctgcctggcctgcgggggaacgttcctcagcccctgctggctcccaacccccgggcctggagccctgtcttctgcctcagccgcgattccactgcacgggactttcccaggcacctctgcccaggtagttggggtggacgcccacttgggtgcacactctgtgggggctggtccaggaccacccatgtgcagtcttccctggccacatcctgtattctcccgcaacgcccagtcaagaatcttcctgctgcagtaactccacatatctgagccagctgtgtctcctgagcacaggacatgggcaggagaggcccctgcagctggaatccgcgccatgaagcccaggcgcgtggtatttgcagccagtcaccaagttttcaagccctcacctgcggcctgtgagtgcccaccctgcacatggtgctaaccagcatccatcactgctttcttttttaatttaatttaatttttttttttttgtggtggagtcttgctctgtcacccaggctggagtgcagtggcgcgatctcggctcactgcaacctccacctccctggttcaagcaatccccctgcctcaatctcctgagtggctgggattacaggagcacaccaccacccacgcccagttaattttttcatatttttagtagagacggggtttcaccatgttggccagactggtctcgaactcctgtcctcaggcaatcctcccgcctcggcctcccaaagtgctgggattgcaggtgtgagccgccgcgcccggccccaccactgctttctatgctgtggccgaggtcaccaactgccactgtgatggacggctgtcacccaaacagcacgagaatcgaaaagccgtgatggcagatgcagaaggcagcgtcgcctgtggtcttttagaagggcagctgtgaagtggggttatctcagcttccacattgcatcacggtgcccctgtgaagggcagaggagctgcaggtaattctgttcgctcgcctctgccttggaggaagtttacagttttttttttttttttttttgaaagtttaaagctttcaacctgggcctggaggctgcagggtcagcagacctgggtcctgcccatggcccccttccctcctcaggcctccatttgctcatctgagagtggggggagtgcagcgccttccgtgcaggtcactgagaggctggggcagtggcgtggattcgggtgcatgactcgcagacatggctgtcgcttggctgaacggtggcccctgaggtgtctgtgtccttgtcctgtgaacaagttaggttgtgtggccaaaggggctttgcagggtgactgagggatggctcgtgagaggggaggttgtcctgggttacccgggtgagccctcactgtgattgtgaggattcttctaagagaagcaggaggatctgagttggaggaagagacgggaggatggaagccaggctcggcgacgggaaagctgctgtgccaccctcaccgcagccctatccctgctcacgtgcaccaagaccagagcctggcaagtcgtctcataccgagggtcaaaggggcccagggcccagcctccagggaccccagccatgccgggtcagggaaccaggctgcagtcctgtgtctcctcctcagtttaccccaattgtgacctcagaagcccttggagcctcagtttccctacttgtagcatgtgtttgatgatagtgtggcagtgatgtcacagtctggcagggtctcgtgggggtctgtgttactgtctgcaaagcactggctgggccagtggtcagtgagcaggggcgtgggtagcgggcagtggcctgcagtccccaggagcacttcctgttgctgaacagacagcaacttagtggatccttcccagggcccctggtgggtggtgggttttgccacatctttgcagtagacagcactggcagcttccggcttatccaaggcctcagggtgaagtcgacgctcgctgctgattccctgctggacgtcaggtgacacttccctccacagcctgggaagaagcacctgtgggccacttctttgtgttgataaggaaactgaggcaggggagctgcctgggtcaccagtgggcactgcatctccatgtgcagatggtgccctggccctctctgcacgccgtgggcctggggagcaggcaggtggcatcttctgccccgggcagcccggctctgcttcctcgtggctgagccaggctgtgtctaatctcacttccctgctcactgcaaatcaaaacaaacagacgtccaggaggattaagtgtggcagtcatggcggagggagccctggtagggtggagagagccaacagttgcaccagcaaggggcagagacccagcccagccctgggggctgcagggtgtggggacagggcctgcagcttggcacaaagactcttctaagaacctggagggaaccctgctccggcagtgggcagcatgctgtgtgcaaggtgagccagtctgagcccattcccagtgcccggaatggtgcccagtgcagatgggcactcacccttccaaccaacctttgcttgtgtccccgtgagatccacagattcaccctacggagggctccccacagggttggcccggaggctccagctgtgtctgttgaacaaattactctgcatccaccgcgtgctagcgctgtgcggattatagtcccagagacagatgagagcaggggtggtcagtgtaggagcacccagagggagcctggcagggcctggacatcctgtccaagctggccaggaggagtcctcagagccaaagcagtgtggagggtgggggtgcagagagcgtccctggctggaagcaccgcgtttgcaaatgccaggcagcttatgcagccagcgctttgggcaggcgggagtcagggggactgaggcccaaggaggggtagggctgcatgccagccttccaggtgctcctgggaaccacgtggctgatcagacttgtgctttgggtcgaatgtcccagtgggggagtaacctcagggagcagaggaagggtcatggtggtggggatgaagcagcagcattggggcttagagattaaatgaaggaagtcccacggggctgatcacctactgtgcaccaggctgcgtcccgggcatggactgcagcccacagccccactcttggggtgctcatggtctagggggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccggtgtggcagggacagggtgtcggtgaggcaggtggctgaggaaatggtagctgcaggttttggccccagtcccagcagcgggactatggctgtggggagggaggaacccagggagggggcctgagcagggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtagccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccatccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccgtccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggccggccctgcagggaccttcagacgtgccctgggctccacatgcccgtctgcagctcgagaattagacgtgttctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccaacgaggacgacccagcttggtatgtgctcccggcttcagctgcccctgagtgatggagacaccctcccactcgccttgccacacttcccagcagtctctcgaagcactggccgcgtggaaacaaatccttcaaggggatttgagggtccaactgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcggcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaagccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggagtctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccctctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctctgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggacgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggagggggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggcgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagttttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctgggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcaatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatgtgtatatatgtatatatatgtgtatatatgtatatatatacgtatatatgtgtatatatgtatatatctatgtatatatatgtgtatgtatatgtatatatatgtgtatatatatgtgtatatatatgtgtgtatatatgtgtatatatatgtgtgtatatatatatatggttacatacctaatatgtatatggttatatatctcttataagggttatatatctcatatacatatgaggttatataccacttatttagatttttaacttctgtcagagatgtttcatagtttttagtgtataggtcttgtacatcttttgagatacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctctttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgaataccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagccccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatagaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttatgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgtttttggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcaggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccctacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcgggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcgcgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggaccgggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacgcttataatcccagcactttgggaggccgaagcaggcagatcacctaaggtcaggagttccagaccagcctggccaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgttttttgttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatgttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacgtcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacaggcaggagtccgccggaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgagggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccaggagggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcgggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatgtccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcaggccctctggggaggacaccctgcagacgaggggctccggttcccccagggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtagtgcacctgcctctctgtccgcgtgtgcgcctgtgcacccctgcccgggggtggccatggggcttctccccaccctccctcctcctcagtggctggtggaaaccacagggtggcccagggaccctggtcctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaaggtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtcctttccagtaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgctgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgaagcagcagcagggtcctcctcagctgaagactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttttggagtaatttattcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagtaatacagttattgacttctgcaattaaacatcaatataatacttggacctaatttaatgcctatgttcccattttgtcagttgccatgacaatgtcctttgtggcattttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcaccctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacaccttgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacgcaccaccaagcccggctaatttttgtatttttagtagtgacggggtttcgccatgttagccaggctggtctcgaactcctgacctcaggtgatccgcccacctcggcctcctaacctgctgggaccacaggcgtgagccactgcacccggcccttgtgcttcattcttttatgaatgaataatcttccatcgtatgatatacaatgaataaacattttgtttatccatttatttgttgataagcattttagattgtttccacattttgactactatgaataatgcttctagaacatgtgggtttttgtgtggacatgtgttttcatatctcctgggcatgaaagagatatgaaaggctgggtgtgttggtggctcacacctgtaatcccaacagtttgggaggccaaggcaggtggatcacctgaggtcaggagttcgagaccagcctggccaacatggtgaaaccccatctctactaaaaatacaaaaattagctgggcatggtggcaggtgcctgtaattccagctactcgggaggctgaggcaagagaattgctttgaacccgggaggaagaggttgcagtgagccgagactgtgccactgcactccagcttaggcaacagagcaagactgtttcaaaaaaacaaaaagaaaggaagaaaagaaagagatatgaaaacacatgggagtggaaagctgagtcaaatgatcactatcttttttttgagatgaagtcttgctctgtcgccaggctggagtgcagtggcgcgatctgagctcactgcaacctctgcctcccaggttcaagcgattcctctgcctcagcctcccaagtagctgggattacaggcacatgccaccatgcccagctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacgttcttggcatccttgtcaaaaatcaattgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctgtatacaacattgatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaattttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttatttttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttcaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtgtgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaatgagatttgcatgccagaaattaattccacatagacatgatatataatctttttgatgtattgttaaatttagtctgccaatattttattaaggatttttgcatcagtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatccccaggtagtgagcatagtacccaataggtaggttttcagcccacctctccattcctcccccaagtagtccccagtgtctactgatcatctttatgtccatgtttactcagtgtttaggtcccacttgcaagtgggaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattttcctttgaatatatatccagtaatgggattgctgggtcagatggtagttctgtttttagttatttgagaaaactccaaactgcttagcacagtggctgaactaatttgtatttctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcttgggttcaagcaattctcctgcctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtaagttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgttgattttctgatagtgtaccattatgattctctattcgattgtctgtatgtgtgtatgtgtattttaaagactttatatttttagagcagttttagggttccagcaaaattgtgaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtatatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctttcacttaggctggaatgcagtggcatgatcatggcacactgcagcctcaacctagacctctgggcttaggctatcctcccaccttaacctcccacgtagctggtactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatatgtctgtccaagtcctttgccctttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactttgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggatgtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacattatgtcaagaacttattcatctgataactctatgtttgtacccttcaacatttcctatttcccctactccctgacccctagtaaccacccttctactctctgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccctcttaacaggttattaattgggttattaagtttttttgctagttatatgagttccttatatatattggatattaatagcttatcagatatatggttggaaatattttctcccactacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtgtcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacttccagtactgtgttgaatagaagtggtgagaatatctttttcttgttcctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtacgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccggttattttcttttcttatatcgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaaacccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctatctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccgtctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctttcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttggtgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatggggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagcgttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttcttttttcttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttatttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattctttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttcctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctagtctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccacatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttctccatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctaaggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctgtttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatccccacccacccacccccagctcccctccatgctctcctagatgcctgacctggctacgaccacaggtgaaaacagggaagaggtggcagctctggtgactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccatcgttccttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtcttttcactctttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatacttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttataaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttggatttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggggttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttctagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgcgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattatgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtatgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatgaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtgttttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaactcggctccagctgctcagggatgcagcgaagctcctgtgggcagcctggccccatggaccctgaactgggaagagaggcacatgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggatagggctgtttgtgtcctatttaagaaactttgactactccaaggtcataaagatattctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctccccactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacatgacgggcgagggaagaggaccatggtagcttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaaggtccccacattccatggcagtgcctagggagctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgctgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagatccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacactaggacctttcttcatcatgcagccgtagagctggaggccaaggacaccctctggaaatctgaattccattcgctcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaagctcactgggcaccttggctgcagggtctgaaaagtcctttgtgttagctccagctgcagagtttttccaggcctcgcttctggggctgactggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcctcagatagggtggagagcaccccttattagagggtggttgggctctctaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcctattgcatctttccagacgtattttatataaacaaatatacgtgtgtctgtgtgtgcatgtacttagtagatacggctcctttttatacaaatggtagcatactgtatgtatttttctacactttgcctttgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgttttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaagttgtctatctgtgtgtatattcatatcccattggcatttgttattgaaacttcattcaatttagattaactgatgaagaattgccttccccacctcaaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctatatcttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccggctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagtttcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcctttctgagagcacagcaatgcctactcatcctgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatctgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaggccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttccagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacttctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagaaatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccctgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcctgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcatcacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaacctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgctgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggagccccagggaggccgcgctgaggaggcccagggaggaccgcgcggaggagaaccatgctgaggagcccccggggagacagaaccgcggcgaagaacccccggggagaaccgcgccgaagaacccccggggacaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctggttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagccggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagagagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttattatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgttttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggaacagtggggagtctctaggaggttttcggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagttattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattctgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgaccttttctccccaagagaacaccaaatccatttccttgggacatggataaggctaagggcagcacccacaaggaccaggagcggggttctcaacagccacttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcccccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttggggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgagcggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggctgtttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtacgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgcctgggatgtggcttccgtggactgagcagcctggagcccctacttgcttggtgtcccgagccagccggacctgcatcccgctcctcctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattattcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcgggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcaaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccgggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggcaggagtggggcaggagggggctttgcagattacccagaccctttgttggccagtgtgggaatggggggaggccagggaggaccccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccgcatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacaaggagacttctgggtagcccaggtggaattcttccctccctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggtctccaggtttgagccccccggggtattagcccagcattttaggggctgccgtggtcatggagtaaagaccacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcaagttgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaacaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttctggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctgtaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcccagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcacgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagacccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacttcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacacgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagacttcaggaaggagcagccatggggcagtggggctctggagcaacagaggcctcaaaagctcagcgtctacagatgttagggacaaggaggcagcttgggggatgtgctcgggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcaatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttctgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctaggacacgtgaagccctggctggccccgagtgcggtgtggttggcgcagatggcaacagggtcactctggctgcagagccaagaatggaccactgaggggctgggacagacctggcagaccaggagggaggccactgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccacctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagttggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttgatgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccacgttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggttctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcgctgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacacacacacacacacacacactctctctctctctctctctctctctctctctctctctctctctctccccccccacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaagcttgtctagcactggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtggctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgaggccctgcccggtggagggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaggaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccaggtcccaggcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgcggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggcggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacttctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcggggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggacccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcagaggctggggttacctgacacttgtcatccttctgctgggcctcagcacccggcggaggcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcggctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccctatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggctaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaaaatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaataaaaagtacaggggctctacacggcgccctgagaattgtgtgtaaatgagtgaaaatggggtgagagggagggagtgggaacagccaagaggccaggaagcggagcctgggtgcaggggcatcttgctggtgaagctggggagagacctgcgcaaccccacctgagtgaggcactgtgggcccagagtccaggtcagcgccaggggcagcaggggctggatctctggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggcggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccatgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatatgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcggggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatgttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgctcagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgacccggggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtatgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaaaaaaaaaaaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaaaaaaaaaaaaaaaaaaaaaaaaaaaaccccacagctaacatcacatcacacttaatagtgaagaacagaatactttccccctaaaataaaaaagaaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactattggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaactgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcgggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcacgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacgggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatttttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccatttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacaaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatctttaaacagatttattttagagctgggtacgatggctcacacctgtaataccaactacttgggaggctgaagtgagaggatcacttgagcccaggagtttgaaaccagcctgggcaaaataacaagaccccatcttagaagaaaaaaaaaaaaaataagaaagaaagaaataaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaagacagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtctgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccgcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatctttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacaggtgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccggggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtgatgggtgatccagaaggcaaaaatcacaaagcagggaaggctggggggtgacttgcctgagtcccttggagcggagggcgtgtgacgtgcttgagtgagtgcgtgtctgccggagcagggcggggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagggctcagcatcccatcttagagaagagagcgtagaatctccatcatacagaagggacatacagaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcagtgtcccatcttccaaaagggaggatcagggctcaatatcccatcttacagaaaggagagtcaaggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagcatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccctccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccgggtcctgcccagcccggccccagctgcatgatcagcggtgccggaggagggaggggctgagaccctgagttcttgcctctcaaccacccccttctcctcaccacccccacccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacgttttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctccccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccggccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtggggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccgttacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccccgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcggcctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatatatgcggtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaagggttttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattttcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcactcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgtttaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaactcttttttcttagcacattaaaaatgttattgaactatcctttggcttccactgttaccgttgagaatgaagatgatgaattgttgctccttggaagacaatctgtcttttttctctggctgcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaacctttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactttaaaattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactggctcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaagaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtggtgaatgtggatggcagggaccatacgggagagcacactccagtagttgccatctcatggccccagcgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagcttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacacccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtgggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaggagttcacgaccaccctgggcaacatagcgagaccctgtctctatgaaaataaaaataaaaaattagccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagagatcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcagctccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcgatgcacttcctcccggcatgcatgaaaacataaacgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcctggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctctccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccgggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaatggggcattgttcacggcctcacctgggctgtctccagcaccccaggatttacgaggactcggcccagagcctcgatgccggccgctccgggcagacctggagggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctaacggggccaggaggctgaagacaacctttccttgggctctcagcgatgccagctccagctgctgtgtcatcaaggtcgggcttggctggcctcttcctagcagaccttccaaaaccccgcagactcccgtggctgtaccagccctgcacctcctggccacctgcccctgcgtacccaccacccttgctcgggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaacttcagccctctcaccctcacaggggacccaattgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatccgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttctttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagagggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgccgtcagtgcttggagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagttggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggatggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggggaaatgatggataggtggatgggtagattgagaaatgatggataggtggatgggtagatggatggaaggagacaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctcaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctggccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcacacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaaagtgagaccacactcaccctgtggtccagtgatctccttctgagaatccgccctggagcagtaacacccttgggactgagaatggcttctgggttgtgtgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgctcttcccccaacccccaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtctctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccgcataagccacttttggtattttttgccttgaaacttatccatcatattgtgttttcaattttattgatatgaaagtatatatcataatcacttacaattattcaattccctcggtagcagtagtattcattcctaattcttatttgttactttacttgcttaaggtttatctactttactggctcttcaaacaacctgcatttggttttattggtcaattctttttcataaaatatttttctattttgctaatatcttcctttgactttgttcattcttttctttgtatttgttttggtgttatttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatgtggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtccccttccccacgtggtaattctggactgttcacagtggcttccaaggcctttgggatgggccttgcgtgctgcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcagccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccaaaccccaaaggatgggtggaaattagctcaactaagtggagaggtgggatagtcatgggccaaggccccaaggcaggaaggaataggcctggtctgtgggtctgagaggatggagagggctgaacacgggccaaaggagaaagttagggagggaaggtggagtccttggcaggggctcagctcagaacagggggagccccaaaggatgtgaggcaagggagcaatgaacaaatctcaccattgtgagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggcgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgggagtggagctgggcatgcacactaaggcctggaggcttgatgcttatccatcatatagcaggcctgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggctacgcagaggccctgggaggagggaggctaggcccaggggtggaaagaagacagatacgagaggggatttggagacacaatccccagacttggggacgagctggatatggtggtgaaggaggggagtcttcaggaaagacccccaggttctggcttggccatatgttggaggctgaaacgattcatccagacaggagcagggaggaggacatgcagggcctgaaaggttctgaggtgtccacgtggaggtgtttgcccggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtccccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccgacttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcagggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcaggttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggctggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacctcagcaggcagggactagcacccaagaagaaaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtgggtggggcaggagctctcgtgatgaaaacaacagggattcagtaaatgcattcaagctaaaaaggaagacctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgatggtgccagagaatagggaattctgccaataccctggtggggagggggagggggagggggaggaggatgagaaggaaggaggagggaggaggaaggaagagggaggaggaaggaggaggaaggaggaggaaggaggagggaggaggaaggaggagggaggagggaggaagagagagaaggaagagattggccaaggagctctgagaggggaaggtgggtgcatgccaccctggctgggaacagcaggtgtgtggtgaaggggaaagaccagcaggccctttacaccgtgggcacaggctcaggactggctgggtgctacgcaggagccctctgactagctggggctggggctgtgcaggataaggccagtgagagaagaggactcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagatggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtacgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccacttccttccacattgcccctcctcccctctccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccagcacccctgagggaaggcctggcccctcaggcacagtgggggttgcccggcatcttggcagatgggcagcgttagagaagccttggacctggccctgcaaacggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcaccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggagacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggagcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctcagggccccgccaggtgaaggaacaagcttggaagggtgtccttatgtctgagagttggggagacacccccaagccccagatgggcctcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagagcccccaggcctggcctccaacctggccccagcctcaggggagctgaattcagagaatcctgtcctaggagccagaagcgggggagggagggagggcggccctgtcctgggtgcaggcccgggggctgggggctgcccgcccgtctgggtcagccgcagctgcaaaccggccctggctgagtcatggggcctccatctccaggcctggcttgaggtgggaatagcagtgaggttggacatccaggcacctggagggtgggcagggctccctgcggctggggtggccagtggcacctggctgttgcccccctgcaccccagccctttggcccccaagtctctgccacctccctggggttctgctcccatattcctcacacccagcacagaacccagcatgtctcctgtagacacctgcatataaaccctgactcacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcagcgggctcagcctgcagtgtccaggagcgacgggaagcctcgtggggctgttgggagacagcaagacctgggtcagcagagcaccgtgtggggtaagcagatgacagggcagtgacagggtgatcgggcccggtcagtggtcccaggggtcggggacaggtgggaatcgaagtcataggaggcggggcaaaggccacggggaaagggacagagctgctcccaaggacgcaccaccatggggtgccccatggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcagcccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcctgtggagccctcagcctccacgcccaccagcagggactgggtggtgatgtcagcaatccccacagaaaggagggctgcacagccgtcccaggagccagcactgtccccgtgattctacatgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcagccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgcccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactccccggcccctccctgctcgagaggtgaccaaggcccagggtctcccagcgagcaagaggccattgaactgttgttggctgtgcagtgccctgccctcggggaggcggcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcagcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtcatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaaggaggaagcaggcttggggctgggggccagggaccggcgcgctgggaagcaggctgcagagtgaggccagggatgggggctgggccagaccacagggttgtgagcggactctggcattgatccggagccactgagggttagagcctatgacaggggtctgacttccagtggtatggggccaccctgctgggctggggaagggaggcgagaggaagtatctaaggtctgcttgtggacttccggggacagcgaggggtattgctggggtcctaggggctggtgcactcagaggttccagatggcccagcaagtggctgagggcccagggtaggggaggatgtgggggcagcagggccgatgtgggcagacctggagcaatgacacgagaacggccaggcagccctggcttcccctgcccacctgcccccgtggccgggctggggtttggctgaggcagcagagcgctcgctggctgcccgaacaaagtgttctgcctggtgtcccctggcctccgggcctctgcgggctcgccagagggggcagctcaggaggcagcggcagagaatcaaatgcaggtggggcctgtgcccaccgccagcacaaacacggctcctgggcccccagcctgcccgacgttcctgcccgcctggcccccaaacagaggccgatgggacgagccctgcccggggttgcactaggtgggcaggtgggcaggtgggcagctgcctcgggctcttggacagagccgcccctgcctggcgtctgccggcaggaagctcctgaggccgggctagggataggccagcccttgggggaggctcgagaccccatcccagcctggggcttccccaccccctcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcagcctctgcaggtctgtgaggctgtggatgtgacagctctggctctggcacaaacgtcagccccaacccagatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctctggtggctggagccagctgggggagggaaggcagcaggggctgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggagggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagacggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcagcagagcttcctctggctgctcggcagacaacagacaccagggacagagacaaggttgaggatttggtctgcagcctctgagcggacacactcaccctcagtgcctgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagaggacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcaggcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcctagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttcccacaaggggggcagcagcatgatgcatcagactgtggacccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgctacgctctcgtaggtctctgggcctcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccggtccccctcccagaggccccgccccaccctgccctctgctttcgccggctccctacctgacacactgtgtccccccatatggcagctccgtggtctcgagatggagccttggggtgggagctgtggggacaggatgggagacatggcactttcagccagtgactctgaccctcttttcctgggcctcagtgtctgcatctgtgggatggagtgtgggcctctgtggctcgtccccaagtggctttgcagagcactgaagtgctggcgggtccttgggtgtgagagaccccggtggatggccctgggcccctgcccctgccaaaccacagaagtcctgcacccctttcctccatagtctgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcagcctctcacagcaccctgttggccgcctcttccttagcctgctcagcctccgtggtaggtgctgtgggtgacgaccacagcacccagcctttgaagctggcccgggtccacccagaccctagcaaactggttgctccctctctggccatcccggggcttgtgcccacgtcacccagcagcatcttccctggggttgtctcacccgcacagaacccagccctggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccctgagcctgaatgcctgtggacacatatagggactcccagcacgcacgggatggactccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttagcgacgtcgctcctgttctgggccctgggctggccctggccatgaagtgcagtcacagtgtggtcactgcctgtcttccagcagactctatgcccttgcggcagatgggctctgtctgggcctctctgtctgcccctcccaggccagggtggcccttcatcaaggacccacatgctccactctgggagcaggccccacccaggcccattccccaggatgccaagggctaaactctggaggggttgtggtgcaaggaaggcctggggcccctgaggctcccatatgctcacccctggcctcctccgggcctctatttccccattggtaacacgatgctcccttagcctgtccagttctctgagtgggacagaggggccaccaccctgctcgccctgaccctgttcctgcagctttctgtgaggcccgcctctcctaaggtggaaagagtgcctcactctcggcacagacacactcaaccggggcaggtgcatctgctgtgcccccacctcagctattggaccgtttctcagtccttcaggactgcagccgccttctgtcctctttccagagcccatcccgaagtctcaggatatgagggcttggggcatctgagatatcaaggatggggctgtcctgagtccactgggggcaggaggcggccagcagcaggtggcagggacaggggccccaggtttctgtgtggagtaggggtggaagcccttgttagagggaaaggccctgggtcccacctggtgccaagcccactgggcccgtgcccccaacccatgggtcttggcatctggcctggccagcactgaccgggatggacgaggtggaggggcagcacggggcttcccaggcttccctggcctgcacccctccgggaggagcgggagcagcagttactgaaaggcaggaactgttgtttccttgttgggtaaatatttgtggaaacccggggatgccggccggaaagcagggccctccacagcgcccaggccccccagccccggccgcccaccccgggaccctggcccacagggagctccgtggggccgcccatctgggccgggcgcggccccggcacccagcccgccttgttgtccatattatggactgcgcacaaagtgcccgaggactcctctcctggacgggccattgcagccctctcgggtgtgaaatgcaatttacctgaaataaagcccaattatggaattagctaattaaagccatggcggaggctgggcctggccggccgagtgctcaatgcccgccggtgcccgtggactgagggaacagatggcgcctcggcccgccgtgccggccgcattccttcactctgtcccccgataagtgacctagacagcacacgaccatctggtgtgtggcacgtcctgcgggccccggacaatggcccggcagacctctctgcgagagggccgtcgcccgggcaacggtggcatgtgcagccccgacccattcacggcccctcccgcagcccctttcttcgggccctttgtggcctcaccgcggctgcctggctgctctggctgaggatagccatgagtgtttgtccccagagccggcctttgtctccaaattgggctcccttattgaggtcctcggggtccaatgggtgccaggagcatctgctgggggtgactgggggaggggctgctcctgcttcctggggcacccacctcctctgccaggctctcctcccccgttgcctgcccccagatgtcccctcgtgggtgctgggcgtggccatggggaagcccgtctctagggctggcactggccaagcccgaggttctcccatcttcgggccagggggccaggaggaggaggagtcaagggcggggccgacctgcagcccctcagctcccaccccagtcctgtctgcgaaatggggaacagtaaaagtgccccctagaaggggcgtacggggcaggggcttgatggagatgagacatgtgagcacacagtaggtgcttaataaaggaagccaaacaaaccacctgggtgggtgatactgggctctgcctccttgctgctctcctgcctgttgcctcggagctcctttctgaggcccctcctgcatctagccttaccccaccaagctccctgcccctcggtgccagggagagctgtccaaacccaagctggcagttccccatcctgctctcaagccaaccatgactccccactgctgagtgggcctgtgaggccccacaggctgcaaccctgccactcaccctgggcatcccccgccatgagcccagcttccccatcctcaccctgtacttgacgtccagcccccctccctactcaggacctcctctgagcaccatcttggcaggcagtcccccaccagcgtggtggtcaggagtcaggcccaccactgggagaggggctgtgctgggcctttgaggccccaaaaaggagccggggctggcagtgcctagtacaagcctggccccagctgggtgctcaggaagtgccagttaaattaaggaataaaatgaaaagttggaaggaggctgcccagtgctgcatgtgcagcagaggtaccaggacccaagcagggcatcaccaggcgtccctccaatggacaggagaggggtccacaccctgcgccctgaaggagggatcaggccaggtgttttgatctggggcagccagacagctgggggaaggagcaggaaggcagacaagagccagggctcctggggccaccacacacagcacccccatctccaggggatttgctgagtcacctgcagggatgaagactgccctttctcaactatatcaagtccctaatttggagtgcccatctgagctgtgccaaagcctgctccccccagcaccccagcctcctctcagcacagccctccgggctctaggacccaggggttccttgcgaatcttttttttttttttttgagacggagtctcactctgtctctcaggctggagtgcagtggcacgatctcagctcactgcaagctccgcctcccgccattctcctgcctcagcctcccgagtagctgggactacaggcgcccaccaccacgcccggctaatttttttttgtatttttagtagagatggggtttaaccatgtcagccaggatggcctcgatctcctgacctcgtgatccgcccgcctcggcctcccaaagcgctgggattacaggcatgagccaccgcacccggcctccttggggatcttaagcgtgtctcagcctcaccattctcggcccccaactgcaccaaccccgctcttgcctctggccctattcttgtggccctggagggccagctagttgggagatcaggcctgtggcctgtgtcccagcacccttcacctttcctgtccccacccaggtcagccagggtcccaggcagccaggcctggaggatgcttggggcagccaaagccaaacagagcttcagtttccactggcctctgagtgcagacagccggggccagggccccctggaagctgacaggtcccaccccggcccttcccaactccactgtggagccttggtgaggaagcctagagggccctcagtcgggcagtgcaggagggctgggggctgccaccccagcccaaggccttagaggccaaggccccagcctgtcccacccaggcactggctgggtaataggaggcggggcatccactctgccctcaagatccttctccctcagtaggtcctgctatgacctcctggccctcctcttcagcaccccgtaccaggcctcctacaactcccctcccctgcagcccccacagctcaaggcacctgagtgaggcagagcgtaaaggagatggacagcctggcccagggcagccctgctggactccaggagatgcttgggcccgctccccactcttccttctagaccctcacccatggctcccagaggggacgaggccgcccttaattcccagagccaagcccagccccaccgcccacctatccccaggcttgggtttcgcacacgtacaggcagcgagcccgaggcccaggaagacacaagccgggcccagaggtggccatggatggctcagtggacagaatccatcctggtgccttctggggcctcaaacacacagctccttccacttcccgggagtggccccaaggtgcaggggtgggggtgtcgagatggagtccagggcttgtcacttgggcacagtgatccccacctgcatgacccatgaccctggaaaccccccccaccttctcctctccccactgccggcccctccacaacattccccgtgacatgctcctttccagcctgcaggacgcatggggtctttctgtggcattgcagctgagcagcatcagggcaggaggtgcaggctctgggaaccaggctcacagcttcatctccctcctgggcctgcgccctgggaagccggtggcagcggcaaacccacggagaggagttaacaggtgcccgaggacagagaagactcatgctgaggggagagaccccagagcaaaaaggcctcagagctcgtgaagccccccacccggtacagacagggagaccaaggctgggggaaggccgggcctgtgctgcgcctgtttgtgtgactttgcattggaaaagcctcagagaagaaatggggcttccacagcagagaaggtagctcagccaggaagccagagggcaggaatgaactgactggctgaaagcaagagctggccttgccagacctttggccggagaggccagatctgaggaagagatgttcaaaattccagggtggtctgagcacagctcctctgctggcccacacaggccaagaagccacaaagcactgtgcctgcctgatacagccaagggtcaggtgggccttcagaacacaccgactggctccaagaaggctgctgttgcacctgccacacagaaaatctcaaacttcccagttagatcctcaagaaactctgttacagcctgaccgcaaatgtgattcaccaaaccccactgaatgacttttggttgtttcttaaccacatccctcccctggccaatgctgacacacacctacacacacctgcacacacacacaccttcacacatacctacacacacacctaccctacaaacctgcacacacaatacacatacttacacacctacacccctacacacacctacacatacacctacacacctacacccctacacaccgacacccctacacaccgacacccctacacacacacacatctacacacctacaaccctacacacacacacacacacatctacacacctacaccccgacaccgctacacacacacacatacctacaacacaagaagtgcctccactgtgtgtgtggcacgaggcagtgggaatgaaggaaaagctgaagccagaagccagggatcccctcattcacagcctggctcagcccctctctcaggtgccctggggcaggagccaggcttctctgagtttcagtcgctcactgcaaccacagctccacagaactgaccccaggatcctcagtggaagagaagatattgcaaaagccggcgccaacgcaagaccaaacagcaatgacagagctcactgtgctcagggagaaccatgtactgacgtcctcttcagtccagcaacctggagctttgacacacaaacagcccctgagacagaggtctccgcagcaaatccacccacgggacacttctgccaggcagagcctgagtcagcacaggtgaccagagagggaagggccccaaatgccatccagttctcccagaacagccgagggaggtcacaagtggcccaggtgccatggggaagagtggccccatagcaaggccaggatgccgctggtgtcagaagccccccgagcacccagaggggcagaggatctgtgggaggagccttcaggtgggcactcagggagcactcaccccaactgtgcccccagccaccccaagaaggcctggccggaagcatctctgccagggacaatgggagcaatgggctagaggtggactggccaggctctggaagaggaggctccagctgggagaggccacaaccccggggtggggcccctccagggcacttgagggtggaactgtgcagcccctgagtgttgatgggcctggcctgggccgaccccagagactccagcagaggcccagggagctggaccgtagcatcgcccagggaaagggcccgtcctgggggtgggcaggaggctgcttgagaaaggcttctaaagaggggttgtcaggatggtggtgaatgccattaaataatttcaaagggtcttaatcaaatcccctctcggtccacgagatcatgtcaaaggactctggagaggaaaagaggggcagacacttcccgtgcgtcttccacttgactggctggccctgcggcgtgggggcctgcgggctctcgctccgcctgtaactccgtttttgaccccagccaagcctgtctcctctctgggcctccacctcatccttggggtgaacccacactgcccagttcagggagcaggcaccacctcagagggggtctgcaagggaaatgtctcatctcaccgctttaggaggaggcctcagcggcatctccaaaccatcgacgcagctgctgagaaccaccacttacagaaggggaaattgaggcatagaagagccataggatggggaggctctttcacagcttccagagcctgaatttcctgggaacttgggcctggtgcttgaccgtgcattgccttggtttctcatctatcaaacaggctgagaccacatcctacctcacatggttagggtgggctgtgagccaggcaacgcagcacatgtgataggtgcttccagaatgttctacggtgacatctcaagcccacggtcctcaatggtcctgttgggctccttcagaatccccccagatgccccacatcatctgccctggactttttttttttttagagacagggtctcagtctgttacccaggctggagtacagtggcctgatcacagctcactgcagccttgatctcctaggctcaagtggtcctcccacctcagcctcccaagaagtggggactacagtacaccaccacgcctggctaattttgcttatttttttgtagagacagagtcttgctgtgtcgcccaggctggtctcaaactcttgggcccaagtgatcctcccacctcggccttccaaagcactgcaggtatgagccaccgctcccagccgccttgggaattttttcaaagtatagacacaaaaccttcgtattgtgtgttcccaaatgtcccacagccgtaggctggacaaagcagggccattcacctccacaaaaccttcctattgtgtgttcccaaatgtcccacagccgtaggctggacaaagcagggccattcacccccgccacagccacacacctctcccacctgggtagttaacctgcaagtgctaagggctctgaaaccacacagcagcggcctgtgatccgaattgttctgcagctgtctgtcctcacccatctgatgctatggaacccatctgtggagaccttcctgttctcctgaccttctgcaaagagtttctcagacagctgtgacctaactgtgtccagcctccctatgcaaatggaaattcacccattctgggttgagctgagattcaaactcacacccagccaccccacatgcaccctaagagccaaaatcactctcccagagctgttcccggccccatcaagcaggtgcacgggcaacagtccgggctcagaagctgcctcctctcgggctcccaggcccggccactcctctgacaccactggctacgaccactgttctggggcaaagacagccaggtgggcatacccaggttgggggctgtggatggaacaaatgaaccagtgaaagctgggaacactcccaggaagagggctttgtgtgcccccagccctggtctcaccccttccctggccctgggatgaggagagtcaccccacagaggccttccagtgcaagtgccagccggggcccctcatcgactacctgatgctaccatgcccccagctgatgggacagagatgaggccctggaagctcagccctcgtccaagggcacccagtgaccaaccgcacccgctggacttcaaacttggagctctgtgccaccaggaagccccctcacccccaccactgaaggagctcgagaaacgccagactatgctgctttgggatgtagaccacctggagctgcaggcaggagaggcggccgccaggggcatcggcccagaaggcccctcacctcctccgctgagggctgcccagaggcaatgtgggtcccaggggacttttcatctgcatctggagaccaccgtcactcatgctccctccctggccctcccacgactggtgcagcccccaccccagaagccccagcccctattcctctctgtggttgggaggacatataagcttaaatcaccttgcccttctctgggtgtcacgctttgtggccttccctcgtacgtacataatgaaaattatttctttccttctgctaatctgctcagtttaactcgtggcccaaagaacaagggcggggggcaagacaatttcactccctgcactaccaggagcacctgtgcctccggaggagccagcagagagggccggccccagccctcatctcagcagaagccaggctgcgctagggagcagagaggccagtgggggtcagtccccaggcccctggtgccacgaacacactcctccctccctcccccatggcccccctgccaccatccttgaggtgaagcaggcagaactgtgtcccgaaaacgctccacagcccccgcgtgtgtccaggtggcttcagttacccggcgcctggctggcccagcctgcagagagccctgccaaggcctggcaccgctgtcccgagcggcccctcttgccgccagcgagcccaagaggcctcagggcacaggcagactgctttcccctacgcggactggcccctgctccccaggaaaaggcttcattgtctcccaccccccggccaccgcctggctcaggagacacgggggctccaagctgcgaggtcacccggccttgcagaatccacctgcagccgcaccagtccaggaaaccaaatcccagcggcagatgacagccgagggtggcaggacagagtgcccattcagcctccgctggagccggcctggcctgacctggcggccgcctcccctacctgggccctctggtgcctgagcccaggcctcacttagcctctgctgaccagagagagggctgggacgtgccccaccctggggcacccacaagtgtgaggatggctggtgaaggtggcagagaccctgccccacaaccagggcctcctgcagcccagagtgggctcaagggagtctccaagccaagcattaacagggatctcctttgaacttgccaagcattgctgccccatcttacgtatgaggagcctgaggctgggaaccaactcacctttcagctgggtgcagccaagctggagcctcgctgactcaggggtccctcctcagtgagcagatggagaaggtggcctggaaagggccccaggctgcacagcagcctgttgtagggaagaggagacgggccaaggcatggggacacatggacccatttcacagacaggcagctgaggtggcagcctcggcagcaagctgacaagaagacaccaggacagcccttgcgtgagttgcatcgaagacaggagacccgcccaccctcccctccttaccatcctgcaggacctgagaccaccagccatagctggtccctcatcgcctccccctatccccagccctggcctctgcatttgggcaaaggctatggaggaagaggctttggctttttggccctggcttcagccaaatcccccaagcacctcgtggaggagaatggctgcacctgggagccacgtgggctccatggaggccctaaagagaccaggcctcagccccaggtgaggcttaataccccctctccaggcagaaagtaaccatttcttttccagtggttctccagcttagggtctccagccagactggccgcttatgggccaggtgtaaagagagggacagagggggcagggaagtgcgagtgttctcaggccactggggcccgtccccacccacacccagtcatcagccccagggacagccaggccctccgcagtgcagggtacaccccgattctgcagccgggccccagggcccagtgcttcctccaggctgccccgggatccctcctgagtggcaggcccaggcccggactctggccccaacccgcaggctcagaggcagccctgccttccacagaccaggccacgagttgcctgtcactcagctcttctgcctggttggtcacactgaaaagagcatcccgtggctgggaggcatggatatcagctccaactcggctcaggaagcaagagctggaaacccaggcgcaggaggcatcttcaggcccggcgcatgctgtggcagctgccccaggtcctcccaaacgccacctgccaaactggccctcctccccatctgggtttagcaaactcctactcatcctccaaagcccagagcgaaagggctcctcttccatgatgctcctcttccaaaagcagcccagggtctcccctacggcactcagcacccaccgcagacactgtctgtgtccttgaagctgatctccctgccagacgggcagcggccctcgagggcattgcaaatgggatgcctgacaagaacaacccttgaggattaggaaataggggtctgctggaagccaatgcaggctggatctgagacctcctgaagacaaagcgcagggagctgtgctcatgctcacactgggcatggggttcacactgtctgctgagggctgcttccctgtcctggaggatgggaaggacagaggggaaagaggggctcacccacatcctgctctctgcacagtgccccctccagcgcctgtccacacagaccagccgcactgcagtccctcagaagccctagggttccaccccatctatgcaccctctccctgggttcatgcctgctcccctgggcccaccccacccatgcgcctactccccccacagcccacccatccccagaaccctccttgcccacatgccacagcagtatacttttgaaggcaacactgaaggtggggagtttctgaaatcctctgtgcttccatctcctctatgggcgcaccccaagaggttgggagagcgaggtgctggtgcccagcccagcacagatagatgaggccaccgtccagtctacttcgtttttccagacatctcacacccataactggcctgaggaacctcattccagcttccaaagaacacggagtgccaagcaccaccacaccccaggctccacacctcccagaacccttgtggtaggggaaggagggggttactctgccccatttacctaagggaaactgtaaggcctggatggagaagtgccccccctccagctcacacggctaccaggccagagacctttgccccaccacacatgttggcccacagatgaggcggtgagtcattcagccacatcacagacgggagatcccctgccccttgggaggagctggagtccccacacctgggatccagtgccaggctttagcacggacccctgtgtgcccacacccaccctgtctgaaccccccattaagggactcgtgtttacacaccggtccctgagtccccgatttctgagaaaattaattggcagggtaattctcactagagtgttgttgacttctccatttgtagcttgctctttctgacagtatctgcactgcagagggagaacctgaagaagacctcacctgagctccgaggtgtggatttctgggcagatttgagactttgtggcccctgctaaggggatataattgagggtccccataaatcatgactcggtctatgaggaaccagcacctagctgcatccccagcctcttccttcttcacacccaagcaaaaccccaggttccagccccacctagcagactgagggcaggccatggtcccccctgctccattccagactccactctggcttttctccttcaggaaacctcctcataaccctcaggctgggtccggggcccaggccctacagacgtgctgggtgctggtgctgacagacaggacggcaaccgtagctggacctcaccctggacagcatcgccacaacccccactggtccacctgggagaacagagacccagagatagccacacactgtcctctgtgcccctcattgccccccaggcctttgggggttctgggggtggctactgcagtttaatttgggccacaacccctaatgagcagcccaacggcatggggggcagtttgtaggcacccagagcctgagcaatgtggcagaaagtccagggggccttccaggggcctccaagtgacccaggtatctggcagagcccagctggccccagggctcccagtcccggcctcctgctccccggcccattggccctggctgcagcctcagttgtaccagctggggagtcccagatttcctgtaccaccaccccacacacttggtcccctaaagacctgatactgagctcttgctaatcatctggctgtcactaagctgccccacaaccattttcaaagagtccctgatttttaaggcccataaaacactgtgaaatggcctttttcaaacattgagggcattaatgaccatggcaaaaacaaaaacctgtccaggtggccagtttttagtagctcccaatacaaaattgcccccaccacgcagcccccacctgtccacgccccctccacttacccaccccgagggattctagccaggacccctgcgtcctgagaaatcctttccaggagtaggctggggaataccggcccagaggggcgaggaccggatgggggcaggggtagggttcaaggggccagggtcccaggggctctcctggaggctgcagaggaacccagcctgggtggggggctccgacgctccacagcctgtcctggcccggccaggcccggcccggcccggccccctgcccagtcgcggcactgcccggcccgacccccagaccttcggggtgcccagtccgagcctgggccgctaggggccgcgggcctggcgggcggggcgggggccggggtcgggggtccggcgagctttaatgcgcgcacaaagcctcatttgcaggtcaatgccgcggcacactcgcctctcccctcgcccggcgccctttgtccggccgcgcccgctcctcgcgccagatggccgcggaaatgctaatttcgggcgcccctgcccccccacccccgcgtttaattgcgcctttgcagatgggccgcgagtgtgcgcttcatgcagatgagcgcggcctcgccgccttcctcggacctccgggagccgcggccgggcgtgctggggccgagggcagggagggggccgctgtccctccactcgacgcgccgccgggcacgggcgggcacccagcggcccgggcccgggaagcgcgcttctctcttttcatttctccaaaatgggatcttaagtgattctgaatgaaaacaaattggcccgctttcttctccaaacagacgcgcggcgcggtgggggcggcgggcgcgggcccggggcggcccgggcggtggggttggctccgggaccccctgcccggcccggccctcgcgccttctccccgcggcccgccttcctcagccctgggccggcggcacttggaggcggccgggcaagacggcagacgtgggggcccctttaaccagagccaaggatccccggactttctgaccaaccaggagcagaagcccgccaggtcaccctcgcctttcatgacagaaacagattcccaggctggtcggagcgcagaaatgaggcaggccagggccggcctccgccaccccgcccatctccagccccagcaggagcctggcccaggcctctggccccacagcgccagggagcatcctccgggagcccaggcctgcctcgaagcctagggctggggcaggctgggcagagtgagggagggaggcagtttctttgtgatgtgtccactttactagcaaaatttcaaccacaaacttagaaaacctatacattggtgggtgattcacttgctccaccaccagcgatgaaacagagacagagccacgttctgggtaagtaagaatactcccaatacaaaactcagccacagacctttaaaaagaaaagggtgccgggcgcggtggctcacgcccgtaatcccaacactctgggaggccgaggcgggaggactgcttgagcgcaggagttccagtccagcctgcacaacctggcgaggtcgcatctctacaaaaaatcttctgatttttttagccaggcgtagcggcgcgcctgtagtcccaggaaggatcacttgagcctgggaggtggaggctacatagagccatgactgtgccactatactccagcccaggtgacagagtaagaccctatctcaaaaaagaaagaaaaaaaagagaaagagaaagaaagagagaagaaggaggaggaggaggagggaggagggaggaagaaaggaaagaaagaagaaaaagaaaggaagagaaagaaagaaaaagaagagataaagaaagaaaaaagaaagaaaaagaaagaaagaaagaaagaaagaaagaaagaaagaaagaaagaaagaaagagaaagaaaatcatctgttcctgaaacattctgtgatactttcgtaatttgctcagccagaggactgaaagtgcaggcggatccctcagccttgggctcagctgggactgaagtcagctgacagagtgaatctggcccaactgccaccagtctgactctggcaccctggccctggcgtgaccttcacagccgcaccccccaccccccacctccgcctcaatgcccaccctccagctccacatcactgagcctgccctgctgcgcccttgcacgggcaccctggctgccagctctcctccacccattcctcctctgagtgtcctcaggcccctcaggggctgctcttccctggacacccaggagcctcaacctttgccctgtgccacacctccctcacctggctcttgaaaggagtcccatccaccttcccctcagggtgaagctcagggcctggcccacacccctgctggtactcaaggcccacctgggggacctaatggggggttccagtagacaccgaggccgaggccggagggctcagccacccttgtcacccatcctgcagggcactgtctcatgggtgccagcacagtgacatgccgtgggctgggggaagctggctcatagaatatgcacggccaggacgcaccgtggaaatttccatggtcacgggatggaaaccatttcctatcaataaaataacaggtgccccgtcagaatccccctttcatttctttccaggaaacagttcaaatgggatggttacacccatttgagacaaacatctcttggtcctaaccccttgtggttgcttcattaaccagaggcctccatcttcctctggggaagacagtgcagcccagctgccctccgcctccaaaccctccctgggccctgaggtgccgtgtggacccactgctgcaatcgccatgttcaccccacactcgagggtagacccagagcatttgaactgtcctcgtactccctcggccacttctcaacaacagcgcattcccaatcctgtaacctggggcctttccctaacacatttaaaagacgccagccgccttctcccgccctagcactgtcaccagctgcttgtactcaactctctgccaaactgttactttgtttatcacactcagattacgggtctcttgaacagtttgttatggttaaatactttcaattaaaacagtatatgtttgtgtgtgtgtatacaaatagatagacattctaatactttaaaataggtactttgagctgggcacaatggtgcacacctgtagtcccagctactccagaggcagaggtgagagaatctcttgagcccaggagttccagtccagattggacaacatagcaagaccctgtctctattaaaaatatacctttatgccagatgcctataatcccagcactttgagaggccgaggcaggaggatcacttgagcccaagaattggagaccagcctggacaacatagggagaccctgtctctacaaaaaaaaaaaaaattaaagattagctgggcatggtggcacacacctatggtctcagccactcgggaggctgaggtgggtggagggcttgagcccaggcgttggaagctgcagtgagccatgatcgtgccactgcactccaacctgggtgacagaatgagatcctatctcaaaaaatattttttaattaaaataaaatatgtgctttggacttaaaaagtaaatgtgagtcccatagatgtaaaatgatatagagccccaaagtgccatctgcgcttatctcaggatagcagcatctatctgggggaatttttactgtcttttttatacattcccatattgtttgcattttttttttttacaatgagcatatgctgctatttctacaaccaagggaaatatatggctattttcaatttggaaatcaaaagaaataaaaagccccactggcttgccagccctgtgacctgggtgctgtagcaataatgcctggaactggccccagccgatgagggaccccagccacagcccatgccagagtccactgtcaggaccatcttacgagaggggctgcctcagaatggagtcctgggggcacctcagtaactaaacccccttggatggaagccaggccagacccactcagtgccaaattccactcgggcctgctctcagttccagcaaaattccaaagtatattgttgttatcgttattattttgcaattacgtgacattttttaaatgcctagactgttttctcagccattttcattagctccttctcactctgcccaagagacacttcagcattgtgtctgccactgggcaggctggccaaggctcagagaggtcaactaacctgcctaggttgcacagcaacagagcagcgggtgcgagagcagacgtcagggctgggcccaggtcatcctgcagagctggggggtgggtctcgctgttgggccctgttgggcttttattcagatttaggaatttcttggggggcgggggcaggggcagatttgggaaagagaagaaaaagtaggaacgagagaagagagaagaaaaggcaaggaaagcccaaggccgaagcaagagagcaaaataagcagaagacaccacgggtgtggggctggcagcaccgcactgagagcccctggcagggaaccagcccctggaggtgcccctgccttctccccacagcctggcatggtgccggcttccagaggagcctcgtttctcagtgaggggggcgggagggggtgagacagcatccgtgtctagacgcttatcctttgaggagaataccagggtccccaaatgccacttgagatctctctgaaatgcaggaggccctggagcctgcatttgtcatcagcctcagtcaccacacctacccccagctcaggagcaggtgccacagctcaacctggctctcatgctgaaccaggtccccagaggtctggacattgccactcaccagcaggcatcccgggccacagggcaggacgcccaatctggaagcccagtgttatgggaggaatcgtatcccccaaaaatcatatgtcgaagccctcacccccagcacctcagcacatgactgtatgtggatacagggttttacagaaaacagttaaaatgaggccattggtgtgggcctaatccaacaggactggggtctttataaggagaggaggacacaggcacactcagaggcatgaccctcccaggacacagggagaaggtgacgtctgcaagccaaggagagaggcctcaggaggaaccagccctgccgactccttgatcgtggactccagcctccaggactggtagatgataaacatctgctgtctcagcagccctgtctgtgatgctttgtgatggcagctccaaggcaggaatacacccagcatccacagagggattacatctgtccaggcccgcacagccagggcagacagagagaccacaccccagccctccagaccagtggaaacccccacgtacccctggctcagagaccttctctgactgagcgcatgaagctggctcttcctggctagtttccctcagatgcatcatcccaacacctaggggcacattgtgcaagtagagagtcccccagtataccattttccaaggcagagacaaaaaaaaagccatgtgcagagttgacgtctgtatacccctaatgctaattggggacagtggcatttagttctgagtggctgacggctttggtgacctggacaatcagggcctgcctgaagaaccaggggctgccggaggcgctgggcctccctcccactcaccggggccttcattaacagccgcgtccagaccagctggagtcagctgattagcccattctaagtggcattgggagtccccccaccccctgtatctattttttcacccgcacatgttcaattcaattttgcttttgtgccagagaggcctctgatgtgagtgtttctggggagtttttccatgtttctttatgtcctcgaaaccaaagtcagtcaccaactttcagaaaacaccctcctggattgaagcgggtaagaggaaagaaaaacacacaacacaaaacaaaagcaaaagaaaacaaaagagaaagcactggctgcctttctacagaatcctcctgcgaggagacaattcatttcaattgaaacgtttccattgtgcggcattcggaacgcgctcctcgcgttgggcagaaatgcaaatccccctttttcctttgattcaaatatttaaattttcaaatatatatgctgcgacaattgaatggcagctgacctcacttattttcatagaagcaatgcggaagccacaggctgcagttaatctcgccagcagcgccccgcctgctgacagcggtacggtcagtcctgggggggcgcagggaataatccttttattcagacatttggcttaaaagaataacaaggaggaaaagctggaacataattgcattgcatggaaaacagagaaagatttttttctctctctctaacaagctttctccttttccttcctcaaagaatcggaggctcacggccagaggctgttttcttggtaaagaaatcgggagtgttttccttccactattgtccccactcccgcccaccccccgagggattttcatagttgggttggctgccacactggctcatccattcattcattcattcactcactcactcattctgcaaactcggaaggaagacctactgtctgtccagctcagctgggctgggggcagggcgagccagacactccccaggcagccttcctctcctggactgggacgcccccacagagccacaccgtgaccctcggaggcaccctgaagcataactgggccaaccgtgcctgcaggaagcccctttgttcctccttggggccccagagcacctgagtgaaagagtctgagaccggaggggcagccagagggggccctggagggaggcggagggaccccctccctgggccagccaggccagcgtctgccagagtcgctgttgctaagtcctcttcttgcagcctggggatcccagaggaccccggcccagtccatcagctgggctgggtctttaatatttaaagagctctcccggacatttcaagaactccccgacacgattttctgtgatgcgtgggctgtcgggacatctgtcttctatacctaataaagtcgcccgacgcagaatgaactcctcggcatcgctttgaatccgggctcacatatggttgctaattagctggctatctcttggagttaaatgattttttttctcgccccgttcgcatccataatagacgcgaacagagtcgtgattgttccctgttgcgggacattctgcgcctgaatgagcgggggctgctgtgtcgacgcggatttgccatatggttgcgcggagccaggaagaatgggcccctgtgtgtgcgaccgggacgcagcggcgcgggccgtgccagccgggcggagccgggtgcccgacggcgcaggacgagcgggcgcaggacgagcgagcgcagcgggcgcgggcgcaccgtcggggcgcggggaccccgagggccagcggagccgtgctgcgcgcagggatggacgctgggcgcccaaggcccgttcccgtggacaggcgcgcggagggcagcaggaccgatgcaccgacggacgcaccgacggacgcgcggacagatgcgccgaccgcaggctctcccgccgtcccggggccgtcgtgcccgtgcaggccgcgagcagcggcggggccggctctgcggctgcagcagccccattgtgaggccggcgagacaatgggcggcccgaggaggcacctgctcgcctgaaaggcccataaatcgccgccgcgtccagctgccttcccgcccctccccgcggacccgctagcgggaagcgcggccgcggccgggagggggaggctcggtccgacagtcgggcagggccgcctgggccaccgccgcgcgctccctcccgcctgggcgcagctgcccgcacgccccgacgggagctgcgcccagcctcccctctggagtcggcgctccaggctgctgcccggccggtggccaaggccccagcaccaccgtccctcctgcagggcatccagcacctacccttccactgggcggctcctggttctggtcccggctggctcactcaggctgcctttggaccagattcttgaacttttccaccaaggatgttgctgctgtttgtagcgtcggatcctggaaaatcgctgtgttggggagcagcaggctctcccttgctcccccagggcctgggaaaatcaacccacctctgccccccgaccccagggctgtaacctggtgtctggtagccccactgtgataaaccgaagcccagcacagtttgggactcgccccgagttgacttatgcagcccccagaacagaggctgaaacccggcgcatcctggtgaagccacacccagccggcctggtcccaggccccgggcacggggtcccctccactcccatctgcttccctttcagagccggggctgagtcggcagggacgcaggctcagggccctggattcccgctttctggacacttgcgtgcatgcccagcaccagctcgcccttctgagaaagcaatccctcctcagaggggagaagccgtggctgtgatgggcaggaagtggtcaggacccactgccgagcaccaactccccatgccaccaccaggggtgcgcctggactcctggaaaggggtcgcgtcagggtgcagcccatcaaaggcttcccaagaggcaagaggcaaggagaagtgtcctactttaaacggccagcctcaggtgagcaccagagatcgggcccagacctgtgtagagaaaaggaggcaatggcccctggctacagacaaggaccctgaggctgccctcttccctctgcacctttggttaggcactgcctctctgtgtggaaggagcaggactcggtcccaagaccatttggccacgctgtgccctcgggaccagcacgtgctggcaccccgatcccactgggactctcttccaggaaaaggcttgtgttcagttcccagggctctgccaacaccagccctgtgctggctgcctgcagcaggcaccccatggggaccacatccctgggcctggaggagctggctgagacagaggcgggcccgaggccaggcctttgcccgccactgctgctccaggcactcctggagggctctgagcatgctccttaggtctcccggctgcagggaggacactcactcccacccccaggtgtctggtgctttgattttaattatttctagccttccagtgccatctcttatcgccccctccccagtctcctaataaagggccagcgccccccgccttcctctagcctccctgacatattagaagaatgtttttccatttcctttgatgtctgttacaagttgcatctcatttcctgcttgggcatttctgacctcgagtgactccggccgccgtggctgcgtggctggtctgctcctcataccccgcccagacgccagcttgagaggatttggtcctccgtgtgccgccaccgccaactcagtttccccctaccctccccactttgttttctggggctccaagggggaggtcaggccctcaaccctgtttccatggagagggctcctcacggggggcgggggggcatccctccatgggacagggagggctcctcacggttgaggggggcgcccatccttctatggggcttcctaaagacctgcattcttcccttcatttttctgggattactcccctttcagtggtcggccctgttcactctgccacctcagagagagtgaacccagcagaggtgtgacgggaggctggggagagaccccagcaccttgagcacacaggagccaggaggagcccaacagagcagcaggggctggggtcttctcctgaagcctgactccatgggaccccaaagaagcagatggaaaactgaaaaagaaaacccctcaagtgagccactggaaagaaagcaaaacaagagaaaataaatgagttgtttgacataatttaacttgtctgtttttccatcttccttcctgctcaccccaccatcaccgtggccccatctagttgaggcacacagctctgggcttaaaggaaccaaggggcatgtctcagagcagtctccaaattgggtgctaggacccaagaaatgcagagagggcagtggctgtgagagaggtttgcataagaaaacagacaagacagaacttggttttatctttttttttttttttttttttttgagacagagttctgctcttgttgcccaggccagagtgcaatggtgtggtctgggctcactgcaacctctgccccccgggttcaagcgattctcctgcctcagcctccctctcgagtagctgggattacaggcgcccaccaccacactcagctaattttttttttttttttttttgtaattttagtagagacagggttttgccatggtggccaggctggtctcgaactcttgacctcaggtgatctgcccgcctgagccacccaaagtactgggattacaggcatgatccaccacgcatggccagttttgccttaaaaccacagctagactcctccacagggaccaggacctaggccatgtctgtcctggctgcagaggtgggtcagccccatacagtgctctctggaagagaaacagggagcagcgtggctcctgcacagaggcacctggctggcccttggcctactggtagcctccaagggtagatgccaggtatctcagtccatttgtgccacagtaacaaaatacctgagactgggtgatttattttctattttttatttatttatttatttatttatttttgagatggggttttgctcttgctgcccagattggagtgtgatggcacgatcttggctcactgcaacctctgcctcccaggttcaagcgattctcctgcctcagcctcctgactagctgggattacaggcatgtgccaccacacccggctaattttgtatttttagtagagatgaggtttctccatgtttgtcaggctggtctcgaactcctgacctcaggtaatccacccaccttggcttcccaaagtgctgggattacaggtgtgagccactgcgcctggctaattttctaggtttagtagagatggggtttctccatgttggtcaggctggtcttgaactcctgacctcaggtgatccacgagactgggtgatttataaataacagaaatgtatttctcaccgttctggaggctgggaagtccaagatcaaggtgccagtgcaatcagggtctggtgagggctctctgcttccaagatggcactgtgttgtaagtgaagcgaacgctttgggaagcctcttttataaaagctttaatctcactcagagggaggaaccctcaggcttaaatacctcctaaaggccctatttctttctctcttctttttttttttttttttttttttgtgagacacagtcttgctctgttgcccaggctggaatacagtcgtaccatctcagctcactgcaacctccacctcctgggttcaagcagttctccctgcctcagacttccaagtacctaggtaacaggtgcccaccaccatgcccagttaatttttgtatttttagtagagatggggtttcaccatgttggccaggctggtctcaaactcctgacgtcaggtgatctgcccacttcgacctcccaaagtgctaggattacaggcgtgagccactgtgcctggccctttttttttttttttttttttttttttgacaggatctggctctctggctctgtcaaccaggctgtggtacagtggcacggtcatggctcactgcaacctccacctcccaggcttgagtgatcctcccatctcagcctcctgactagcacgcatcaccacacctggctaatatttctttttttgtagagaaaagttctccctacattgcccaggctggtctgaaaatcctgggctcaagcaatccactcacctcagcctcccaaagtgctgagatcacaggcttgagctactgcgcccagcttcccacttacattaatactatcacattggccagtaagtttcagacacgaattctggaggggacatagtcaaacccagcaccaggtctcaggtgtccttacttctccctctgcaattccggcttcaccacagccctcaggtgtaaggccttgttgtccagaccatgtgctttttcccaggactgagagtgaagtgctgaggttgcatgataaaaacccatgtgactatatgaccattaaagtgaatagcccccagagcactgggcggtggggaccggggctccctcctacacagacagaccaattaaggtcttccaggcctgcatgtaggccaggctacagggatggaatcagcacccagctagagcagaagggtctaaaggaaccaaaaggggttctgggacaaatctcaaaccatgggcaagcttcgctcaagcactcaaggaacattcgagctagatgggccctcagagactctgatcctatgttctcctttcagtgagggaaaattgaggcccagggaggcttctgcaccctagacaggccccactccttagagggaccagtgaggggaagtcagaccccagcaagacggaggaagtcccaaattggagacaatcagaaagacaacaccagtgcagaccctaaaccaacaccccacctgctccaagctgggctccagtcgcctaaggatgagctgggcccatgcaaactccctgtgtgtttcctgcatgtgggccaccaggcaaccaccctctaacttgaacccctgcccacagaccccagtaccacccaatggttggccaggggcacccccaaaggattggatcatgccgaaggtagccacaggcagatgacagtgtcaaagggaagggggataagtggtttttgttcacgcagaccataggagtgaaggttgtagcattcccaaatgtaagtccgcgtggctaagaccacgggcagggctccccagctggcctggctcccagtgtctgtgcattatcgtgtgcgtgtgaggcatttccacttggattactatttcagctcccaaaaatggatcagtggctcacaggaggatccaggaagcagcaaatattgacccgtcaggatttcaaggtgaacgtgggatgtcccctacatgcagggaccgtccaccaagtgtgacactggacacaggatgtcctggatttgtcccaggtgcatggtctcttaagacacttggccagatggtggcgtgaggccagcagtggttttgtgtcattttcaagcaaagcccagggccttccctgggagctagcattgttattctagaatgagtggaaagggacactttccagggcaaagctgatgtgcaccacactgaagatgggaaagaacccacgctgtatcttcctgtccacattgcatttgtaagaatgaaacttgcgtgagttgcacggaggaagaatttgcagttgggggaatgcagtgtctgggatctgctttttttgttgttggtttttttcaatagagacagggtctcgctatgttgcccaggctgatctccaactcctgggctcaagcagtccttctacctcaatctcccaaagtgctgggattacaggcatcacccactgtgctcagccagggatctgctttatgaaactgcagaaaggaaaaaaaagtaaaagtggaggtgggaaacagattgacaagattggaaaaatgttaatgatggttgaaactggctggtgatgtactattctattgcttttgagtatgtttgcaaatttccataagaatgctttgtaaggaagtagcagtgatactgttacatattgctgagaaaatgtaaaaccaaatacaaagttaacaaaaagagataaattatgtacatatagacaatatatgcacacatacatacatgtgttgtgtgtatacatacacattatgtgtacgtgtgtatgtctataacatatagacacatacatgttatgtacacgcacataaaagaaggcagaaaggctgtgggcagataccctgatcaagagtttttgtgacatcatcacagtggccttgcagcccttactcaggggtccttgctgacatgaactcacagcagtgtgcctctcaactaggcctgcatctttctaatttgctagacaggaagccactcctggcacttggtcaggtcaaacacaagaagtgtttgatgatttttttttaattctgttaattactgaaaatccatgctagaggaaaaaaattgtttttattttgaatttacttatttattgagacagagtcttgctctgctgcccaggctggaatgcagtggtgtgatcacgactcactgcagacttgacttcccaggctcaagcaatcctcccatctcagcccccaagtagctgggaccacaggtacacgccaccacgcccagataatttttatattttttgtagtgacagggtctcactgtattgcctaggctggtctcaaacttctgagctcaagtgatcctcacaccttggcctcccaaagtgctgggattataggctgttttgaattcaggtaacaattgcttgtgggtcctgaagtaaacccccccaaacatgctggctatcaatcaatcaccagggttgggttctgtaagaagggtgttggggcaaagatggctgcaaaccctttgccactcaagcagaaaggatccccctgccatgaatctgggatggtgtcagtagcttgcttgatcaatcaaatgaggcagacatgatgctgcatagcttccgaggccaggtctctagagctgctcctaggcctcctggaacacctgctcttgaaacccagctgccatgccatgaggaagcccaagcaggcctgcgaagggagccacaggcagcagctcccagggctttgccaggcatgggagtgggccatattggaagttgattcctcaaccccaatcaaactactctagctgacatcccataacacagagccaagctattctgccaactgttccccaatttctgatagaatcataggtataaataaaaccactgggtttttttgtttgtttttttgtttttttgaggtggagtcttgctctgtcgcccaggctggagtgcagtggtgcaatctcggctcactgcaagctccggcctcctgggttcaggccattctcagcctcagcctcccgagtagctgggactacaggcgcccaccaccacgcccagctgattttttgtatttttttggtagagacggggtttcaccacgttagtcaggatggtttcaatttcctgacttcgtaatcctcccacctcggcctcccaaagtgctaggattacaggcgtgagccaccgcacccggctaaaaccactgttttaaaccacaaagtgttgggatagttgtttacttggcaggagatcatgagaacaggtgtaatcatgctaacagaagaggaggtaccggctgcctgtccacacccgactttatgcctcagtgttgaacagcagagtagtggctgtgatttggggcagaagggaatggtgagtacacacagctgtctgacactggagcaggcaagccctgccaagaaagtcctgcccctgagggctttcaagtaacagctaagatcagagcgttttcttcctggcgccactaggtcatcagaggccattttcattttttatcccaaggggcttgcccatggagcagagcttggtgatataatcaatatctcagctgcccctgaaacaaccacttcaaggcttaaataacacaatttttaattttcagaataagcaattgcgattttttttttttttttgagacggagtcttgctccgtcgcccaggctggagtgcagtggtgccatcttggctcactgcaacctctgcctctcgggttcaagcgattctcctgccttagcctcccaagtagctgggattacaggcacgtaccaccatgtctggctaattttttgtatttttattagagacggggtttcaccgtgttagccaggatggtcttgatctcctgacctcgtgatctgactgcctcagcctcccaaagtgctgggagtacaggaatgagccacctcgcccagccactttttttttttttttttttttttgagacagggtctcgctcacactgtcgcccaggctggagtacagtggcacaactgatcatggctcactgcaatctccgcttcccgagctcaagtgatccttccatctcagtcccccagggagctgggaccacaggtgcacacacaccaccaaagctggctaatttttaaaatttttttacagatggagtcttgctatattgccccaagctggtctcaaactcctgggctcaagtgatcctcccacctcagcctcccaaagtgctttgattacaggcatgagcgtccgcacccagccaggatttcttcaggatgctagagtgtgggcagccagctccatctctgagactttgacccttccccaaatcacaatcattttattccttcatcaaagaaaaaaaagatgacttactagacagttgttaaggcactcacataaaactacacgatagcaggatagatggtaaccaagagggaactcaggacccgtcactaccagctggaaacacctgacctccagcctgcaaatgtgacaagctagaccaacaccagcaggacactgaacacagcttgcagggatgagtctctgcgtcatttctggacatgtgtccaagtaaccagaacaactcaaaatgccaccaggcccttgctgtcattcccataaacctcgaacagtgagttgggtcttcaaggaacctgtctctgtcagcttaccttatgctgcataacaaacaggcccaaagctcttggcagcgtacatcaagcatggaggatctctcactcaccacgacagtcccttcgctggagggctggggttgtactccattttctcttttggaaggggcggcccctgtctgaggtctcatttgtctcacagcagagggatgaaacggcaggacgctggctttgacgggctccatttggcaatggtacatgccaagtgggtcacgtttcactgcccagagcaagttacatggccacgtctgatattgacgtgcgggaaatgcagaatcttcctgcatttggggaggcagatatttggacaacatgcaattcattacagggccagctggatgaagaacggccaagggcccaggctcttcaccccgagccaggccgaaccagccggggccgtgagatcaagccacggtcatcagtgttcgtttggaattatgccttgtccttgccgtgtccacattgtagtagggtttctgttttttaattcatctgaaattggtggtgggtgtggtacacagatgagaaacaggaactctccacgctgggctttaacaggagctgcggtgggaacacaaatggtgcagccactttggaagatagtttggtggctccttacaaaactaaatgtacccttcacatatgatccgccacacaccatccagcaattgtaccccttggtatttgcccagatgagtcaaaaacttgcatccacacaaaaacttgcacgtggatgttgatagcagctttattcataattgcccaaacctggaagccttcaggaggtgagtgggtaaacaaactgtggtgcctccggtcagcggaatattattcagtgctaaaaagaaatgagctcaagtcatggaaagacatgaaagaaccttaagtattattaagtcaaagaagccaatctgaaaaggctgatgctgtatgagttcacatctatgacattatagaaaaggcaaaactacaaagacagtaaaaggatcagtggttgcaggagctagggaggagggagggatgaataggtggggcacagaggatttttagggcagtgaaactaccttgtatgatactgtaatggtggacacaggacagtaagcatttgtccaaacccgtagaatgtacggcactgagaacggaccctcctgtaacctatggacttcagttaataatattgaaccaaaaaataactaacaataaaacagtgctcttcagacaccattacctgctatgtcacctgctgggagctggaggaggggcttcctagcccctcctgttttaaaggctaggctggtgcttggctcagctctgtcccacccccccacaccaaccacctttgtatgcaccacagcccactggaggggttttctgatgtcaccagtggagaaagcgcctgcagcagggactgctgtctctctattcattgctaagtctctggtgcctggaacaggggctggcatgctggagcctcttggagtgtccacccaacccagtgcctctgccctctgcctggatggccacagtgtccttctggtcccctcacccccttccctcttgctggcgctcctccttcctcacccagcagctgagatgcttctactactccctgcttcagtccctccggggctccccactgctggctgacaaaatccaatctttggcaccagtccatcaggcccggggaggtacaggagaccagtaggacagggcagggaagggggaggcccagcaggcacacccaaaagacacccttacactgaaccacatgtacgcccgtgtgccggcctcacacacaccagcaggccaggcccaccaaggccccctggcaccagcagcctcccctgccttatctctcctgcctcaccctgatcccctggctccgacacattcacccttctccctcatcactttcatctggactgtctgtaggttaacggagcaactgcctgtcttcccagcccagtccaggggacaggatagtgcaatggtttccaggcccggccccagagcaccccagcccaacatccctctgccctgccaaggtcaggagtgtgacctcaggtggattactccatgcctcagtttcctcttcaaacaaggaaaacagtgggacctggttgacgctgatcctgcttagcatatgcctggcacagagaaaagccattgctgtgtgcctggcggtcctggtgtcatcgctcatatgatggttgtggatccccagtggagctggagcgtgactcccacacggcagacccatgagtgtgctggctgccagccggtgcctgtgttttcagcttggatgaggcctgggggccaggacgcacgctcctatctgctctttcccaacagcatgggtgagaagagagctttgcaaacagtgccatcaggtattatttccatggctgtccccacgtgagaatcacagaacacagtgctggaaaaaaccctggacgtttctcagcccagatggggaaaccgaggccccccagaaggaaaggctagcttgcctgggtcacatgtgcccagagtcccacgtgtgactagcagcccatggaggctggtggcctgtgcatccctgcagccagctcctgccctggggagaaactcctcctgagaaatggcgctgggcctcaccttcacgtccccacaaaggcctcacactgcttttgagaaagctacccttgagtgacaagagggtgctgggcaaccacatgtcctgtgcccaagggccaggactgcaagaagctaagcaaggtaggagccccgccggccccagctgcagcaggaggcctggcagcagatgcagctgtggatgatgaggccccaacccagcagatcggtcaccacaaacagttaactcaggttacgctgtgcacccactaactgcctgccaggcacccggtccagcctcctcccagcccaaggcagaaggcactgccaccctcctttatctcagaagggaaaaggctttgtcctcctcacacaggtgaatgtggaggtttctcccctgtgggagaggttggaaggccgaagccaggtctacatgggtctggtccctcattaccgtcagctgagggtccctgttgctgagccgaagcagcgagacctgccactctcaggtcccgggggcatttcccggagtctggccccagctgggcctcgaggccaggcccatcaccctccccgcccagcccttccaggcagctggggggagctcagttaattacatgtctaaatacatctcgaccatctcaagttgagcccccctttgtccctgcccccggtggaggtgggaggaggaagtcagcaactgtcacgtagggccccgtaagggtccaccagttcttttcttctcccagcccaaggcaccagcaaaaatactgctagccgttctgtttttgctattttacatcaccctttccattgtaagccataattttcagaggtttataggtcagctattaaaataataaacgtctcttttactaagagggagcgctttgaaactcggggctggtagggtggacagtgggggcgcacaggggtgcactcagcctcgacttcttccaccaaagcctggttatcagaagccacccctccccatgtcctcctgattccagggcacctcccccttgtgctcccatttctgcctcccctcagaggcttcgaggctgcccctcctccactgcaggtgtgactagaccttgaacactttgagtgtcttgtggcaagacctagggagaccctggcccacaaaaacaggagaccctggtgcaaggcctgaagaagtctggaggactggctgtgtcttggtggagccctgctccacaccctccacctcagcgcatcctcaaactagcaggggcttgagcccatcagcagaggggttgcgggtggtttccttgaaacaagcctgggtctgggcagcaagtcaggggctgtgctccctgcctcctggggctacatgaagtccaggcttgtctttctgcagccccgcaggtgagaggtgataaatgcagggtgcagtgcaggccggccgcccctcctgagataaggggactggagcaggtgggtgtgggccaggcccagccaggagagaggcttccccttttggatggactggggatgcccactttgggctgctctctcctgcgttccagctctccagcttttgggggtgcaggagaagggagctggaggcaggcacaagcacaaacagactggagttgcagcatttttcggcctctttatttagaacccggcggacgaggggccggggcagtggtacagacggctcaggaaccattttaacagacttgtcttcaagtttcagataaacacagtcataataagagagacagcgaaagcgcgaagagactgcaagctagatgggcatgtatggcagctacagcttgtgagtgacccccttccccagagtccgcgatgaaaataaagttacacttgtcaataaccagatgtgggagatggagagtgcctttggcataaccaataaccgagctagtgcgtggcagagcggtccacgcctggacataaatagaaaatataagttagtataactttaaaaactttttgtacaaatatacatggtttttttattttttccttttttttttcttttttcttttttttgcactgagtttcagcagagattaaacattttatataaatgactcttaaagctttacaccttgggaccagtgtaccttctcgtgcagaatacatttagatataaaaagacgttattaatacattgcacagttttcaaaatttaaaaacaaaaccgaacgctgctctgcggcagccgccgccggttgctgctacatgaacggtcccagccgaggcccagcgcccttccaacgtccgctgccccggcaggttccctcggggctctttgggctctaaactgcgaggagaggggcggtcagcaaagccggcggggacccggcgggtcggccctccgcgcccccccaggtgcgctgtactcacttggctcaccgcagcctcttgcgcggggtctgctccaccgagcccacgccaggggcggcgcttggagagggacacggcgcggggacatcgcccgacgacttctcaggcgctgatctcttgcgcttggcgaagaaatctgcgggcgacagcgcgcgcggccggtcagggcggggccggcccggagacccgagagggggccgggagagggcgcggggcgcgggccggccggggtgggggcgccgtccccgcccgcgccgaggtccgcggcgggtcagctttgtttacgtcgccgcgcaatgtgctgtgtaagcatttccccttgtcccgcggccaagccccccggggccgccgccgcgcttaaccccctccacgccgtgctcacggcgcccggccgcgcccggggaggggctcccgcggccgggggcgaaaactgcgctcccggggggtcgcggccgggattcagcctcccaccccgcccgcgcgaagccgctggagggcacaacaacggggcggggaggggggtaagggcgcagccgcgccctgagcgctgcgggccctttaatgccacgggaggaggcgggaacccagcgaggcccccgagggctggggggaccggccggccggacaaagcggggccgggccgggccggggcggggccgtgcggggctcaccggagatcagaggcccggacagcttcttgatcgccgcgccgttggcgctggcggccgcggtgccggccgcgggacgtcccgaaatccccgagtgcagctggtcagcgagaggctcctggccgcgctgcccctggttcgcgccctgctcggcgctctcttgaggcgccgcgtccggggccggggccggggcgggggccggggcccgggccggggccggggctggggccggggccgcgactggagccggggccggagccggagccggagccggggccggggccggggccaggaccgcgaccgcgaccggagccgcgaccggagccgcgaccggagccggagccggggccggggctggagccaggaccgggactgggggcggggtggacgccggggccgggaccgggacactaggcagctgctccggcgcctcctcgaggccgtcgagggactcagcggccggctcgaggggcgggctgacagccaccgcgaccgcgacgggccgcggcgccagcagcaggcggcagcgccccacctgcaccgtctcgcggtagaacgcgggcaccgagtcgctgtccacttcggtccactgcaggcgtccagggccccgcagcggcatgtcctgctggaagtcgtaatcccagcggttctggtcctcggcgttcagctcggccaggcgggcctgcagctcgcggctcagctcctcgtggtccaccggcccgaagaggctgcggcaggcgctggtgcgcactagtactgggaaggtcccacgggcgacaagacgctccatcgtggatgtgctgcggagggacgcgtcggacatggcccggggctgcgcaaacgcgggcagcgagagaggagaggacagcgagaagaaggggaaaggagaggaggagagggcggaggccgggcgcaagggagaccccgcgccgcccgactctgcgtgtgcgagggacgcggcggctacctggctgtccggtggtggactcttctgcgtcgggttcgcctgtctcgtccggacggcagccgcgccccctcgatgcctgctggctagctcgctcgctcaggcctggccggcacccctcgagcacagcgcacttggcctgtggaacgcccagcccgcctgcgccccctttatacgcgcgggccccacccccgtgcgcgcgggcccggccgcgattagcataatgtagtattttcagtttcaacaacaccacggcgattggcggccgccccgctgccccgccccgccgcggcccggcccccgcgcaccgcccattggccgcgcgcacacccaccgggggcggggcggggcgcgcggccggggcgcgcggctgattggcggccgcggggcgagcgcgctgtagcaggggaagggggcggtgagcggggcgggggcgggagttaaagggcgctgcgggcggtaacgtgacaccgcgacgccccgccccctcgccccatcccccctgcaacactcccccacccccccggctcccgccccccgccggctcctttgtctgcaggcgggggcctcagcccagcgcggcaggggccggctcctggcgggtccggtgtccggccaggcccaactcgaccccggcccggtccggaccccggcgcccagctccgtcccgcgctcgcccgtgggcctcctgcgccagctgacgaggcttggacccgccgctgccagctcggccctggcctgcgccggatggggtcttcggctgcccccgcgcggcctgctgctgctgggctggtgtcccttcgagggctccgcgcgcctggagccctcacacacctgctggccctaaggccctcgagtcgggaggggggacaggggtcagctccactctttccccgagggaccatgtgtgggacaccttgagagactcccaccagccccctggagctggagtctgaagccgctatctgcggaggcccaccctgcccagtagatggaacaggggctgagcccatcatgtcactgtcgggggtcccagcccttctcagccttgggccagaccactccagccccgggatctgcctgtccaggctggctggaagctgttgtactgggtaaaagtgaaagatctgcccgaggtcataggggaaggggctgtgaaggaccatgcccctcccccgcctgcagcccttcctggtacagacctcggtcgtgcgcgcacgcacacacacacacacacacacacgcacgcacacacacggtgcttcaccccagccaggccagaccaaaagagaccattatttcctgctgcctcccttttggcccacctaccatgaggcagggagccccctcctcaaaccaggagcctcccagatcgggatggggactgtcagacacctgttggagggtccagcagcccatgagatctaagcccctatctcaggtgagcctgtgagccagcagagagacctctgggagggagggaaggtgcggtcccctgaaccccaaccagcctgcctttgagtcccaagacacccccacccccatggaatgctgtggcagtgtgcagctgcagctgggggagcagggcgggtcttctgggtctcagggaagcgagatctgaagtgaggggggtgaactggatgggacagggcgttaacccaggagaggggccagggccattcttggctcttgatggtggaaccaaaagccatgatttatgtgcaatttcatattcttctctgtgcacaatttacaaatttcccgcaacaagcccagatgtcacaattttcatcttaggaaaacaaagagaagctgaagaaggctccccaggccctgcgaacccctcaagcagggctcatatcaactggcctgggggcagaaagaggcaaagtctagtctgctccatgcccctatgctgccacctccccagagactaggagcaaagggctagagtgggtagtgacctagaggcccccggatacccacactccaaccatcaggactcattggccttggtgacaccactcagagggtgtagctgccatcatcctgtgttatagaagagcagcagagaccgcgtcagccgctgaggccgcacagctggaaggaagcagggctcagaactcccgggctgcctggctttctggtttggtttccacttaggtttcctacttttatttttccactttaccagcttaattacagagtcaaacccagtgctgtggggattcctccgtcttggcctcgttagaagctgagaggtgacctgctctaagtctgtcactctgaattcgatcaaagatggtacccaatagcattttaaacctgcacgtcccaggagcggggctgtgtccccccagcccaagccagggacacacctggaggaaggcaccccaggagctgggggctgggagttccaggctctgagaggaggcccaatgggcccagaagcaagcaaacatctgtctaggtgcaacaatcaagctctatttttgtaattaaaaatgtatccaaagggaaaaaagaaacaaaaggaacaatatttgtactctatgttgctgcagagagcagaactgcggagggggtgctagtcccaaggggtggactgtgctgtgctagtgccctaaatcctgcaagcgcggggttgggggggcgggggagaccgctgtcgggggtcgtgagttccgggcccttgtgtgcatgttcacgtcctgtcattcttgcccccagctgagagagcagtagaggaaaggcactacatccaccagcctttgcattctcctcggagcacacagaaagacattttccagttatcttgcacacaagtgggcggcgggacccgttttggccgggaacgttgtcaggaacgctgtacaccacttccaggcggtcacgtccgagctgcccaggcagtccttctgcgccctctgctggccagatggaggctgcagaccctgcggggccatcaggagagaaccaccaagcaccctctgcacaccgcattgcctgtgttgggcacaaagaataaacttttattgcatcttaacccactagaaatgtaggcttgtccatcacagtggggcgttacataccctaatacatagggaaggcataggtagatttcagttggccttttacagacaaggaaaccaaggcttgagaagattcaaaccttactgcagccatggctcacacctatataccctcagtactttgggagaccaaggcaggtggctcgcttgagcccaggagttccagacaagcctgggcaacatagagaaaccccatctctacgaatattttttaaattagctgggtgtggtggcacgtgcctgtggtcccagctactcgggaggctgaggtgggaggattgcttgagcccaggaggttgaggctatagtgagccgtgatcgtgccactacctctagcctggacgacagagcaagacgccctctaaaaaaaaaaaagaagaagaagaagaagaaagaagaagaagaaaaagaaaaacttgctgcccaagcagttaaggcaggattaacctgcagccctcactgctgtgcgttccttctaggaaagacccagaagccagagaagcctaggtcccaatcctggtggatcttcgtgctggaatcgttaagccagctgtttcccaggggccacccatgggccagtcctcaccacaacctcatgggtggtcggtcaatgtcgtaggcccgctttacagccgaggagacagaggcttccagaggcaaacacactggtccatgagtagcagaacgagggtaggcccaggaagccatgtccttggccacatgtgctttctggcgggtgacctccactccagtgcctccccggctgcccgaggcctccccttcccgggtgtggcagctgtacagctgccttgtcggcatgttcatggccccatcaggaatgtgtgccgcaggtggcttcacagggctaggaatgcccgtcctaggttaggcccaatccctacccagagccccagggaacccaaattctgggacacaggacacccggccagtgggccaatggcccctatcagggagtgaccaaggacaggccgggagctcttctttcccctctgacccatggtgaaacctgcctcgggcctgttccctgggttctgaggccctgagctatctgtcttcaaacaaacgaaggcctcaaagaatgttccattgagccatgggccccatatcacccatcaatcacaaagggctggggattgcaggcacagggtcaaggtgggtaggaggtgagggctggacaccatctgaatctgtgctgttccagggcccactagagagtctccaggtacccggagcctgccctcagcagtaccaccctcccacagcaccccagggaccctgcaagaggtgtctgtgcccttcccggctgcctccccagctgctccccaggtggtgccctgtggagaggaccagagggatattataaacaatgacaacacttgctgccttcatcttgtgcctgctcagggccctgccctaacccagggctgggctcgttgcctcatttaatccttccaagacccctgagagggaggtgtgttcgtgcccattttgcaagggaggggactcaggctcccagaggttaagccacctgcctgaggtcactgagacttgaggttggccctgcctttcacccagcctgagcccctccataggacttctgtgagggcacaagaaagcaggaaaagaaagaagtcaagggccctgggaatctcccctgacatctcccaccccaagccctagagccagggctgggcatctgtgcagggtacaaccctgcccagggatgcctgactctggaaaggccacccctttggcctcaaaccacatcacccagcagcaggtcctcagaccagccctggacaggagcttgactggctgtgcccccaaaggccccagagctccctgcccccactgagcctccaccttcccatccataagatggggtggggagtcatccagcccagaggccccaggggcatggggagtgacagattaacccaaggccccccctcccgcaacaggcggctcagcacacacttggcggggggccatgctgggccaggagagctcccccgcaccagttccccgcgcgcaaggctcgccccgccccccaggacaggctgttcttggggcggctgccaggcacgtcctccgcaggtgccggcctccctgcggtgacgtggccacatgcggcacaagctccgattacagggactgccttgtgctgggggttccggccaggggtcctcactccccaggaaccgatgggcggagctgggcaggccctgaggagaggcccagtgggaatagggaacagtcacccctgctccagaacgggaccaggggctgcttcccttggggtctggaagagagggaccccctggtcccagcctgcctgagactgctggtttcggcactgaatgttccaggaaaccgagggccactggtcatcgtgggcttcacacggcgcctttctgggctaggaagggggctcccgggctaggaagcaggtaccgaggagggtctcaaggacatgtggggacctatgtcagacacccctgcagccagctctgagcccaccaggcctttcctcctctccctgccaatccacaggacacagacacaggggtcccaggcccaatggctcactttatcagggaaacagcaggaaaaacaaatctggtgtgagcagatctcccttcccaccaagccccctgacttcctgctggagctcggggagacccctgtgaccagcatctcctgcctacggggggcgccagggcctcaaagcctctccaagccactccctcccaccctgctttccacacccaagccacagcgttcagagaagctcagggcctatttgaaatgccagagagtggggatgcctccagagaggtggcatgagggcccccagatgcaccccaccactccctcctccactgcaggaggaggggcctgcagttactgaggaagcctcacccctactgggccctcgggggtgaaggggcttcccaggccttgagggagactgtatttcagatgtcagttaaaagcgcctgctacatggcgtgacctctctgaatcctattactttcctgtgcaggaaactgaggcccagagaggtggagtgaccggcctagggtcccccagcaagtcagagacagtgaagccacctcctgccctgggctggggtcccgccccactgacctccagggtcagagaaggaggggagcccccaacacttaactccttccttctttccttcattccttcctccctcccattctccacctcctcctggctgagctttgaagccagggcagttggccagaccgagcgcagaggccaggaggtgacggcaggcttgccctggcggcctcccaggttaacacactcccaggtggctgcaccccacaggcgagggctgctcagagtagatgctcaaccaagaggttgcccgtgcccccttccccagccgcaggggcagccagaagccaagcagcctcccgcccactggagcctggagcctgagggctgaagctgggcgcctgctgccccctggcgtcccgaaacggcacagccaccaggacccccacccacctcattcatgcctcacacctgggggtgacttgggccagggccttgctctctggccccgagtcccctcaagtgtaagatgggggctctgcccagtgtggctgtccgggctgcagcgggcaggagcgcatttttcacaaaccccaacacccctcggatctgggggtggggcggtgtcactcgcacctcagtgggaaacagcacgtgggcctcgcccgtctccagggggtgggggaggggagacaaagagcccgctctgcggagaggtgggtacccgccctgccgcccctcccccatttcctctctgctccccctgcccctcctcccctccctcctccttccttccctcctcatccccagctcctcctcttcctcttcctgccctatccccccgcaggcccggccggcagcccggcgccctctgccttcgttcccgccattggcgctgctgcccggagcccctaggtgacagccagccccgaggctgcagcctctgtgtcgggcctgcacctgcccaccgcgtggtcactgcctgggcacgtatggacactcacacccttcagtcctgagcacaactgtgccctggctgcttcggaacaacaaggaatcatagtcctgcttctggctgggagctgggggccagcaatcagggcagctggggaagtggttagggaggtggcggcacacaggccgagctcagagagtgagcagagaatgggcccaggggagggcgctggagagggctgcagggcttggggctgcagctcaggagctggcttcaccttggaggctatcagacctgctcctcagcattggcccagcaaggggaacagtatggggaacaggggacaggcactgcctggccagcagcaaacaagtaggctgtggagttgggcagagcatctgcctcttactagctgtgtgtccttgggcaagttgcttaacctctctgtgcctcttctttctcatctgtaaagcttctgatgaggcttaaagggcaagtcagtatgtgcctggcacagcggccttcctcttgaggatgccactaccctcaccatcatcagcctctccctccaacctagaggggcaggcagggcagagagctgccactggccacccctccagctgtgctgtaatgaaaactggacattcactctatacccagagatgtgggctggcggggaggaaaggcacctacacccctgccatgtaaacaggcaggcagggtgaaaggggtttggtttgtttgtttgttttttgagatggagtctcaccctgtcgcccaggctggagtgcagtggcgcgatcttggctcactgcaacctccgcctcccaggttcaagcaattctgcctcagcctcccaagtagctgggactacaggcgcctgccaccacacctggctaatttttgtatttttagtagagacggggtttcaccatgttggccaagctggtctcaaactcctgacctcatgatccacctgccttagcctcccaaagtgctgggattacaggtatgagccaccgtgccaagcctaggatgaaatgttatctacatgatgagcagtttgggcagtgaaccccacctttgtcagagttcaggacagtccatgggatacaggtcactccgactctcatgcatcagtcttcacgccagccctgagtgagcactgaggcacacgtgcctagcacccagcagtggccccatcccctagctgctggtcagtaccagctgccactgcagcacaccctttctgctaggcagccttatgccatgcacttgatgtgcaaatgatcttgtctaatcttcacaagcatcccgtgaggcagggattaacgttgtccccatttcacagatggggaaactgaggctcaagagttccagacccaggcaagccctggtcagtggtgaagatgccagcctggtggggctggctgcagagtgctgggccctgtcataagcacaggcctctggcacgcatgctgactgctggggattttaagattggggcccccctgctgagccctatctacagctgcccccttccctgggttaccccaggttttaatttgaagcagttagtgaattgagcttatgtggggtcttatttgtatttgcttttgggtttttgctttttgggggagtttttgggttttattgagatagagagtctcactcttttgcccaggctggagtggagtggtacaatcttggctcactgcagcctccgcctcccaggttcacgattctcatgcctcagcctctcaagtagctgggattacaggcatgcgccaccacacccagccaattttttgtatttttagtagagacagggttttgccttgttggctgggctggtctcaaactcctggcctcaagtgatctgccagcctcagcctcccaaagtgctgggattacaagcatgagccacctcgcagggccctgtatttgggtattagccatggcagcctggcagatgttgctgagggtgtctgggcacctgggcctgggcttggcggcctgagcagtgcctcctcctcaaatgtcaaattgaggcctggactaagggtgtctgatttatggcctcacctgtctgtccgtccattcagcaatatctccctgggacctcaggggcaactgtgccttcaggggcttccgggtgggcaggcagaagcagaaataagtatacaaggcagggtggtgcccaggttgtatgatgaaggaggggacgggggattttcagggcaacgacttgtgccaagatccaaggatggaagggaagagacgtacaggcaaggggaccattccaggcaggggacacaggcagagacccatccaaagatgagtgcagggcagacagtgcttgaagctggagctctctatctctcatgcttctttggtttgcaaaatgtggcatgatccagtgggggctgaggggccagggctccagggctggctgccccaggaacacagcagtgtcaccagaggtccagggtgggaaccaccagagttttagaaactcacccagccatgtccagggtgcctggagcagggaagggaggctgctacacctcactgagatgccagtgtggctgcccccggtggaaaccaaatagccaggctccctgaagctgccagcaagtctaggggcagggaggacaggtgagagctgagaggcctccaagggtcagaagtaattgcattgggttttgcgacttctcctcttgcttcttggaaatccttcctgcttctttctggattccctactgaattctgaaggttctaaaagacctggaggctgggcactatggcttatgcctgtaattccagtgggaagatcacttgaggccaggagttcaagaccagcccaggcgacatagcaagatcttgtctctataaaaaaaaaaatttttttttaattagctgggtgtggtggtattcatctgcagtcccagctaccagggagactgaggcaggaggatcacttgaacccaggagttcaaggtggcagtgagctatgatcacaccactgcactgcagcctggatgacagagcaagaccttgtcttatgaaaaataaaataaagagaacatggatgtgggttggatggtgagagcttggggctgtcctttgttcctgggtgggggaaagggactgggaccaaaggaggctgcggttgagggagacgtgtgtacctaagagatgggcagtagctaagctccaggccctcgggcaggtgcctgtggggggacagaggcactggtggccatgccacccatcctgcctgagtttcccagttctggctggtgagcaggtgtgaggctgctctctcaggaccccgttcggaggcacatctcttcctgatcccacgatgcccttcacatgcacacacatgctcacatgcacacatacacatgtgcacacaccccaccacagcccttgccagcctgggaccgccagctgctggctcctccccctgcctccccggatggacatccgtcctttgcaagggctgttcttccttcttccttcttcctgagtcctgaggtcgggcaaggcatccctcaagggagtccacaggttgggcccaccaccccgcagttcccagttcctatgccattgcctggctacctccccaacctccaccatcgtcccttcctgcctccaggtcaaggaccggagagagtccctctggcctccaagggtcctatgaggggagggtgacccagtttgtccggagctgtcccaattttggcatgggaagtcctacatcccaaaactcctcagtcccgagcaaaccaggtctcccccaagcaatgagtgagcttcctagagcagggtcccagctccaccacccatctcctctggtcccttggcctgtggtatgagaaaggggacgtgggctactccagactacactctcactgtcccccaaaggcctcaagggctccagtcttcaggccccacactggacgcctcccccatgctgccatctgggcctttatctccttcagctgtggctgttggccagcgtgaacacaaatacgtgaaccacagcccaccatgttggagccccaggtccaggcccacagtggagcccagtgaggggagagtgctcgcccatccaggaccacaggactctccccaaagcccatagcacgttgctgccctccctccatttggacactggtgtcagggactgggcccttggccctaagcccgtctgggttccctggttcactagaggccagtggagaagcccctgttggcagagcctcctccggggccctggccctaaaggccacaattccacacacctctcatgggatgtgtctgagcccaatgcccagcccggcaagaaccagccctggatgaggtccagcccctgcccctcctcctagaagtctctgcccaacctccaatcccagaagcgcattcagagtccagttctagaaggttcctcagcacctgacagcccacttcctcacgtgcacctgcacagccggggcctagcagatgagagacagcatgggcaccaccaggccccccgcagggctacctggcaagcctagcccctttgggctgaaggctgacccctgggtcccaaggataccaggtcagggggtgaaggacctttgaacccagcctcccagactcttaacctgacacctcccagatgaagccgaggccaggcacccagtgcccacagcaggctgaaggcccctcataaggctgtgattcccaagacaacacatacaaagcctggggtgctgggacagagccccaacagggtgtcagacacagatcccactgtgggatccaggcagcccccattgaccaaggtctgcaaccgcacctcacctggctgagaaggtgtaaggtgggcgggaaccgaggttcgggcgggcaggagtcacatccaaccctgcctccgctctagtcccgccccaggcaaaaccttgttggctttattgagacaggtccttggagaatcataggagtaagagtacaaagcctcaaggagaacacgttcacttcacccatggagtaatggcgaaggccagagccctccccgctccttccagatcacccttctgtcctctgcagcatcatggagtaatggtgaaggccagagccctccccgctccttccaggtcacccttcagtcctctgcagaatcatggagggatggtgaaggccagaccctccccgctccctccacatcacccttccgttctctgcagcatcactcttttaaatcttaaaattgtaaacaaaggttctctctcttcatcccacttcccctccagccacagtcccatttctcagcccccttttggtgcaaaacccttcagaagggtgtccagcccattcctcctgcttgaatcccgagggtcagcccccatgctcatgacgctcttgccaaagccaccagtgactccagctctcggccccagggaagctcccaggccttcactcgcttacctgcctctctctccagacccagctcctttatttttccctccctttccctggtcagaaccctgggcacctcctcctcatgctggggtccagccttggcccttggcccctctcctctctagccccatccactcctggtcatctcatccagggtgggagctctaaacaggacatgagtgtcaatgacaccctcacgtccagctcagaccacatgccgcaaactgcacactgcacactctgccctctctgctggcccacaggcccctcccgtggatggacctgcagggttgcctcccctcatgtcgcccccagccgcacctgaaggccccctcagttggccctctcagcccaggccccaaccagcaggaagcctgtcaggcctccttccagggaggttccaaacctgcccctcaaatccccccatgccccatccaagtccacaccacctctcatctggaccacagcagagacctcctgcactgcccctcccctcaacccctcatcagcacatcagccagaggctccttggagaacagaaggggctcagaaccctgcagcggcgtccactgcacacacaggaagaactcaagtgctcgtaggcagtgagtcatttccttaggcattgtggtgacccgggatcatgtgcctccccgaagcctgcacatgcactctaatgatgcaagctaccaccgggcggtcagctttgccagctgacgtcccaaacagctggcatggggcatgcacaca

SEQ ID NO: 11775 - DNA, 8344 bp, Human
gagatgattttcatagaaaacaggaagtcctccacagcagcagttagatgcacttgttttccttccttagcaaagctgagtaagaatacaagcccaacacccacccaaccttctgggtctcctctttgggactgccttaacatcgtgtcctcaatcatttcaaggcagcaaacctgccacattacaattcttgaattacttattcgtgaacaacttgagagcagggactgttaccttgcattgtttcctagcatagcacctggtatatagtagatgctcaataaataatgtgtttgtttaattatattgattaagaaggaaggggctctgccccataatcccattcaatcattgcaatggaaaatcctcaagaaatgtttccagattcaatcgactgttgacaaagcagtaattttttcatagaaacgaatttcttctccatcacggttagaaagggactagagaaaatcatctgacttctcctctcaggccacatagctcatatttcctacctctaatctgaaatcctgactctcagaaatgtcctaaagttacctaaggatgtgcatgagctatgagaggtttggctgaaaggcagactgcaataagtgttttttttttttccatttctatagaggaacaatagacttttaattctaaatcagaagcggtaacagccatgcctattttccctttcccctctttgacatagtggctgtttgactgctgagcaggctggggtggtaagtgctgtaagaaatcccaaattctgaatgaattgttctcaagtggatgtctgtggaagaagagcttctgcacctgggttcatcagattcagtaaggaccacaaactgttggtccctcccttaaaatgagcacatgctgattaaagtagatgttgcataaaaatgaagcacatatttttatggagaaaaggaaattcaggaagaaaatatgtttgctttcaagaatttgaagggctgttaaatggaggagacttcagacttatttagaattttaatgagatttctctgaagcacaactagaacaatgttctttataacagtttctcctttcgttctatgaaaaaaacctgtcaaatggtacaccaagtgcagagtccgttggccctagcttgcctttgcagcccagtgtctcactgaggctttctatgctccattatttgcttacttggaacttctttcagctcccccatgttttctttccttggttgcccctgcctgggtcacacagaagactaccctgtagtgtggttagtagtgcacacacaagacatctccattagagtgggagccaccagatactatgtgatataagtgacagtaagctcattgattttatattctcattgattaatgtatttatcatcattcagcaaatatttatagagtttctactatatgtgactctaactcatcttcagggcttggcctcagggttacagttctgctcatcaaaataggtgctccccagagtgctcccactgtttcatatcctggcattcatcactggtcatttcatagattattgacacatttgcaccaccctctctgctgaaatgggagttgcatgataacaaggactgagtccattacttctctgatgtctagcacaatggtcagcacacacagtcaacattgggtatcaacatatcatcattgaatagtgattgataaataaattaatgtatacataaatgcaatgagttttctgccagttgaagtatgtttgcaaagaaagggtggatccccagctgatggggatctttttaaaaagttattctttttggcattataccaaccatgctcggttgtggttgatttccttagttcacttccccattagactatgaactccttgagaacaggaagagttctatttgtctttgaaatcctacagaacaagcatacaatcagtgtttgggaagtgcacaaaatgtctattttctgagaatggattgtttatagaacaagaatgctgaggcactaaagaaaaagtggcagtaatgtaatccgcttgttttgccaagccactaaaaataccttggtaaatattagctaatgtgcagccctttgcttgctattaagatttactgatttcaatagaaaggaacctaaaaactgagcatattatataacccagacaccagggacaatctctaatcacctaagagttcataaaatacatattggctctgtctgtggttagattaaatgccattatctaaaaaaagtaggatctgtgcaataataggtctgccatgtgaatgacagttttggttagtggatgaatttatcctgtatcattgcattctctaagaataatccctctcactctgaacaaataaatcaatagcattggctaacccagtgcatgtaaaaaacaccttcagtaaatgccaggttttcccgaataataaagacttccaacaataaagacttcttttaagtctgtttcttacataactgttgtatggagagattaacatggtatcttgtttcttcctggtgtgatcttacttttgtcttgtaaatatgtacttatgtctgtatgttcacctgcatctttgtgaacccttggaaaactcagtatttcagtgggtttcagagaataggccgggagattgatgataagtaagtgtttccggccagttgttattaggcacaacttttaggagaaacaagtgagcgatagagcgtggccaaggagaggaaggcaatgctggaacccaatccacgcctgctgcccagagaccttagctgatggcttgtcatgtcttagcatgttggtattcaagccatgtgatgttggaaagaaaaaatacctattcagcttggggcttggtctgagaacaaccaattgccttggtttaaatcacacgactccactatcaaattaagtgtttccaagtttacacaaattagcgtcagtccactgactgtcgcctacaataaattaggctgagtctaaaagaaatcagtctgcatagaaagaccaacaaccagcaccacttccttgctttttccagccatgaatgcttccagtcggaatgtgtttgacacgttggtaagtggaggctggggaaatcacctctctggaaagccaggcagataatgtttcatcattaatgcagtcatggaaactcaacgttattcaagtgatcaatcagggggtacttcttcactctacagaaatcttctttacctttaaaagtaaaatgaaattaagggaggctagaggagcagggtgctgggaaaaaaactcagaagttggtgtgttaggagccatctctggaattataatgtatgacaaagagaatgtggattcaattgataaatgttggttttagaatttactatttgagctgagagtcactctctggagagctgggtaaacagtgtgaccctgaatgcacctgggagagaggtcagtccacatgggtgtagaccagggtaaaggatgtgtgtacaaggaaaggagaagaccatttccttctctgtacctcacatgcaccatcccctaatcctcactggggacttgaggtcagtgagggcagtgtgggatgagaggagggccctcttgactatgtgcattgctgtttattctcttggcagcattttctttttttatgtctttagaacctgccctcaacatttcaaatcaccacagctgtggttttctcatcaccgcttcgacttggcgttggcttcttgtgttttcagctgggttaaggccttgaacaagacactgtgggatatcactattatttaaaatgtatcactcagttggtttcgcttcctagttcttacgaataaacacatttttcaagggggattttgaaatctattttaaaaacatatttgcatttaatgaaaaataccctgaagacattgcggaccagggtgggcacaccttgatattcttgggcatgggggaggaggtaatctagcgtttatgactttgggtttcaccactgtcaggtgtttatgggacaggcccttcaccattttgctgtacaatggaagtcacagtaatgtcatctataaaaaatcaattgagcaaataggattttgaaaaatgtaattcattcactgaattatttcatttacgtttactgaataaacagtaggcactcatcaactgtgctagcaattgtgatataggaatgaataaagtatggtctgtctttatggagtattacttaaatcagtgctccccagtcctccagctttggagtagggaaggaagtgttagatgtgttgatggtggctctcatactattccttttgggaatcttgggaaaccgtggggagagagtaggaacaggcttgtagatttatggagaagccctatgagaccatctggttggatctgagctctgttctaaatagtgttcagcatttaacaaaaagaaatatgaccaatacttgtctgaaaatattttagggaagtgtgactttagaatataacatttgataactgagacacggagtggtagaagctcccctagactagaggcagggagccctatattctagttgtcatcctgccactggctaggtacatgcatttggacaagttatttaaattttctaaatctcagttttctcatttgataaatgagagaacagaattgaattaggatttttcttgatatatgagtatcaatagaagtacatagatgatttaggtagtatattgatgagtgttttattggtcagttattcatttttctatatctcaaaaacatacataatgcttcaagtttgtgatttctcagaaattattgcttaacataaggctaaacttatgagaaggtgatttaagtaatattcaataaataaaaatacaggtcataattggttattacaaacatatttaaggttgtgtgagactaattgaggtcaggaaacacttgaatatataatcacttagtttgtcttcatttctagctctctgtaattattttgcctctttatgtttgagtaacatggtcttccagtggaaagtttctatcagaaatagcattgtggtatccagaataaacttgtcagcttgccaaatgattagtaacccagataattttgaatgatcttttcgtagttaggtctttcatgtgggtcacctagttcactattgctataaacataatccttttttgtttttctttgatgtgttttcagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgcatgcactttgattattattattactatgcattaactgagtcaggttccaggtgaaaatcctcttgcagagaggaccctctcctggaaggggcgggaggagtggagaggaagcagataggacacatttgttgtctggagtcctcaggaggaaatgaccctggccacagacacaccccttccggtacagctccatcacgcctctccagtgtgagtcttggcacataaaacggcagctgcccacagttgttgggagggatggcttatgtttttccatgcctgggctgtatttgtacagatccatgcaccactctggtccttctgactaagaacagtgggaagtctgatggttttagggttgcacaccttgtcagtggccataacagtggccatagctggcccatgtggaactctcactctgtacctgtgagtgctttggcaccacaatttaatgtgctgacaggaaaaagaaatcaggtatcacaagcttgagggagctggaattctctgctggcccactgtcatgatgtagccccttcataaactggagggaaactgtgttgacacttgttcccatcagcatgcactcttcctggtgtattctcctgctggctggcagcatgcatgtagatggctggaagtgagatggtcataagcaatccattccctttgattgtttagggaggtgaacaacatacatctttctgattggtatttacttctgggttatttggtggaggcccatctgcttctaaatatccctttgctaggatcaagacactctgcacctggagtctcttttttaatggaaattcccattgaccctctagcaaccattaacacaggtacatccaattaagcccctaggaaaagaggcctggaacaggtaacttttga

SEQ ID NO: 11776 - DNA, 148156 bp, Human
  misc_feature (1)...(148156): n = A,T,C or G
gagggggaagccagaaaggtccccataggttcgtaggaccatggttggagcacgtttacagtggagcacccaagcaccaaattaggcctaaggactttcaaagtcacttctacccataggcttactagctttgtaatctggaacaaattattttacacctaaatgactgttagactagatttctttaaggtctcttggagctttaaagtattatgattcctttgagaacatttcaaaatgtgtgtgtgtgagttacaaacttaagctgcctacattacaaactgaaggtcttgctttaataatttcaactaactgataaaatcaaaggcttctttatgtgattcttctgccctactaaacataggtgtggatagtattaaatgaatctgtaaatatgagtggggatcaaacacatcacctgactaacatttttacaaagcagttcccaaaacactgaaaagttcattgcaacaaaaccaatttacgattgatgaagaggtatctcaattgtaacctttacatgcatgacatttcaatcagaatattgagttagcagtttcagactttgacttttcagacatacactcatacaaaaatacatttcatatcattattgtttaatatattatttttgtttaaaattgatagttgtcctataattttatgtctagctgaattcccaaagtagaagtactaatgtgcagagaattcatgaaaggttttaaaatgtcttacaaatgtaagattatttgaagctgtatcagcttgtaatttaaggcctgcagctgctggtatgatagaagtatcaaatttcaaaagaaattatggtagagtataaataagcagaatgaagagaaaagtctcctgagaagaaaataaaatgagaatgaagcatatgcattgttattgcattgctcctttttttcttcattttttatttcaggttcgaggggtacatgtgcaggtttgttacacagataaattgcatatcaccaggatttgatgtacaaataatttcatcgcccaggtagtaagcccagtacccgatagacagttttccgaaccccacctttctccctccctccttcctcaagcaggccccagtatctgattgttcccatctctgtgtgcatgtatactaaggcactgcttcttatattcaaggtttagtactaaaatgcaaatatgaagtatataatttagtaagttttaatcctgctgcaaaccaggtcacataaaaataatgcaaaataaaatattaaaattattcagaagttcgatatttattctgttgtctttacaccttataaaatggaatgacctaattactcttaaataaacataaagacaatttaaggtcacatttgttacattcacataatttgttaaacacaatagaaatgttagtttactagaaaagaactgtcataattttaacatgcagagtttgtttaccttctattatggtgatctttgtttaagattttctcctcagatgttaaaagtttttcacttaaagaggcttagggaaagtgatttttaaagagtcactgttacatggtaatatgccgttcatttggatgagactagtatataggtaatagtcacaagttctaacttgcatgttaatttgaagagatttttcgtaaaattgtatcaacattagtttctaatggaaaccagtcttagaagttttctgctgtttgtttgaggtaaagtttttttaagaaagttataattacattaaactatcatgctttagggtttaaatgttggaaagttggttttgtaagaagaagagtttggtttcttgtttgtttgtttgttttggtttgtttttggcatgcgaagagctgtgtcctggaattggtgcccaaaaaattttaagtgtggtatgaactgtttatgtcactgagtaaaattagacacgtctgttgctaatgtgaggggatgaaacatgagacagggcgaaactcgtgagagccctttctccagggacagttgctgaagcttcatcctttgctctcattctgtaagtcatagaaaagtttgaaacattctgtctgtggtagagctcgggccagctgtagttcattcgccagtgtgcttttcttaatatctaaggtaagtgctcagttttaacttagattttatatcagtacaaagtactacctaaaaaccaaacgcttaagaggtttcttaatattctttcttctttggtggcataataataaatttaaaataatgttgaataaattggtgtatcacaacataatgacatatcaagtatcaatgaaattctcatttcaactaagttattctgactacaaatatgctacatatttttagcataatcctatatttctaacatttttaatttgtagaatgccaaaggtagcatttctgtattattgggcattgaattggatcctgtagttaatttaaacaaagtattatctttaagatcacctacttctaattctgctcttaaactttagtggtagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgaaaagggaagaatgtttctttccctaaatctggaaaatataaaatactgctcaaaatatgtatgaaaaaataaacataagtggggtaaaagtacacatgtgctaatgcttcagcttactgaagttatgagttctttctttgcgttttctaaattaatacatgacaactagcaaacacaatttttttaaaggaaggattagaaaaaaataatacgggaaaatataactcagctgactgaaagatttgccagcagaccagtacaaaaacgaactacggaatacaccgtttgttttttgcttattttcttgcaaacattttgtaggtacaaaaaggcacctttgtggaatttaaaaagtaatgctacaagttggggttcgttttataggttctaggattcatttcagattgtctttcaaagacaaatgaaaagtagcatttcaatgtagttagatatagcattccaaagactaacaaattcaggtgtccaaaagatatcagctaagcttgcagttaaaatgcggaaaatgaaattgttccatattgtcctttaaaaaatgtacttgctagtcattaaactaagttgttattaaattgcattaaaaattaaatgataattgtaaattatagtgggttcccaatgtgttcagttttgcataacttatagggcctgaggatctccctccactccctaatctgtggctcatcacagcgcttgtgtcttctcagcttgaggcaccagggctgtggtttcccagtgggaggggagaaactacagcgtcctgaggatgactctgctactctcctgctccttcagaacccaccttgaccttcatgacaccttcctgtctctccctccctccctccccttctctcagccgctatagcacctgtctggctttattcttctccagacctactgcagggccagatagttctacgacgttctcatgaggattgcaggatccatcacttgctactttggccattttggattccagcttcatttttaattttatatgttatgctgtagatagttttatgggaacactggtacaggagtatttagtaatttgtgaatggtaaaggtctcaagacttttctcagaacctgtgaaaatctcactgcctgctcgacttcagtatgactggtgggtaggaccactgaggaatggggacaggagggcttgctgtgcccaaaggcgtttgtgcttcatcctaagcaccagtgagacctttgaacctctagaaaaggagagcagcccagtcacatgggtgctttggaaggatcactgcagttgacatggagaatggattaagggcagtggaggcggcagtgaagggtaccttaaaacctagcttcaccttcgtgacttctttaactctgtttttaaaatgctcaattaattttacttgagaaacatctctggaaagtctaacatcaatgaagaggctatgattaaaagtttaggctatggagccagactgccatttgaccttgtgtgaattacttaatttctatgtctcagtttcttcatttgtaaggtgagaggagttgcattgtagcagctaccattttaacaagtatcaaatttagtctatataaggcaattagaaagtttctgacttcttagtaaatagtagcttccatcggcatcacccatcaatgcaccctcttatcctgaccccacactgcggggaagtcaggaagacctcgggaaaatgacggtaactggtcaggaacttgaacctgcttctcacagtcccctaagaaggcgtaccagaaaggagccctaagcaggcaggagactccaggctgaggctatttctgctgtttctgtggagaacgttctctgcacgcagccatggctgctcagaaggggtgtgtgcattccaggatacaaatagccctcctggcattcccggtggctgcctgcctatccctagtggtaaggtctatgaaggaaagaaaggcaagtgactgtttacctttcccatgaaaatcttccttttcttcaacatttttgattgtaacgaaaactttatataaaatattctccctttatttttatttttttttgagacagagtctcgctctatcgcccaggctggagtgcagtggcatgatctcggctcactgcaacctcacctcccgggttcaagtgattcttctgcctcagcctccctagtagctgggattacaggcatatgccaccatgcccagctaatttttgtatttttagtagagacggagtttcaccatgttagtcaggatggtctcgatctgctgacctcgtgatccacccgcctcggcctcccaaagtgctgggattacaggcatgagccaccatgcccagcctacataaaatactctaaaatgttaatcttgctgaaacaatataagtgtgttgtctccatactggaatgcatttgaatgtttgtattttggcaacatttgaaagtcactttaaatcatcccattcatatctcagagcaaaggtgataataaggaagtgaataaatggccctgaggccatctgaaactttttaaatgaactgccaggccataggaaaaacacatatataccacgtttgataaaaaacttaagtgtacctcaagaatttctttacgcatttagaagcacagtatagttgatacattgaaataacttccttttcttaaaattttaatttaatattgtgtgaatgtttttcagagttagaatttagttatacacaatttttagggactaggcaaattgaaggtttttttttttctagagggggcagtgatagttgatttgcttaaaaattttaggcttagtataaaaatcaaaatacttataaaatagattacaggctactttatttgctgtttggttaaacacaaacttcatgtgtaattttaatttaagaatattctaaactctgttctcctttgtaaataacagcaaatttaagagtcatgtctatacaggataaatggtactgcaatgtaggctggtccccttcacagggctagtacataatgaactggtttctggatggccagtaagggggtctttttaattctctctctctccctgtctcacttctctaagaagtgtccttggcctcagcccacaccttgcccatcttcctctcctaacctagccggcttccctcattgcctggtgccttcctcttgagagcattcccttaatacaacacctgaacaagaatccgcatctcaggctgcttccagggaacctgatgtgagatagtgtcaacctaaataacaagcgagctcccaaagaaaagatgttcatttgtgaatagagcattgcagtgggactatgaggattacataattgttctgaaattattatccttggctacagagatcaataacaagagtaacaccagtatgagattgtaggcagatgtcctcgcagaagtgtttaaggttgtggtttttgcaatcttttgtgataatttttgttatcagcatacaagcataaaaaatttttctttatggccttccctggttctgtttgtcagagttttcttaacattagtgatcctgacaactttcacatagataaagttgaatggtattctgagaattccatcagcatacctgatcacaggctggagtgcaatggtgcgatcttggctcactacaccctccgccttctgggttcaagcagttctcctgcctcagtctccagagtagctgagactacaggcacctgccaccatgcctggcttatttttgtatttttagtagagacagggtttcgtcatgttggccagaatggtctcgatctcctgacctcgtgatctgctcgccttggcctcctaaagtgctgggattacaggcgtgagccactgcatccggtccccgatcacttttaaattccaatttttccaacagcaattgcttcgacaggttccctgggaaacagactccaagctggagatatgcgtgccatgtattggaacccatcttgaaaaaaagaaaaaaaatccctgtaggacagcaaaggcggcaaagtgggcagaaggagatgtcaaatagtactgtagctgccacagagctggaggcctgcagggctgttcccaaatccagagaggggccgggctttcacccagtgcactgataaaacgttggagtgtgcctctcatggggaaacacagccatgggcgaggcagcttagtgcattctgaagtcattctcgtcatcagccatcacttccacaactgaaggaaggagtgtcttggttctgaagggtgatgggcgtgacatagcacgagtccacccctcgcatcactcagatcctcttgctttgtttacctaatttgggaacagctcctccaagggtttgattgatctcttttcctgggggaacactgagggaatattaatggcaggaactagagcctccccttatgcagatggtctcatgactacagctgatacttacccatcctttttccctcccaccgccttcacctacccattcagcatttgcttcattctcatctaacaccctggctggtctgagtagccttggggtgaccctgacattcaactctgaagggtcttagccttggtcaccaacccctaaccagtcccaatgcacttgtggttcacacatggctgagcatttgctctcaaaatggccagaggaataccagcaaatgccttgctggtccgcctgggtgacaaacatattcttcccagacaattcttgtcagaatggtgcatcgtgtcctcaccagtggtatccagcctgaggaggtgaagcgattgcagcagcttgaagatgactgggactcacattgtgtcctctggtagaagcactccctgctgggagcagacttccagatccacagagcccatggtaatggggatgggaggcacatacttcccagctggcaaacatgaccacttctacgctcaccattggtttccagagggatatatcctatccactggggatggagcgccataatggtcattgattttggatgtacagaactgcattctgaagtatcccccatcctcacaggggatcgggggcctcaactgcagctttaaaagattgttctatcaccctgtcaggccagcagctgctgggaaatacagaaggtggcaagaacaggggatcccgggctcatgtacctagcgcccctctgcctttgccataaggtgggtcatttggcttgttggcatctcctatgggattccacatcagtggatcacacattctgtaagttcttggatagtgatgctggccaaggccctgcaggtagaaaagaaaaatccaccccagcctacctgttagttcccctcaagatgatgtaaccccctggccaccgagtggctgcttggtcttattgagggatgctgctgtatccaggttcagcatcagtgtctgctgtggacagtttagacattcagcaggggcagtggctggatcagccttgccaagaggaggcctagctactgggcccatgcatggcctccctccctgccaccattctgggctgctctgtatatgaccccattgtgggagccctggagtggatggtgatgggccagctgtgtcaactgggtgagccactctcgctatggtgccccttctacagtggacggcttggaggctgttaacgtggtaaaagatcttcctccttgatgcccaataggtccatccacaagcctcttcctcagacttctctgtcctccctattccaaactctccccttccacccaagccattcaccaccatccatgagaccatgtatagtctaacctcagcctcaggtgatttctgtttccacaggaagtggatacacaggtgcgctgcctgtagctttgtcagcgaggaggttttctctcaccacaatctttcagggccacccattgcagtgtggcagccggccttctgtggattgcacccacagaggcctaccaaatgtggcccgtttcctccctggaaggctggccataagggtcacccctgtgtggccaggagaggtgcattagtggtgggtgaccgggactctgggtccctcgcacatgttccctctgcctgcctcatccctggtgccccacttctgacttaacagtgattgctgctggctcctgacctgaggccttggtgcatctcacagagctcaggtcatgatgtgaaattctgtgcatgggattatgctgtcccatgaccaggtgctctgtcttccaccaacacccagtagcactcggagaagtgttttacaaatggcatatatttctctgctgcagatggcatggcctgattccaaactcctggaggcctatgctgtgattcttccactgcagcttgccataaatgccacattaccttctttccatcaaggatgcatctaaccccacaggggcaccagcaggtccagcctgcagtatgtgcagccctgatgcagagccctgttctggccacactaaagctgtcattctgtaaatgggttaatttttccaaggccagaacctgaagtggtctaagaggcatcatttttcctttacagtggtggtaagtgcaagatacaataattaattctttactttgcaggggatttccctgcatgccctagaacactagatcctaaaaaccactaagttggcaggttcagatcttggtaggatttctctctcaccgtctgaacacatcttttactaaggcttttttttttttttttttgagataagagtcttgctctgtcacccagtctggagtgcaatggagcgatctcggctcactgcaatctccacctcccgggttcaagctattctcctgcctcagtctctggagtagttgggattacaggcgcctgcctaattttttttttttttttttttttgggacaggtattcaccatgttggtcaggctggtcatgaattcctgacctcaagcaatccgcctgcctctgcctcccaaaatgctgggattataggtgtgagccaccatgcccagcctaagaaggcttttaacatatttgtcgcattcactcatctagtccggtccacatggtatcatgaagttagtggacaaatgctgttctgagaatgtccaaaatggcctagatcccttctgaggataggaatgtggcaagtaaatactgcagcctagctcatgggcctatgaagctctgcagttcctctatgtgagataaatgggaggaagatgcctgtgccagttcaatggcacacatgcctggtgccacgccaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcttcaagagaggcactaatctctgccattcttcctgggatgtggagagatgacgggcggtcatcccccgtcctctcactacacagggacaggaactccccatgtggcagttctgccagctatcaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgcatgccaccacgcctggctattttttgtatttttagtagagatggggcttcactgtgttgcccaggctggtgtcgaactcctgagctcagggaatccacctgccttggcctccaaagtgctggaattacaggcgtgagccactgcgcctggcctttttcctgaaatttttttggaaaataattttctttccctacttgtgttatttctgtagatatgaccaacatgtagtcctgtagaataacaattaaaaatagttgaggtagagatttcattgttacattatattcatgcattcagtcaacagatattggtaggatttctggacatggggactggcctcaaaaagggcttaacagagaaaactatcaccttgctttcatggaggtggggcaaatagtatgagaagatagatgcaatttgggaggatgttgaataagataagagacaagagagaaagacttgaacttaagagtaattttcttggtttcagaattagagaaataggttaaagctatcagcagaactgaactcccctaccctactccttcacccccctgcccgctccttcaggctcagagctgcacaaagtctaccttaaatagtggttatgctcaaagggaagtgtcaaaggacaactaaataattacccctttagtctcaacatagacaacttagaggtcattgatagtgtgattaaatattctgctatcaaactattttaaaagaataaaaatataaaataaacgtttaagtgtttaatacatgaggggaatcaatactgaaaataattttagtataatggctctatttaaaatatttttgtatgagtatatgtggaaagtacatgaacattatagatcaattatataataattttagtaaattggtatttgagagtcttgattgattgataatattaataatatatggcattatagagttcttctgacttgatatgagtaatgtctgtagtagtaatctccagaactttgtcaagatggatgtagtatcatcatattctgtaaatatatcatctttgaaatattaagattgcctggattccaaaaccataaattttatacatgctatgcagtaatagcaagcataatgacttctctatgctaaacattattctgggagcattgtattttccatttggagctttggggataaattttaagaaaacataggcctccagacacatatgctacctgcatatattgggggtgcatcacaattacaaagttaactggattggttatgaaagttatatgtccggccgtaataaaatggctttgtttgaaataattatagtaagtgaggcatgataacctttatgaaacttataattctcatgacattaaattcttgtaattgacccactatatttacaatccacctgttgtgaggaagacagccagcaggtacaggagtcagataaaccttaagaagtcagattcacaattgcaagcctcattcacagcatcacaggactttgaagagaactattatatcactgacgatattaggaaaatgctaataaatggccctgtaaaatcctcgtgtgttaaagagttttttgaataattgaaaactatatttggtgaaacttttctgttgataataaccttcagaaaatactgtgcaatcaaacatgccacatgtttgcaggtactttctgagtaatttgcaaatattttctggataacagaacacaaaatcaacaacagaaactttaaaaaatacatctatatatatagtctactaaaaagttacatattaaatcaagacataaatcatcttcttcatttgacatcgaaatcaatttgtatattttaaaagcagagatcagccatagtaattccagttatattttatgagccaaaataatagcatgcctttaatctgccactttgtttggaagtcttattttcagaaactatgaataaatcttctacaccatcttcccgagagctttagtaagacctcagactggagtagagttgaaggagggaatgccagtctgaagaaggaaaggaagaggagagacagcaaggagaacttcagttgtcaaggtatcgggtgcaggggtcagaaagaaacatgactccatggaccactgcttggcccaagaccagatgtcaaaaccacagagccctgctgtagagcattacaaatgtattccaccaaatgttgggatgcatcctagacctgtgctggccagcagtccccagctgtgaggagaagcccgccattttgagttgatcacttggcagagttgatcatcataaaattatccttgtagagctaaataaggtttgtctttgacattcagtctggtttataggatagcaaaagggaagtggcctcagctagtagatttgaaaagcaaaagtaggaataatgcttttcagatactaatcttccttcccgatccaacacattcatcatatgaaggtagaattttatctgacgtcaagccctaaaatacactattcaaagacagtgcttacggattaacatatatgctagaaaacagagtagcgtactcggacactgagatgtaaaaagagggaagtgtcggccgggcgcggtggctcacgcctgtaatcccagcacttaggtgggcggatcacgaggtcaggagatcgagaccatcctggctaacacggcgaaaccccgtctctactgaaaatacaaaaaataagccgggcgtggtggcgggctcctgtagtcccagctactcgggaggctgaggctgcagaatgacgtgaacccgggaagcggagtttgcagtgagccgagatcgcgccattgcactccagcctgggcgacagagtgagactgcgtcccaaaaaaaaaaaaaaaaatgaaggaagtttcagcctatgaatcatggcatatgcatcaatcatactattacagaagttaaagggtctggaagtaataatatgtaactctatcattttctccttcattcgattcttttcccagctgttcatggagtttctgttgaagttggtaggatctttatttattttattttatttattttgttttgttttattttattttatttttgagacggagtctcagagtctcactcttgttgctcaggctggagtgcaatggtgcgatctcggctcactgcaacctccacctctggagtttaaatgattcccctgcctcagcctcccgagtagccgggattacaggcgcctgccaccacgcccagctaatttttttgtatttttagtagagacggggtttcaccatgttggccaggctggtctcaaactcctgacctcaggtgatccacctgcctcagcctcccagagtgctgggattacaggcgtgagccatggcgcccggctggtagggtctttattaaagaacagttatgagagatgtatgaagtatgagtaaagatagaataatttaggtctttaattgtaatgctatatcctaaacatggaaatctatttgaccaatacattgtggatgaggatatactttattctgccttcctttaacaaatacgtataactgagctgttactatgtgccagaccctactttaggtgccagttatataataagcaaacagacacccttcctgtcttcctggaggtgagtctaatgaggaccaggcaataaaaagtaaacaaataaatgcatcattatgtcctaaaaggaactttggaggaaatgaacaggacacagttgcagattgtacaggataaaagggacaagagcaggtgtttatggaaggctgaggtcaggaggacagagtggtggccacgtggtatggaccggttttcccggcagtgggaacaacgtgtccaaagactataagataggagaaagtttattccatttgagggatggaaaggctggtgctgttgggaagggcacagtgaggtgagatggagctggagaggctggctggaccagatggagtgaagcttcatctgacatgcagtgggaagccacgagtgactttaaacagggcagcaatggtcctcttgttgggtgccatgtggagattggattaagagaggcagagtgggtggaggagaccctgaagaggctgcaccgtcagtgttggagtggagcaggggcagtgcagatggggaagccaggatgagcacagctgtcctcaggatgtggcaggcagggcttgctgatgaagtagacgtgaggtggcagagagattgtgatggcactcatgcttctgagatgatcaactgggaatggccgatgccatggactgagatgggaatagagaagagaaggggggaaattcaggaggtgaggagaaagttattgaaaattacgttactttttaacaagtgcagttcgaaataccaagtggagatgtcaaacaggcaattatcagattagagtagagagttcagagatattttaggtagaaatataaatttgggaaccatcagcctgtaaatagtatttaaagacatgataatgaataggatcaccttgaaaaattgaaggaagagaagagatggtcccagaacagttcaggcaaaatccaccatttagaggtcagagaaaaagagaagattatgaaagggcctgagaattaaagtctagaaaggtagagggtaaaattaggagaatactgattttaagaaaacaagaaaaaagtgttttcaaggaggaaatagccaaccatttcaaataaaatgaagagtgaaataaattttaaaaagtgagggaaataaaataggaaagtgaatattggatttggaagcaaggaggttatgtgatccctctgattgatattagccaaagctaaatatggcaaaataacttctggaaatacatccttctatctaaagatttgcctgttctttagaaggacctgtttggtgcagaaggaaaataggtcaaaaatagttgcaagcattccttaccatgttggtagaaggtgttcttactccatggtttaccatcataagccatcctgcctttatgcctcttgctatgtgtattatccaggactgtttcgggtgcaagtgacggaaacccaagtcgaagaagttcaagtgaagatgaaacttactaatttataaaataaattagacagtgctgaatttaggatctcaaatgatgttgttaggatttcacccctactctcacactctctccctcttctttcattcttcctgatttcttctctggcaagctctctccaagtggtggagggatgaatgttggcagtgcagtgttaggtccattaacttctgatagcagaggccagcttctctcttggagcattcatattaattctgggacaactgacactggcttgcttgtgtcccatgacttcctaatggtattcaccatgtctggattgatgacataccctgattggtcagcatgtaccacatacacacctgtgttactggacatgtgtccacatgaccgatagctggaccacaaccgtggggagctgaggagtgttctagggacagacaagaaaacagtaggtgcccactataacagtatacagaagaaaaaagtagacatcgactgtaataggacacagaagaaaacagtaggtgcccactgtaataggatactgaagtagacacagggttgcagctgagcttccaacagttcctccatatagttctttgttaacattaactcagctttcattgcagccaactactaacttaacaattagctatgtgagcactaagtcagagattgagggtaggtataaatcatgccaagagctagaggaaatttggtaccaaataacaaccggtcttggttaagaggctaggtatccataaatgctggtcttgctctattgccattctgtgtcttgtttttgctaacttgttaatgtttctggatgttggtattattctttagtcaagtactaacctaatgacaccataaaagctttagatttctgatttctgagagcatctaataaaaaccaggacagagcaatgagaagagtttgtctgaattgcctacccgtgtaaatataaaactgtgttttaaaatgagcctgtagctgaagtaaaaatcaaaacaagaccagttttataagctaacatttgtaggcctgtgggtttgagcttgtttttattttttttttcccttttagtcacttgctcgtttaaataaaggtttttgtttgtttgtttgttttgtttttttctcttttcaggtctgttagatacttaaagggcatttattctgttggtttggtgtattttgtagggaactttttaaaatggcagagtttgccattttattttaaaagtcagtcctattgtaaagaagagagaatgatttgatgatcttttaatctagatgtgtgtgtgtgtgtataataagggtattattattcgagaattatgctgattataactttggatgaaattgataattatgatccatctattttgctatatttagtgtgctgtgctgagcaatttgactaaaagataaaggagaactattcttgaaattatttggtcatcctaaatacagtaatgaagttgggatgagtatggtaaatttattaaatttactatcacaaaagaaatatatatatcaattctgtaaattgaaaaaatacaaaagaaatttgggaaatactattttaaatgaaaaaaggtggattataggaggaaattattaataattttttagtttccttacagtatttttcctatgagtatatattttaatatgtatatattctaagttttcatttaacattatatcactagaatttccctaggttgttatatgtttttcaaacatatttcacatacccaaaatactaattttgtaatactatagtaatttgatggattaattactctaattttaatccttcttcatttaatgtccagttttgccccagtacagataatggtaaattaaagatctttaggcacaaattctagtttttgtttctagttgtttcctttgggtaagttactagaattggaattactattgtttgtttgatgttcttaatacttagtgcccaatatcttttgggggggttattgttaactttcactttcttcatcagaggagcagcatgtctctttttcaaacacctggccaatattatctattatcagtttttaaatttcccttaatctttgaaaactgctgcagtgatggtgtttattggcatttctttaattcagggtgaagctgaacatttttggtatgtttattcgtcacgtgtatttctttgatgtatacgtgtattcattgcttgagttttattggatttttttctgtttttgcttggttgagattatttatattttaaggatattaaccttgtcctatctttaaggcaaatacttctcccaatttatctgccatggtgttctttgtgccacacatctcctagggcaggcacctctccactcctcctttctgaaatgttggagctctttcagaatgatgtaagttatgatgcaaacagtaaggcagaaaacacactgagaattactgccactaattaacgtgagatgagatgtttcttggaagtttaaaggaaaatagaagtaaaacccatgcagtcattcccaatactagcataacataggcagcctgaatttaaccatcccactagcttgctccttccctgccagctcacctcctggaagagcaacttgtatagactggatgcctcttagttctcacttttcattgccttattatgatctgtgtgtatgggcttgtttctagactctccattttcttttacttgtgaattatctgtcactagctcatttttttttgttactgtagcacaaagctgtatcatcacaacctgtagggtaagtcccactccttatgcattcgtgtgttcaacaagcacttactgattgcctattatgtgcacataactgatactggtcacggtcacctagtcacatcgttgtaattgacttctcacgtgggttaccttgtcatttggagggacgatgcaccatgatggtgcttgttacctagtaagaaattatctatctggatattagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtgaatctcccatgaagattagaaagatggcttactctcttatctgacagattgcatacagctgcaaagagaattagtatattggaaggtagatcttagaaaacaccacagagtgataaagctgtggaaatataaagctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatctggaaaacactaaaagtaaagaaacttttaaaagtcccaatggaaaaaaaaagacgtaacactgaaaaaagctttgtagatacgtgttgaatgaactgttgaaagcaaagtggtggaaatttgtaccagaaaaacattgaaaccaaaagtggcataccaaagtcagtatcagacagataacttcgaactattataactcattctttgagttcttagatagaattaaatgtcatttctaaaaggtctgttttgttctttctcaaactcaccttttcaaaaatcatatgatattaactcattttgggcattatccttgcatttatcatctttgtgtctcagactcttgataatggcctacccaaactaggcatgacaataaatgttggttgaaatgaagaatatcatgaagacactatgttcgattcactatattatatgctatgacaataatcacataatgtagaagacagattatctgtccttaaggtcattttgttttaaataacaaactggggatcatgaattcagaagcatatgaaagcagatatttacaccaaaacaagtatagtgcttcacatctggagccctatccattaaaggattgaaaactatacctgagagatgcattgaaaagcaatcaaaattaaatatagcatggccgggcgcggtggctcatacctataatcccagcactttgggaggctgaggtaggcagatcacgagatcaggagatcaagagcatcctggctaacatggtgaaacccagtctctattaaaaatataaaaaattagctggatgtggtggcacacacctgtaatcccagctactcaggaggctgaggcaggagaatcgcttgaacccgggaggtggaggttgtagtgagtcgtgattgtgccactgcactccagcctgggcaacaaagcgagactccatctcaaaaaaaaaaaaaaaaaatttgggaggccgaggcaggcggatcacgaggtcaggagatcgagaccatcctggctaacatggtgaaaccccgtctctactaaaaatacaaaaaattagctgggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaaattaaatatagcaccaacatactttgaaggatggttagcaggagaaataatgtaaattttaatgacaaaatttgttttaatgaacaagtctatgaaaataaattttgttcatgatacattaaaaattagaattatttatcttggaatatagattttaagttctaatatacttatttcactaattatgttttgtaaagggtttataagaagaccacaaagtgctgtgtgttattccaatgcaatttcttgctgacatgaataccactaatgcagttgcctgacctccaagtgctgaagcattgatattcttctcaagcctaatttgagtaaatacctaaaggaagctggttaaaccagatagcctctgaaagtctctcctggcaaaaatttaatatagtgtctaataaaaatgaaagccacttgtgagttgtgagaaatataaacaaatcaactttttagagaaatatttaaattgagtgtttcacctagtgatttaactcatgcttatctagagtaaaaggacttttttatgcaatgcagtgaacactggtagatggcactttcaaaacattaaagaaggctgtcataaaacgatataaaaagaattacagctggcaaacttaaaaaaaacaaagattggtaaatacagctcaaatatgggaggactagaaagcaggtcaccagcttccgaaaagcagtgtgtggtcagtattttcttccagggatgtggggtccagcttcttactcaagctgtcagcagggcaggtgggcagatgtggggggactcaagagccaaagacagcacattccccaggctccccatttttgggcaagcctcaccagactgaaggagatcttgctgagtcttcttctgagtcctaaacaactaatcacactaaacgtactctgtttatgcacaggcttcaaattaactcattataaaaagttgaggaaattctgaagtaacactcaacctattttattgcttgttgtacgcttaaataaaaaatgtctgggttggccgggcgtggtggtgcatgcctgtaatcccagcactttgggaggccgaagcgagtggattacctgaggtcaggagttcaagaccagcctggccaacatggtgaaaccccgtctctactaaaaatacaaaaattagctgggtgtggtggcatgtgcctgtaatcccagctgcttgggagaccgaggcaggagactcacttgaaaccctggaggcggaggttgcagtgagctgagatcacgccactgcagtccagcctggcaacagagcaagaatctgtttcaaaaaacaaacaaacaaacaaaaaaactgggaatttttcctttcaacatttgtatgtagttaattcagcaaatgtttattaagcacatactacatgctggctgctgctctaggggccgagggtaaaacaaaataacaaaatagttgaaaacctcaccctctcagggcttataggtggagggtgagcatttacaataaaatatgtaggtaaaatatgtagtatgcctggggagttaagtgctacagaagaaaaaatgtcagaggagcatggggagctctgtggtggtgttggtggggcctgttactgaaataggaatgatcaggaagatcgttgataagcgatctttgcacagagagttgaggggagccatgcaggcatcgggagaccttccaggtagtgggaattataactgtggagtccctgaggtggggtcacacttgggggactcctggccgagtaagaccactgttcctggagcaggaggagtcagggcgagagggactggatgaaggcagagaaccatgtccgtcggggtgagaagtttggtttttactctgagtgaaatgggaagccacgggaaggtttgttgcagaggtggggcatgagccgatgcatgttttgaaaggaccactccagcctcgatgttagaaatggactgtaggagatttagagccacaggcagggggatagtcaggtggctgttgcagtgacccaggtgaaagacgatggcagaggtgctgattggggacctaagagctggcctcataacaggattgctgtcagctctccagcaaaccacgataaaattgtcttaaatggatactgaagttttctcagtgttatgtaagggtgaacaaaagcattatctagtagacagaataatggcccccagagacattcgtgttctaataacccctggaacctgtgaagaggtcaccttacgtggaagaggaggaggctctgcaggtgtggttatgcccaggctctcgaaagggaaagaccatcctgggtaatccgggcaagcccagtgttatcacgggggtccctgtgaggggcagacagaggcatcggagccagaggagggtgtgtgatgatggaagcagaggctcgagcaaggaacgtgggcagcttctagaagctggaaaaggcaagcaacgtctcccctccaccctccagaaaaacacagccttgcccacgctttcattaagacctattttttgacctccacaactataagataaaattgtgttaagccactaggtttctgataatttgctacagcaacaataggaaactatatatataggactgggaatatgtagaaatagaaatatactcacatgtgttcttagaaaactttgctagttgtattcacctgtagcaatattgtaagtctgtgcttgcttttggttcagactccctggccacccttccccatccaattgcactctcctagtctgtcctttataggaattctggagccattatttcaaatgataagcactttggaatcaatataatagagggaagaggttgagagtgactgcgtgtccagagagggaggctgctttgaggagatggcatgtgtgctgctactgaaagatgagcaggaccagcaggggcagaccaagtccaggacaaaggtcctggggtgagaattagcctggtctgttgaagagtatctactctttgcttcagtcttgtgagcaaaggacacagtggtagtagatgaagccaaagacatcagcgaagtccggctcatatagggtcttgtgggtgatagaggcgtttggacattgtcactgtggcgaaaagccatcagaaggtttggaaaaatagagtgacaggagcttactgacattttacacattgactgctgggtggggaatggttttcaagaagggaaagaatgaaagtggacttttcagcagtgtagttacgagcattcagagtaacctaaactagtgtggtagcaatggaaatgtagagatgtagacagatttcagatatatatggaaggtagaattgataggacttgctgatatggggcttgagggaagagagaaccatcaggaatacatctggtagtttggttcgagccactggctctaatataaggaagactagaggagttcaaagaaatgagtcaatgaataatgtgcttacgaaatcattaaacatttaggggttgaataatgttggctgtcagtcctggatatttgaaaatactgtgtgatgaatagcctcattgtagataatcagaatatgtgaaaacgcctattgttaaattggaaggagatttaaagatttgttttagaccataacttatttttaataaggacaactccaaatcacccctaaaaataaatgtgtgacttttgcacaaaaaatcccagagaagagtatttatattctgattcatctttttactacatttacaatcaggaaagtcataatctccaattttagcttcatagctaaaaagtacttctgttatttgtataaagggaaaaatgaataattttttaagttttctttttttctttttcttttttttgagatggagtctcactctgtcttccagactggagtgcagtggcgcgatctctgctcactgcaacctccatctactgggttcaagcgattctcctgcctcagtctcctgaatagttgggactacaggcgcctgccaccatgcctggctaattttttgtatttttagtagagacggggtgtcaccatgttagccaggatggtctcgatctcctgacctcgtgatccgcccacctcagcctcccaaagtgctggaattacaggcgtgagccactgcgcctggctgcggattcctttttaaatttacacataccagtttgattttcctcccaattaacctttgtagaactcggtaacttgattattttaggttaatgtttcaattccaagtttaaccctgaagaattctgatagatagatacagagaatttattaacatctgaatttattaacatttgaaaatatggtcactagatttcaaacgtttatcatatataaaatattttaaatggcagattaaatatctccctgtgattgaaacacagtgacatgtttcaaaataatatttaattatctttttaaaaatcattaattttggaaatctatgactgggatgaaaaatatgttttcaggctcatagtaaatcagtattaaacaagttgcctccctcattccctctctgtctctttctctctcctctcgtgaacacactccgtggcagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagtaagtatcattattttctggtaagcatgttcttgttttgttcactgtatcacttagtctgtattgtattgataggagtttccttttgtaattaacattcatttctttgctgtctggctctgaatttcaggagcaaaatatgtatgtagcatttacgtttttcccttttccttaaacctcattgtgaactatagtgtgttggttttgtgtttttgctgtaatttttttcattagtcatctcgaaatagtgggaatattgtaatagtctttagtttgtggttgattgagtcaggattatttgctgattatttaattcagtttgtaaaatggtataaatcattttcttaatttcattaattcataaatatttaaatgacactcatttaaaaacttttttatttacagtggtaatcaagttacactttcattttttaaaaaccctatgctgatgtacagtaaaaacatcaatcctgaggaattcatattctattttaaacattcttatgttttaaagacagctacataattttgtattctttgataatattttgtgtacttttgaaaaaatgctaaatgtagaatgtcttaattttacaagatagctgcagtgagataaaaatattgcagagaacattgcaggcaggtcagtctgttgcttacatgcatctgaaggtgtgatatatgcacaggctctttcttttctttcttttctttcttttctttcttttctttctttcctttctttcctttctttctcttctttcccttcattcccttctttcccttctttctcctctttctctctttctttctttcctttttttttttttttttgagacggagtctcactctgttgcccaggctggagtgcagtggtgcaatcttggctcactgcaacctccacctctgcacaggctctttctgagagcaatgcttgaagtcattcattctgaaacaccttctattattcttcttcttcactttctatgcaactgtttctatcccactatagttctagccagtagatacattatttattttattgacatcataaataaatatttatgtttttacatatgcaaagaggtaaaataccaatcaaatcaaaatatagtttgaaatggtgttagcatatttgatatattaatatgaatgtaatcaatatagatatatgatataagctgttaaattacatatattataaatacatgaacaattatataaatatattcaaattaatccaatttaaattgtgatttcttagttaaaattcataaaatcactatttctacagcatcacaatagtacttagttccactggacaatgttacttcatgaaagtagcacaactaacaggatgcatgtttttgcacatcatatacattttagtatctaaatgtaaaatactctaacattttttggagagtgaagcagtgttaaagtcctcaaattataaactatgggatttgccagagacaactgaatagagagccctgcatcagcctgctgtaggaccgtcagttatgcagaaggttaagagaggcagtgtcctgggtaggaggcccatggaagggcctgggagtgacgagaagcccagcacgtgctgaacaaggacagactttatctggaatgaatgatgtgcattatttatgaaatatgggtgaattaattttgtaaacggtttgactgtaaagtgacaatatgtctactttatactcttgtcatgtagcatgtaaaacaactttgaggtattataaatttggattaaattaagttgtgccagcagctgagtccatttcactgatggagaagggcttcccacagagatcagcacagcctttccggccatcactgcagctgcccatcccctgccctttctagtgagatatggtcattgagcatggcatttgcttcagttaggaacctgttgctaattggtagcgagtattcaggattctttagtgctgtctttaacaaaataagaaaaactaccactaacatttatggaatcaaaaggcaagatacccaaagtcactaagctacagaaaatgccaggccttaattggaagatgctggttagactttgggtcattattctcaatgtggaatgacataaatgacgtaattaccttaggtgcatgagtttgatttcttacttttgtaattatcctatatgttttgaaacagtaaattgtaaattaacgtatgctttaattcttactgatttgaaagattttaaaatacaagatttcatgttttatttattttaaattttatttcaagaacaattaacacaagatctgccctcttaacagattttaattgtacaatacgatatcattaacaataggtacaatgttgtacagcagctctctggaacttactcatcctgcttgattgaaatgtgaagtccattgtttaatagcacccattctcacttcctcagctcctggtaaccaccattccactctttgttcaatgagtttgcctactgtagatacctcatataaatggaagcatgcaatatttgtccttttgtgcttatttcactttgcataatgtcctcaaggtttatccatgttgtctcacattgcagaatttttttcttgtttaaggttgaataatattctacggtattgatatacattttctttattcatttgttgtctgtagacatttaggtttttttccacatcttgattgactactataaatagtgctacaatgaacatgaaagtgcagatatctcttccagttcctgatttccattcttttggataaacaacaaactatctgaaaaggaaattaggaaaacaatgccattttcaataacatcaaaaagaatgcaatatctagaaataaacttaactaagaagattaaagacttatacagtgacaactataaaataactgatgaaaaaattaaagacacaaacaaatgagaagacctcccatgttcatcaattgcaagacttagtattaataaaatgtacattgtaccaaaagtgatctgtagattcagtgcaattcccatcaaaattccaatgttatattttttacagaaatagaaaacacaatccaaaaattcatgtggaaccacaaaagacctgaaacagccaaatcagtcttgagaaagaaaaacaacgctagaggcgtcatgcttcctgattttgaaatatatttcaaagctatcgtaatttaaacagtatggtactggcataaagaaaggcatatagaccactggaacagaatagagatcccagaaaaaaatccatgcatgtgtgatcaactggtctttgacaagggtgctaagagtatcaaattaggaaaagatagtctgttcaacagatggtgctgggaaaactggattttcacatgcaaaagaatgaatttggacccttatcttaaaccatacataaaaatgaatgcaaaatggattaaagatttaaacataaggcctaaaactgtaaaacttctagaagaaaacatttggggaaaagcttcatgacatggatcttggcaatgatttcttgaatatcaaaagcacaggcaaccaaagcaaaaatagacaaatgggactacattatactaaaaagcctctctgcagcaaagaaaataatcagcagagtgaaaaggcaacccatgaaatgggagaagatatttgcaaactatataactgataaggggttaatttccaaaatatataaggaactcctataactcaagagcaaaaagacaaataacctgattaaaaatggacaaaacatcagaacagacatttctccaaagaagacatacaatggccaaagtgttcagcatcactaattatcagggaaacgcaaatcaaaaccactataagctactacctcacacctgtcaagatggctattatcaaaaaacaaaagacaacaaatactggcgagggtgtggtgaaattggaaccctcgtgcactgttgataagaatgcaaaatggtgcagccactatggaaaacagtatggaaattcctttaaaaattaaaaatcaaacttccttatgatccaacaattccacttttaggtatttatccaaaagaatggaaaccaatttctttttattattttcatatataaaccaatgtattttcttgaacattaacatcccaaagaagtaatacgtctataaaagaacttttttgagccctttgatgctgaaatggtaaagttaaatagggctttgagcatttgtagagatctgcatagttttgaacttgtaacaactaccatataattatttacccaaactcagtgtaattgcttttctatcatgcattcagttgttagtcagaatatagggaaaaccataatttttcaaattaacaaagtttggcatggctttctctgctcagatcctcaacagtgtagcaatggcatctttattattttacatgtactgtcattgcaacacctcatcatactttaatgtttcactgtagaaaacagtaaaactaactacaaatgatatattcaaaaatgcccagataacattagacgagaaagccagtaaaacatcacaagatgaacgcataaggacaccaaagaatattaaaaatttaaaagagagaagactagagcaaaatgttgacaaagagaataaatctgaattcagataaggctgagcctggttttatctgcccagctggggttagaaagagcccaaattactagtatctcacaaatccaattctactcttagaattaaaacttgatgtaagataaattttcacaatttccaggaaagacatctgttgaatataatatttaggacattgtaacaactgatgctgagtataaagattctaaaatattccgttagccatcataatagttaaatcagtcaggaacacggttattaaatcagtgtagtagagtaccttattatgctttttccttattatattttcattctataaaaatactatgcaatattagtttagttatagtgttcatgagtatagaataatatacatgggtcatatctgtatgttaaaataagacatctttaatttttaatgatattgattttttagaagacctttagagttatcaacctttgtttgcatataaaatattttagtgcatttagtgaatgtaactttaggttatcatgaaggtaagatgaatgattctaagctaactatattaactctagtagttaaatcttgggggcacttttatttgggaaaaaagatataagtgatcaaggaagaatcataatactaaatgttatcattaagcttataattctataaaatacttcgttgataagtattgtttgttttaatttattgtggtaataagttacattgccctttttaggaggtcaggaaaccctggtagatctatccttaacaaggatttaaaattaattcattttggaaactagcaattaggaattctccattaaggactttcccattaagaatctttcatttagcaagaaagtaaacccttgctagacagcctttgtagatatttccttagataaatgttttgtcattaaacaattagtgattattcataggaagctgggaaaatgttattagatggcattttagtgacatttatttcagccttatattaacataatcatttgaaaaggatttttaaaacttaggaaagaatgcagatatgcaagtgaccacaggctgtctgtgaatgcacagtggtcatggagggttattaaaatatcacccttgtagtggtattttctgaaatcccatttgcattttatagactctcaacactgtaaaataggctttgtgttagatgattttgcccaactgtaggttgatgtaagggttctgagcatatttaaggtgggctaaaccaagctatgcattagatgggtgaggtgtattaaatgcattttcagctctcttcataaatcaaaaagcatctatattgtttaactgctgtgttttgtcattaagcagttagtgatcattcattggaaatttgttacacagaaatagaaaactagtacaatgttactacactatgtgaagtgtttaatttctcttgctggatattgacaaaaacaaagcaaagagaaaaactctaaaattacctaaataaacgtacctgatgacccatactcttgaccatttattaacagagaaatggttagcttttaatcttttattactggatattgatatatattttaaataactagggaagcagcaataagataacatttagcctaatctaatcatgtatgttttaaccacttcctactgggaaattatttgtttatgaagtaaattattcttttttgaaatattttgaaatgaaattattttttcattttaacagcaaaaatgttctttgatgcattaatatgagtgatcattttagctcatcataattgaggaaatcagtgtatatattgatgtagtatttattgtgaaaaaagattgtgtttaaaagactgtcttttttatttttgtgacttaccatttagtatataatagatttcacggctgggcgcggtggctcattcctgtaatcccagcactttgggagactgaggcgggcaaatcacaaggtcaggagatcaagaccatcctggttaacacagtgaaaccctgtctctactaaaaatacaaaacattagccgggcgtggtggcgggcgcctgtagtcccagctactcgggaggctgaagcaagagaatgcggtgaacccgggaggcggagcttgcagtgagccgagatcatgccattgcactccagcctgggcgacagagcaagaccccgtctcaaaaaataaaaaataaatagatttcacaatccattcatgcctgctaactcagtttatcctcataatgatcccatgagtttgagattgacaggcatcagctttatgtatcgttatttcagtgatttcaaagctaagtgtatcttagcagatatcaggatccatgaagatcaggaaaaccaactcagaaggtggtacgatgaaggcagtacacagacttgttgtccttgaaccatgtccgaaaaaagtccttttggggtttcatgggacccaataaatacaaatttttccccatccaaattcaaacccaactgaaaggaacaaaaagaaatctggtagggatagcttaaaataccatctgtattactgataaaaagctgattggagggtactggcttggatttggccaaacgtcttgcaccccagaattagaaagatgacccatcaagtcacaggcagcatggaaaattgccgatgcctgctgcgaggcaaggacttgatattgtgacattcttcctggtgggattgcctatacccacagcagaccagaaatccgtgggtaagtagatccctggggaaggaggagaggagccagaagcctgtgcttctcctaactttccagccacacacatcactctcctgcggtgcagagaagggcagagtgtttctctcaggaaaggtccctcctgcatccaccacttaagtaatctcatgttgatttttcagtctgccagagtgaggatataagtcagaaaccggggagagggggtagaaaagtggagaggagagcttgaccccccctttcaccatagagaccaagtgattaatcattattcccacttacctgcacatcacttctggctgtttcaaagttctgcctgtgggaattgggaagacgaaatgccttcactgtatttatctgattttacttattattgaaaatccatgagtggatccattcctattgcactgaaaaacaaaagaaacaccagcttcttgaccgcaggctgggcacagttacctctgcagtcttgttctaaactgccctcctgttgctcattggctttcaatcctgcagacagttctctcttgcttcagtgttttggtatatgctcttctctctatctagagcatccactccaacccaggcacacacgtacagtcacatcattatggtttggatctgtgtccccacccaatctcctgttgaattgtaatacctagtgttgaggtgcagcctggtgggaggtgattggatcatgggggcaggtccttcatgaatggcttggcaccatccccttggtgctgttgtcctgatagagttatcatgagatctggttggttgagtgtgtagcatctcccctctctctcttgctcctgctcctaccatgtaagacgtgcttgctagggctttgccttccaccatgattataagtttcttgaggcctccccagaagccaagcagaaaccactatgcttcctgtgcagcctgtagaaccatgagccagttaaacctcttctttgtgattgacccagtctttggcatttcgttgtagcaatgcgagaatggactaatacagggtctcagctcaaaatgatactttcttgctgaggttatcttgatcacctctggtctaagacaggatcctcctacattctcttttgtaagactcggacttatttttcccagcatagcacaccacaattttctggttgttaaatgtctgctaaccccgtaggatcatgtcagttgagcctggtagcataaaacttatgctctgtaagtatttcttgagttgataaataagagattaaatgaccaagggatgtattctttttatttcaatatagttgttgttatatgattttagcaaatgagtatagaaagaggcaaagtaacctagaaaaagcacagatgcttaaaaattagtagaagaataactgaacccctcaaaggcaaattagacaggatgtgaaagcatgggcatgatatgagggagtgagaagagaggctccagttaacttgggaaggctcttagaaatggatactgctaagctgcttcccaagagaggctggtggattgggtctggggaggggctccagctaagtccgtgttgcagagcaggtttggtttgcagacactgcaaactttagggtcatctaaagtttaaattacactcagggaatacagcatgagtagcaggagtccttgactcggatttcacattctttcccatattatctcctttgtaatgttttttgctgacagtgttgatgtgatatagatagaggcattccatttcttaactggtgaaagggaagcaaaaggagtatgcctgaatgaaatcatacaacacacggaaactttctgtacggagctgtcagttttattaccctatctctgcagtggtctcactggcaaagtacccatatctttgcagtggtttcactggcaaataattagggttgcaatttataggattaattaatttaagaaaagacaacagggggcgtggtgactcatgcctgtaataccagctctttgggaggacaaggcaggcagattacttgaggccaagaattcagaccagcctggcctacatggcaaaaccccatctctactaaaaatataaaaatataaaaattagctgggcgtggtggcacgtgcctgtgatctcagctacttgggtggctgaggcaggagaatcacttgaacccagaaagtaggggttgcagtgagcccagatggctccacagcactccagcctgggtgacagagtgagactccgtttcaaaaataaataagaaaagatgacaatgtaaactactaaaattatattgtatctgtccttgatcatttactgaacttaaagagatcaaatttatccaaaaccaaaatgacttctactaaaatgctttctgggagcgtgttatgaacacactttacaaatatattttataaataacatcagattggacagattttatttttttaaaaaacttactgtgatagttatttgaacaaaagactgtctatcatatttttagtgactagtgctatagtgtatcttaagatatctttgttccccattccactttgcttgccttcattgagaggctggcaggtgcccctaaggcagctgcatgcagccacctgtaggctaccgaggctcagcctagcggtggttttgctctgctccctggggctggcttctgtgtgcttcctaaggaagggcagtgtggcctcagctgcaggaaggcctctaacaaacttggccatgaaaggaactctctgaaactgacccagttgttccatagatagttttttggataaacagaaattgacccttctggtcttaaagcttgaaacttacatttgttttatctgagttcctttctcaggaaagggccttcagacctctcaaagtatcaaagaactgaaacttaccaggtcaccacatccagacaataaaatgcctgaccccacgttcatcatggttgcttccttgtcccatcctagttcctgttttcctacacattgttaaatttcttccctgctataaaaacccctagttttagttgatcagagagattaatttgagactgagctcccatctcccagactgcagcacccaattaaagccttcttccttgtcacttcagtcattggctttctgtgcagcaaacagcaggacctaaaccaaacccctgctgtttcagtaacatctccccagggaaagcaatatgtgggaaggaagagcagtgcagtattatctggcacataaacaaaggaagacacatcaacttctttgctctgcctatttgacattcttggtggctccatttagaaacattttaccactggtcttccaactgcctttctctgcactgtgctggtggcagagatgtgtctggtgcccagaccaaccctatcccctgctgttctcctccatccctgccttaatgatgcccggctcacactgccatttgattttcagcagtgtgatattgatgccttaaaccacctgcatctccatcccatttgtttttcaaatgaatggaactatgattaaaagaaaaatacaacgctgtagcatttttaaccagtaccctggcattttctcaaattatttatgtctttctaaaaggtattatatcagtgctttccagtccaaaaatcattagaagacaagatattattaggactgagtttggaggaggaagataaacctaaagctattccaagtacagaggaatttcattatcatggacatcagtgatacaaatcccattattatcggtgtctaaagatacaaatagcactatagttttaatttttatcccagggatatgccttcaattttctcttttattataatttttatgagtgatttaaccatattacagcaattgggaaataaagaaggcaacagcacacttggtctcctaagcttcaggctcttgctgcaaggagggacgttcatcagcctgaactggaactgcagctcactttcctgtcacagggaatattcttataacaaaattaatgggctccagatgcagatctattcactttcttcccatttctaccaataatatgaaactgttaatgtcttctggtaacatagtttttttctcacaaatgctaataaagataatatcttgaaattacaaaccaactaatcttatttacttgattaggttttatttagaaaagcctactttgagatactgtaaaaatagtgaaaagaatattagcttaggattcagactgggtaagggtctcggttttaattaggattatgttcaatctgtgattctcccatagcacacacacactcagagaacaagaaccattagtgattacttattttaattaaatgctcagtttaagcctggcacaaaattatgaaatcctttggcgaaagttattctttatttctatttttagtataacatgaaaaagtacctgctaccctgttaaacttctcattataaaaataatgtgaaaagttacactcagacaaaaaccaccaccccattggtacaatatggaaatagggatcccagcatggatgatttagtaggtgttaatagagtaagctgagagttaaaaaaaaaaaaactaaaacaaagacatattttgtggatagtagccatcatcatatagcaataagatgtaggctatacataacggccaaatgtggaagaccaatttgagatgttcagtagcttacaagactatgtgcacaaaatgtgaaataacagaatttcaaagatgacagtactcagaaaacgagatatgtaaaagaggataattatctaccttttcttagcaatgaaacatattagaatcttgaacatgtttctccagagtaatctctccatgacagaattatcatggacattccactaaatacctaaaactctctcaagatgcacccttccagcttgacctagtgcaaatctcacgtcttctgagaggcattctccaaattctccaatactctttattcaagtcccattcagaacccctgaatttgtctatactacgggtgtatctatttatgtcagaggaattcaggggccaatagaacactatacttttttgaatcctgagccatatcacagtgccatatgtataatttggtacccaataaatattttatgattcaaaaaaagtgtaaatatgaaagataactttcacaggtgtatgtgtatatgaagttagcaatgaccaagaaggaatgacacaaatttattactagattgataacaaaaaattactgaagggtttgcagacaggttgatggatccaatataactgtaaaaatttattagtctattattttgttaacagaatatgatatttaatggaccatgatattccctcacaaatttttccatctctttgcaaatgcacttgagtaaactgttgtataaaatatgtattttcttaaagttgttgctttccaaaatttgctgagaggtatatatacattgttgtctaacattgacttttctttgtatgtaaaatgtccaggttagtagcaaaagcatcagtacagttgatgatacaactgtaatatagttctctgttgttaattacataaaatgatgtggactaattgattgattgtacacttacgccagtcatcctgacactcttaatttaatcttaaagtatattctgtttgattatctggtctgggttccaccacactgttcataatatattgagaagcacattcagctatgtggaaatgtgtttttaattcctgggtagtcataaatgacaattataatgatgagcatgatgataatgatgatgataacctttgtgtggtgtgttagaatgtgggaagtaccaccactccgggtatataaatactctttacaatgcctccttttccaaattaagagactactgttccaaatatttcatatgaggagaggttctaatttgatttttatcctcaaatagtttcctgaacacagtttattgaataactatgtttcctattagttattatgcatttgttatcatactataagctcttatgaatagagactgtttcagagctacatgttgtatctacctttctgttgcctcttttgctagtgttttagaacccaacatttccaattataataaatttatcattgttttcatatatatatgccagtcccccgattaatttttgcctttacagtctattatgaaaattttcaaatgcatattttaaaaacacgaattcttcatgaagttgtgtgtcatccttataaggcgccacgtcaatcttttctgattttccagttgtatcatctgtactgctaaatgaacataacatctgagaattcctgagtcttttctgtcccgtgattctcttcttgtgtctggagttgttgtcctatggtagctgctctcctgcatcttttaatcagctgtactttacaagacatgaaagtaggcttgtctatttttattatttttactagcatctagtatactgctaccatgtaataggtactcaacaaatacaggtacacttcaactgaaatgtcagaaattaaatgcttttactgagatcgcacaaccagaaaatgagagttaggatttatatccattccatttgattcaaaaatcaaccctactcaatggccctatatgagatgtcataaatggtggtagtgagaataagtagctgatgagtatacttccctaacatgatacaaaatatttacaacaaaccagcagccaagaacatactaccagaagcccacaggcattcccactgaagccaagaacaagaaaagtatgtctgatatcactactgtaatttggcatttttctgaaagtttgacaaatgcaacaacagagttaaataaggaatagaagtagattaatggaagatgatttgagaaaaaaacttgcaagtaattttagtgttaccttatgcaacccagagaattaaaggaaaactattgaaacaaataaaaagtttataatatatgtatttagtaagaaaacatgttagtgttcattatacatctatattttggtctcaactagctagaaaatgggctagaagaaaaatcacacatcatactggaagatatatgtaagttctttataaaactacaataattcaacccttatggcatataaacaccaaatataccactggaacataaagagatttcagaaagagttggtggggatataaactggtacattcagtagagttacaatttgttcacttttctgaagatgttatgcttcactaacataaatgtaaaataaactgtaacactaaaattatttaagttgtttattaaggtagtaatgataaatattaaattcataaacttaaaaaataaaatttgttgggaaagggtagtaaactcaacatattgttaatttaaaaatcaatatcagagagtgaccaatatttctgcacacactcaaatataactgctgattgaacagagattggacatgccatacttacttgtgttcatttccttccatgacaggtattgtgctgcttttattgtattaatacaaatagaccaaggcatttgaatgatggttgatagggacaaccttactttgttgaaataagtatatccatttgagtataggaaaaactcaggaaaattattgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaaaagcatagttttttttaacaaatactacatatataatatttatatgctatatatttttatgggttgtttttttttcttgagatggagtcttgatctgtcgcccaggctggagtgcagtggcacgatctcagctcactgcaagctctgcctcctgggttcacgccattctcttgcctcagcctcccgagtagctgggactacaggtgcctgccacctcgcctggctaactttttgtatttttagtagagatggggtttcatcgtgttagccaggatggtctcgatctcctgacctcctgatacgcctgccttggcctcccaaagtgctgggattacaggcgtgagccaccacgcccggccataggttttttattagctttttatcctaaatgatttgggatcatttctagaattacttttaatgtctaaatagaggtattcatatttatcagaaaacaagttttccagcaagtgggatttcaggggattttgtttatttatagctgcggtagtattaaaggaatttttcttcctctagaagaggaggatattttttaggtttattttattttgcatagcagggtgactatagtaataacatattgtatattttaaaatagctgagaggattttaaatgttctcacaacaaagaaataaatattttagataatggatatgttcattaatctgatttgatcattttataatgtatacatgatgtatcaccatatccctttaaaccccataaacatacacaattattattttttttttttgagatggagtctggctctgtctgataactaacttttactgaaactaggtttacatttcttttccttttttttttttttttttttttgagacggagtctcgctctgtcgcccaggctggatggagtgcagtggcgccatctcggctcactgcaagctccgccttctgggttcacgccattctcctgcctcagcctcccaagtagtgggactgcaaggtgcctgccaccacgcccggtcaattttttttttctgtatttttagtagagacatggtttcaccatgttagccaggatggtccggatctcctgacctcgtgatctgcccacctcggcctcccaaagtgctgcaattacagggctgagctaccgcgccaggccaatatttaccaattaaaaataaaagaatatggctgggcgcagtggctcacgtctgtaatcccagcactttgggaggccgaggcaggcagatcacctgaggtcgggagtttgagaccagcctgatcaacatggagaaacccgtctctactaaaaatacagaattagccgggcgtgtggtgcatgcctgtaatcccagctacttgagaggttaaggaaggagaattgcctgagccagggaggaggaggttgcgatgagccgaaatcgcaccattgcgctccagcctgggcaacgagcgaaactccatcccaaaataaataagtaaataaacaaaaaaataaacacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaccctttcttatgcttaaccaacaagaaaattcatgtccagtcttctgcatgattcagaataaacaaaaggtcaaaatctcacaaaatattgaaattgctatggaaaggggagtgagttagtctctttgtgagtattagaagatagataagccaaatcaatcactgactattttcagaatccatctttatagaaaatatgctttaaccttcccgctaaatcctaggaattccctgtctgcatatatgagcaaccaggatcactgtaacattgagaggaaattttataaaaatcgtatcattgaaggagaaaattatgttattcatctacagcaatgttttaggatgtagtcagatttaaaatgtgtaagcattcatgcatgcaatcattattccttttacaaggaaaagaattttataaactgcaacttaggtctgatgcctaaaattgttactaacatcctagcaagaaatgaaagtttagaaaactaccagaagtgactaaaaacacgaaaccctgaagtaagaaaagaatagttgttaggataattaaagataaagaaaatgggtttgatataattatatgttacctaggaattgttggtgtgaagttatgaaagcacaagttaaaagtttttttgaattagaactatataacacaaactaaaatgcagagtcacttactatacactatttatcatcttaggcctgtgaattctgaagcaatgccaattattaacctattaattttaaaaaatatatactgagcacctaatataagcactgtgctgtctatggtggatcttagagctgccagggccattcagtcattgaacacagttttcttaggttctatgatgtataaggcacagtgctaagcgctacaaatacaaatactatttacaaagcccattgtggaatagaagtttacatacatgtggcacaatgtggtgaggcttatatgagagataggctcaaacctttgtagggatcctatgagggactcaaaatggtttaaggaggttaggaaaggctgcacacaggacttagatgatttgaggatgctgtatacagaaaacaagaggttgctgagtgagaagtttcctgtggctaaaagagttcaacaaaggacaggggaacctgtggaaatagtcagggaccagatgtaagaactatgtatgccctagtacccattcatatattatcctgtgcactgactgaaagccatcggagacttttaaagagggaaataacttgttcgattagttttcagggaaatgatttagggagcactaaggagggatcgctgatgtggaaggtgataagtttgagtatctatcatgtattaagtgttgttaaattaagtttagcctaaatctgcctccttgtagttttggcctagatgtttccccatatatcagatttttggatactctttcttatgaagggccgtcgattgtctatctgttgtcttatatttttgaaggagtatgctatatattcagaatgctagtcttaggtacacgtattgcaacatcttcttccactctgtggattgtctcattactctattaaatgtgtcctttgacaaagtgatgttcttaaaatggttttctgtgccctctttaagaaatgtttgccttcttcacagacatgcagatgttctttgtccttttctaaaagtttatttttacatttctatgtgcaatccatattgaattaatttttatgtatgatgtgagattatgattcatttatttccatataggtatctaattcaatcagcacttttttttacaaaaatgttctttcccccttctgattaagaagagcattttttggccaggcgcagtggctcatgcctgtaattctagcacttagggaggctgaggtgggcagatcacttgagaccaggagtttgagaccaccctggccaacatggtgaaaccctgtctctactaaaaatacaaaaaattagccaggcgtagatggcgtgtgcctgtagtctcagctactcaggaagctgaggcataagactcgcttgaacccaggaggtggaggctgcagtgggctgagatcatgccactgcactccagcctgggtgacagagcaacagtctgtttctaaataaatagaaagaaaagcatttcttatactttgaaacttccatgggcattttttatattattatctcttttttaaaaggtatatgttcttcctattttttatgactaactccttattcagaatgggcttctcaacattttgggggcccagaataagagtacaaataggctgggcacagtggctcacgcctgtaatcccagcactttgggaggccaaggtgggcagatcacgaggtcaggagatcgagaccatcctggctaacacggtgaaaccctgtctctattaaaaatacaaaaaactagcggggtgtggtggcgggcgcctgtagttccagctactctggaggctgaggcaggagaatggcatgaacctggaaggcggagcttgcagtgagctgagatcatgccactgactccagcctgggcgacagagtcagactctgtcacaaaaaaaaaaaaaaaaaaaaaagagtacaaatagaggcccatattttatgcccctacattctccacctatagatgaaataatttaaagcattcagactaataatgactgataaattaggttgatatttgaaaaattaattttacattattacttttgttccctgccaatgactttaaattatcacaaatgcattaagttaaaaagaataaaattttaaagattagttcaacagtgaaaatgtatatattagattctattattttaaagaaattacttgttaatagaaaaatagtcacgtttcagataataggaaaaacatagaaatttccatttttggtctttagagcattgacatagcttatggttttgcctcacatattttgttgccacttaaagataggaggggctgggcgtggtggctcatgcctgtaatcccagccagcactttgggaggctgaggagggcagatcatgaggtcaggagttcgagaccagcctgaccaacatggtgaacccccgtctctactaaaaatacaaaaattagccaggtgtggtggtgcgtgcctgtaatcccagctactcaggaggctgaggcaagagaatcgcttgaacccgggaggtagaggttgcagtgagctgagatcacgccattgcatgccagcctgggcaacaaagcaagactccatctcaaaaaaaaagataagagggagattcaatcaaaggtgttgtggatctaacttttgtttaggtcaggcatgtatgtgtcatgctggtatctaataggacattttagtggtttccattttctatgtatgtgactggaacagtaggaagcctgcatgatggtaacagatcctgctgtttctgagtcagtctatacagattgaagtagcttcaatcaggtaattttcaattgtatttgattttgttgtaattacaaaacccgaaaatcccaatattttctgaggttttactccaacatatgtgttagttgaagagccactctaataaggtgaaactacaggctcctcccattccacactgttctctacattatagtatacacatctactacagttcttattattctttctttctcctgccgaagtatgaatgcctccagatggggatctagtctaatacagtagaattcaacaagcatttatgatgttccaggcacagcgctagacacgcataatacagagaggagggggcaagtgctggtggaatgggcccccagcacagagcacaatatgtgaaatgtttggaaaaattagatctcatttatctttacttctagcccagagtgagcctacactacatgggcaaatgcatcagaatggaaatctcccaccaaccccaaattccaaccccaaacagggcacacatacacacacacacacaccccacaccagtgcaagcactgctaactagcgagtacattttttcctactaagccaggcacaggccatagaaaattctcacacaacactcaaggttttcaaccctagctacacaatagaattacctggaagcttcataaattcccaatgcccagatcatacaatagagtaatttcatctcaacctccgagagtagggcccaggtgtctgattcttacagctctccaggtgcttccaacgtgcagtcaaggttctgaaccattgctatgctcttgccagtgagcacggtccctggagcagtagcagcacccactacgagctcatgagaaatgtacaatctcagttcccaccccagatccactgaatcagtgtctgcacttcaactagatcccagctggtgtaaatactcatggaagtttgacaagaacctcagcaccttccaccacctcatcctcagtgagtgagtgttggtaggttgaatggtgattccccaaggatgtccacatcctaacacccaaagtccacatcctaacacccaaatgttaccttccatggccgaagggactttgcagatgtgattacattaagggtcctgaaattgaaacattattttgtattattcatcactttcaccagctgattaaagggccaggcttcactgtaaaattatgagtttcccacttataattatttcgtgaggaggtagtttgaaactacttaagtgtcttgttcttcatgcacctttcaatttattcattaatttatgcacatccacttggactcataatttccaattttatccaatgggctctcatagtcttttactgacatttattttgatgctcaaactttctctgatttggcttgtgggagcccttctgagcaggcttttctgtcatttcactgtccataacactctttgagcccttcctttctgacacaagatcttccatgctcacctcgtcctttccttactccagccctggaattagctgtttctccaaggagctcttgctccttttagtggagaatgagtccagagccagatatgctcactgctcttgtgattctgctcccaggccctctgagaggacatgtcatacacacacacacacacacacacacacacccctacatacatcaacatttatttctgtgcctatctatatatgtatagaaaatggtgagttcagacaaatttcaatttctgttcaatatcacagggtttaacctggttttctccctttctatgtttgtacctcccttcccctacaatgaggagcttggctcccattgttcattcatttacttattcagtcaatcccattcatgtttccattctcctacctctgccacaccctctccttcaggcagatgcccttcctgttccacttgtgctccaacaccccgcactgggggatttcagtgctgggcagtgggggttctactcacccagtgattacagtgactataaacatcaaactattactacaagacattatcaatttgcatttttaaaaagatcgtctattatgctgcttataagagacagttaaaagaaaataactgaaacagtttgcaaataaaagaaaaagcatataccaaatcaatactgactaaatgaaagctgatatgaaaaaaaattaaaatcacttataatgtcaccaagagacataaaataattatgcaaaaaccaagaaaaatatatctgtatgtattataactgtataatatctgtaggctgagagcaaaaaaaaaacactgatgaaagacatcttaaattaaataaatggaaaaatagacagtgttcatgcactggaatacttgatattaagatgtcaattcttcccaagctgacacttgtgttcaacacaatgccaattgaaatcccagcacaaatgtttgtagaatcaacaagcttatttaaaaacttatatttaaaggcaaaggaactagaataaggtgaaataagtggaaaaggacaaatatttcagattccacttacacgaggtgcctagagtagtcaaattcatagagacagaaagtagaatgttggttaccaggggctgggggcaggaggaaatgcaaagtgttcagtgggtaccgagttgcagtttaggaagatgaaaagagttctggaaggggtgatggttgtacaacaaaaaagaaaactgagctgtcaacaaaaaggaaaacaaggagggttcagcaagtcaatttgaggatatttttccttttatatgtgggaagctgtcccggaatgaggcagctggcaaattttaggacaatgaatcatgtcagtttttctttttatcttcacagtgcattgtttttctacctgcttgtcttatttttagaataatgtagaaaaagaaaatggaggctctttttcctaattttggcatgaatcccccttgttccaaatgaagatggcatcatgaggcagctcaaagaggagagcttaggtaatgcacaatgtgttggctgcctgtccacatctgtcctgcattgatgtggtaggtgagcaatctttttgtgaaaatcatgtttgtgaccataatcatttggatgaattcttttaaagaaattaaaatcccagaaagaaaaaaattcattatacacctattaagaatgggaaaaaaaaaaaaaacaaaaacctggcagtaccaagtgctgacaagaatgcggaacaactataactctcctatattgcttatgggaatgcaaaatggtgtggcctctttggaaaacaacattttgacagttcttgttcttaaaaagttaaccttagacccgccatacaaactgtatgtaaaagtctgtagcagcttttctcataattgtcaacaaacaactcaaatgtccttgaatggacaaaccgtttggcacacaaccaatggaatacaactcacccatagaaagaaacaagctactgacatccacgtggatggacatcagatgtagtattttagtgaaagaagcctatctggaaaggctacatactgcatcaccatctatgttatgtcctggaataggcaaagcttcagggacagaaatgagatcagtggctaccaaggaatgggcatggtgaacaagaaaggagcctgcagaggggcacgggacattagtattgttatttattattattcgagacaaggtctcactccaatgccaaggctaaagtacagtggctcaatcacagctcacttcagcctcttcctcctgggctcaagggatcctcccggctcagcctccagagtacctgagactacaggcacccaccaacacacccaactaatttttgtattttttgtagagatgggattttgccatgttgcccaggctggtcttcaactcctgggctgaagctgtccgcccacctagacctcccaaaatgagccacagcacccggccacagggcattattttatggtggtagagctgtcctgtatcttgatgagttgtacaactatatgagcttgtgaaaattcacagaaatatttactttcagggacattttatttagtgaactttatttcatgaaattgtatttagggtaaatcttattgtttgtaaattacacctgaatttgtccgacttgtaaaaaactaaacaaaaagctaggcatcttctttttatttcaagcatttatttggtgatttgttgtttgcagaagtttatagatttattttttatttaaataacagaatcttgcaagtgaaaggaaacaggtcatcttatgtcaattcctacttttttttctttttaaaaaatattttaacttttattttaggttcaggaatacatgtgtaggtttgttatataggtaaactcatgacttgggcatttggtttacagattatttcgtcacccaggtactaagcacagtacctgatagttttttgtttgcttgtttgttttttgaacctctccctcctcccaccctccaccctcaattaggtcccagggtctgttgttcccctctatgtttccatgtgttctcattatttagctcccacttataagtgagagcatgcagtatttgttcttctgttcctgtgttagtatgctaaagataattggcctccagttccatccatgttcctgcaaaggacatgatctcattccttcttatggctgcatagtattccatagtgtatatgtaccacattttccttatccagtctactgtttctttatttgtttgtttgagacagggtcctgccctgtcacccaggctggagtgcagtggcacgatcttggctcactgcaacctccacctcccgagttcaagcgattctccagcctcagcccccgagtagctgggactacaggcatgcgccaccacacccaactaatttttgtatttttagtagagatgggttttcaccatgttggccaggctggtcttgaactcctaacctcagatgatccacctgcgttggcctcccaaagtgctgggattacaggaactgtaatcccagtgtgagccaccatgcccagcctatctagtctactgttgatggacatttaagttgattccatgtctttgctattgtgaatagtgctgcaatgaacacaacgcatgcatgtgtctttatagtagaacaatttttattctttgggtatatatccagtaatgggaggattgctgggctgaatgttagttctgtttttagttccttgtggagttgccacactgctttccacaatgcttgaactaatttacactctcaccagcagcatataagtgtttgctatttctctgcaacctcaccagcatctattatttttcactttttaataatacccattctgactggtgtgagattgtagctcattgtggttttgatttccatttagtaacactgaacattttttcatgtgctttttgaccacatgtgtgttttcttttgaaaagtgttcatgtcctttccccactttttaatgaggttgtttgttcttcatttgtatgtttaagttccttgtagattctggatattagactcttgtcagatgtaaagtttgcaaatattttctcccattctgtcagctgcctgtttactctgttgatagttccttctgctgctcaaaagctctttagtttaatgaggcctcatttgtcaattttggcttctgttgcagttgattttgctgttttcatcatgaaatttttgctggttcctatatcctaaatggtatttcctagcttatcctccaaggtttttatagttttaggttttacttttagttctttaatccatcttgagttgattttttttatatggtgtaaggaaggggtccagtttcactcttctgcatatggctagccagctctcagcaccatttattgaataggcagttatttcccctttgcttgttcttgtcagctttgtcaaagatcagatggctgcaggtgtgtggccttatttctgggctctctattctgttcttttggtctgtgtctgtttttgtaccagtactgtgctcttttggttactgtagccttgtagtacagtttgaagttgggcaatgtgataactccagccttgctccttttgcttaggattgtcttggctaattcgggctcttttctttttgttccatatgaaccttagaatagttttcctaattctgtgaagaatgtcattggtagtttgataggaataacatcgaatctgtaaattgctttgggcagtatggccattttaatgatattgattcttcctatccatgagcatggaatattttccatttgtttgtgtcatctctgatgtctttgagcagtgtttcgtaattctcattgtagggatctttcaccccttggttagctgtattcctaggtgttttattctttttgtggcaattgtgaatggcactgcacttctgatttggccctcagcttaggggtgctgttaatgtatagggatgctactgatttttgtacattgattttgtatcccaaaacttagttgaaattgcttatcatctcaaggagcttttgggcagagactatgggttattctcaatatagaatcatgtcatctgcatacaggattactttgacttcctctcctcctatttggataccttttctttctttctcttgcctgattgctctgaccaggacctctaacactgtgttgaataggagtggtaagagagggcctccttccttgtcttgtgccagttttcaaggggactgcttccagcttttaaccattcagtatgatattggctgtgggtttgtcatagaagtctcattattttaaagtatgttccttcaatacttagtttattgagagttttagcacgaaagggtgttgaattttattgaaagccttttctacatctattgagataatcatgtgctttttgtctttagttctgtttatgtaatgaatcatatttattgatgtgcatatgttaaagcaaccttgaattgcagggataaagcctacttcttcatggtggattagctttttgattttctgctggagtcgatttgctagtattttgttgaagatttttgcatctgtgttcatcaaggatatagaactgaagttttcttttttgttgtgtctctgccaggtttgagtgtcaggataatgctgcctgtttgaatgagctgggaatgagtccctctttctcttttttttttttttgagtagctttagtattttcctgcatgtttttcaaataaggaaagtaacagccagagaaagaaatgacaatgaacagtcagctttggcaatctgactatgtaaattagctaccacagaagctaggattaacattagggtttttttggtgatataacaaatagagtccagaaaactgccaccatatgtttacttgaacccagaaatttggcagcaaatttttggaacagaatttgtagtcttgaaattctgctttgtttaactctaggccataaaatctttaatggaaatgtttgctttaaaaagtggcttattatgcatacatgatcgatttttataatttactaatgttggtttaagtttataaactatattataaatgcctggctggatcccatgagaaaatcccaaacagcagttgtcaacctctttagactctgagccctttcttcaaacaaaatctcccagtgcatcacacgtataaaagagctcagaaggccaggcacggtggctcacacctgtaatcccaacattttgggaagctgaggtgggcagatcacctgaggtcaggagttcaggaccagcctggccaacatgacgaaaccccatctctactcaaaatacaaaaattagccaggcgaggtggcacactcctgtaatcccagctactctggaggctgaggtgggagaaacacttgagcccaggaggtggaggttgcagtgagccaagatttcactactgcactccagcctgggagacagagcgagattccataaagaaaaaaaaaaaaaaagctcagaaaagctcatctacccagtatgggaggtagctgcacctagcagtgtgtggggcttccacatgcacactgctaatgccaccactcccaaatgtcagttcgaatcgtagtttatggattgaaccacaaggcataatcacatatttaatttggttcttgttaatggagctttcaactgatgatgtctttgaaagtagaagtctattgcctagcaggtaatattcagttcagggtaacatatctctatcctagaaattcacctgtcacaacgtaaaatgtcccttattgctttgtttcatcctttggattgtcctgctttccttttttaaataatgctttctatttggggaagagcgggaagatcaaagctcaactggttgaattcagatgcttttaagacagtgggaggctgaagtgagcggatcatgaggtcaggagatcaagaccatcctggctaacacggtgaaaccctgtctctattaaaaatacaaaaaattagccaggcgtggtggcaggcacctgtagtcccagctactcgggaggctgaggcaggagaatggtgtgaacccaggaggcggagcttgcagtgagctgagatcacgtcactgcactccagcctgggcgacagtacaagactccatctcaaaaaaaagacagtcagaaggggaggacagttaggcaatcagatatatgggtatgaagctcagaacagactatttaaaataaaatacagataaaaatggattcttccatgtggatggctgctatcaaacagaaaataccaagtgttagggaggatgcagagaaattggaattcttgtgcactgttagaatataaaattgaataactaccatggtaaacagtatggcagttctcaaaaaattaacaatagaatttgcatatgatcgatcaattctgcttttggctctataccgaaagaattgaaaacagggcatcaaagagatattcgcacacccatgttcatagcagcagcatttacaatgcccaaaatgtggaagcaacccaagtatcaatcaatgggatgagtggatgagcaaaatatggtttgtacacacagtagaatattattcagccttaaaaaaacagaaatgtcatgatatgctataacgtgaaagatcctagaggacattatgctaagtgaaataagtcagccacaaaaagataaatatgatatgattccacttacataaggtacttagaataatcaaattcatagagacagaaacgctataagatttgaccttatagccatatacatatatttcaaattgtaccccaaaatgtgtacaattacaatgtctcaattacatattaaaactttaaaacaagaaagtagaacggtggttgccaggtggttgggtggaggggagaatggggagttagttgtttaatgggtatagtgtttaattgtgcaagatgaaagcagttctagagatgattggtggtgatggtcacacaacatcacaaaggtacttaatagcacagatctgtactcttaaaagtggttaagatggtaaaatgtatgtaacatattttaccatgatttttaaaatttggaaaaaaatggataagcctccaaactgaaatagtaatggaagccaattcatagcatgaacgcaggaaagggcctaagactgaacttgagggagccggtagtcaagggctgggtagggaggacgagcctgttaggagatgaagaatgtggttctgcaggtgggaggaaactaaacaagcacagcatcatggaaaccaaaggaggacagtgtttcaaggaggaaggggtccagtgccaaatgcccctgagaatgcaaagggcatgaattgggaaatgcccacaagttttaacagcacagcggtcattggtgacctccagaatcatgtcttccatccaatctggtaatctttcatgactgtaaactccttgagagcaggcaccttgaacagacctctatatcctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtaccttaatttaattttttttaaaaaaatggattctttttcttacatggtgatgggctcttgagtattataaaatgactcttgaaattttatatatgttttctaaagagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtgtgtaacaaaagatggactgcgcttggaaggggaatcagaatttttattcccattgtatgccaaagaaatacactccagagtggtaagaaaatgttaagacaaataatttgtgctttatgaaaaataaatcatgtttaagcacaaaaattcagtacagtttagagaagatttttaaagcgcatacatgtgcacatattcatgatatgctctttataaaaagcttgactattgcagaatttatctctgatattaccttctaaaaatatttcaatttaatatgcttcagatctgaatttggtggcctcagtagtttagaccataataaactaaaggttttagaaatgaaaatttttaccaagaacaatttaaacttctttatgttagatcaactaacttaaatatatttattttagggtattcaaaattatctaagaagcttagaaagaaattcgtttcagctgggcgcggtggctcacgcctgtaatcccagcactttgggaggctgaggtgggcggatcacctgaggtggggccagcttggccaacatggataaaccccgtctctactaaaaatacaaaattagccaggcatggtggcgtatgcctgtaatcccagctactcgggaggctgaggtaggagaatcgcttgaacccaggaagcagaggttgtggtgagcccagatagcgccactgcattccagcctgggcaacaagagcaaaactccatctcaaaaaaagaagaaaaaacaaaaaaaaaaaagaaagaaatttgtttcattgtattatgttctgcacttattatactaattacagattatgatcctgtaagattctgaacaagtagattcagcattgttattaaatacttatgtgactttaaaagtaaatcaaggttttcttcatttacctccatggagcttataagaaggacagccaagaataaagtgcaaatacgttcaaacaatgttggcaatatgttctatttttacttaagtgatgctatgagcattatagtaggcacgaacattttgctagattattgataaatggcattacctccctgacgcacaaaaagttaaaacttcacccagctataactttctagttatgtgaagagcagagtcttcattttcctttcatatttctgaatatgaaagggtatttcagtatctcctaactgcagaggctgtaccagccactataggagaattagaaaagaaacaaaagacttactaagaaacatgaggtcttgttagagacataaaacacactcctgaaccagacattcgccaagctctgttaccaattgcaaaatgacatggcatgtgactaacacataaatatcacaaagagagatcccagtaagtgaaaagtacataagtagttttaggtgctgttatgttacttctggggctatcttattggcagtgggagccagaagatgacctgcagtataataggcaggtaagagcctgattctgtgaggcttacccttaccttatgtcatacacttaccttaattgtgatggcatttcagtgtgaaacaatcctgtcctacaggatttcccttttgtaaaaggggaagtcagacatgaatgaagcattcaagtgttagaacttggtcttcttttttccccagagttgtgttggctgatctcctgccatattttgggaagaatcagactggtagaatggtccggtgactgaaatcaggtgactaggtcacagcaaatttaatattctggaattaataataactctcagttggccaggcgtggtggctcacgcctgtaatcccagcactttgggaggccgaggcgggcagatcacaaggtcaggagatcaagaccatcctggctaacacagtgaaaccccgtctctactaaaaatacaaaaaaattagccgggcgtggtggcgggcgcctgtagtcccagctacttgggaggctgaggcaggagaatggcgtgaacctggaaggtggagcttgcagtgagccgagaccatgccactgcactccagcctgggccacagagtgagactccgtctccaaaaataataacaataataataataataactctcagttatattttatcaggctttttcatctccagtatgcttttaaaaaaagcaaaattatagcgaatatcttagataatcacatattaaagtcttagaatgtggcattaatgagtatgtcaatcaacacataaaattcagtaacaatttgaataatattatgtgataacagagctgtacagtgttttataactaacatggtttccaataagagccatcccagaacaaaactatgcttcctaacttctgtatggattgatatattagttataaatttccttttcaaagatgagtctaggaagcaattttccataaaattacagaaaagaaattactttatgaatttgcaaaatttgacacataactcacttatgtgtactgatgagctgagagaatttcttctttataaatataattcaacatgctactctggcctctaacatctgatcacccagtaacccctcaaaagtaatacatgagggcctgtattgaattcatactttgaattcatggcttaaacccatccaccatgcccattagttcaaacacataacaattatttcctttaaacaaaaagggttttaaaaaactacagagccatgatgaaaaactaaatgaaacaaatacgtggtaataaagccttacttgaaatgatcatctgtgaagttcccagccctgaaaagaagctttagcttacagccaaagcccacagtgtgacagggaccaaaagggcacctcactgggactccaggcaagcccattgcataagacagtgctgaagacagaaaacaactacaactatttgaataaagttgctacaactatttgaataaagcagcatataaaaaagtagctacaactatttgaataaagcagcatacctgaggggaggaggctacaaagatgccagtccagaacctgaatgtcatgaggacagaagccctaagccaccactgaaagactgggaggccctgtggaccaagtgaaaacaacaggacagactttagacagactggtaagagccaaaaggtagacacatccacacagtggaacataaaacttgaaatttcatatgatgaaatcttcatctaaaaaaaaaaaaagcccaataaactttacataaaggaagatcaatatccaactaaataaaaagtcaatctgaaaatgactagaaaaacacacttaagattctcaaagagataaagctatttttaaaggagttttccttaaaataacatgaaattataaaatcagaagagaaattacagggcagaaataacagggaataggtttaccctcctgcattaaacaactaaaaaatgaaaaaaaaaatatatgaaacagtggttttcaaatattggacaatgggcagctcaggagagttatccctgcaagaggaaaaacaagagtgactcctcaaattgccttaactcactgcatgaagagagtttccaggctgcaatgagggaggggagccaatgcagacacaggtggtctccctgagttgaagagacagggttgggaggccaaggaatccaaggcagctgcagtttgcaaggcggagtactgcagaggaggggcttgctgcacgtggacagcgctccagagatggcagagacttcacctcatcccacccccaccaagtctatggataaatatttaccagtgtgtgtgtgtgaggaagctaccttgagactagtgaaatacccactctaagggagcagaaggaacaatgcctggagctcacacagggtggggaacagttcatattcccaccagtcagagtggaaaacttcataaattatgggcatcaggtagaatacagaagggcatggctcagaagtggtacaagatcaacactaggaaaaaaatcctgctctggtccattctaacaaagcttaacaggaatccttgaaagtggcatgctttttccaagtgatttgctccatcccagaacagagttctaaaaaactacatttcatctgtgcacaaaagtcgaggaaagcataatcatgttaaggagagacataaaatatggaaagacagaaaaaacacaaaagaatcttctagagatgaaaagtataacaactgaaatttttaaaaagccaatggtgggactaacagattaataacaatttaaagtatagctatagatactctccaaaatggagcacagagaaaaatgactagaaaaagaaagcaacagcatatcagtaactttctttttctagaaaaagaaagcaacagagtatcagtaactagagggacaatgtcaaggggctttatgtatgtgtaactggcatctccaaagaagaagaaagaagagaggacaaatattatttaaaaagaataaagtgtactttttttccaagcatgataaaatctttaagcctacagataaaacatgttcaatgaaccccaaacaaaagaaacaaggaaaactacaaggtacattgtaattaaattgcttaaaaacaagagagaaaaatcttaaagagaaagccttagaagtagctagagaaaaaggatatataacatacaaaggagtgaaaaaaatatgacatcagccttctagtcagtaacatttaaagccagaagacactgaagcaccgactttaaagtactaaaagaaaaaaaggccaacctagaactctttacctagcaaaagtatctttaaaagacaaagtcaaaataaagacttttttggacttactaaagctgaaagcaagttacttcagcagactagcaccacaagaaatattaaaggaagcctttctggcaaaaagaatatgatgctagaagaaaaatctagatgttcaccagaaaaaaattttaaataccagaactcataagtatgtggttatacaaaaaataattttaaaaaatgttagaagacactttgctcaaagccaaaagaacaatgtatttgggatgttataacaggataggcataaaatgtatgacactaatgaaacaaagaccgtaacagaaaaagatagaagtactgctataatgttctcacatcacacgtgagtggcaaaaattattgaggatggaccttaataagttaaagatgcttagtatatctaaagtaaactcgtaaaacaaaaagtatagctaatacatcaactaaggagataaaaatgaaatgataaataattaatccaaaaggaggcaaaggaaacaaagagaaaattagttgaatatgaaaacaaatagcaatttggtatatttgaaccaattcatagtcacattaaaataatcacattaaatataaatggtcaaaacaccccaactgaaagacagactgtgaaactgaacacagaagcaaggtccaactatatgccatctagaagaaacctaccttaattataaaaacacaaataggttgaaagtaaaaggttataccatactgtactaacctatactatactaacactaattaaaagaaaattggagtgactatattaaaacagacaaagtagatttcacagcaaacagataaatattttagagatacagagggtcatttaagatgacataggaataaattcttcaatatttatggttctaaacactcatgaatccactatcagagcatcaatatacatgaagcaaaactgatagattgtaagaaaggaatagaaatattcacatttagactcagggatttcagcacccctctctcaataactgataggagaaatggatatagaaacagtaagcatatagacttgaacaatgctatcaaccaacttgatataattaaaattttcagagcatgctgctcaacaacagcagacagagttcttttcaagtgcacagggaacatttatcaagatagatcatattttgaaccataaaacaatctgaataaatttaaaaacattcaagtcttccaacatgttatctgaccatagtgggtttaataagacaactataacataaatatatctgaaaattttttgaataactggaaattatataaaaatttataaataaccatgggtcaaagaagaaatccaaagggaaattaaacagtattttgaactgaatgacaattaagaaaacaataacattaaatttgggaggatgtagctgaggcagtgcttagacggaaatttatggcattaaatgcctatattaaaaaagaagaaaattggccgggtgcggtggctcacgcctgtaatcccagcactttgggaggccgaggcaggcggatcacgaggtcaggagatcgagaccatcctaacacggtgaaaccctgtctctactaaaaatacaaaaaattaaccgggcgtggtggcgggtgcctgtagtcccagctacttgggaggctgaggcaggagaatggcatgaacccaggagtcagaacttgcaatgagccaagatcacaccactgcactccagcctgggcgacggagcgagactccatctcaaaaaaaaaaaaaaaaaaagaagaagaaaatcgatgacctcagtttcatccttaagaaactagaagaagaacatgttagaccaaaaatcaaagacagaagatccaaacaaataaaatcataaatgaaaaaggagacatcataatggataccacagaaatacaaaacatcatcattagaggctaccatgaacaagtatatgtcaataagtttgaaagcctagggaaaatggataaatatttggatacatacaaccttccaagattgaaacaagaagaaacaggaaatctaaacagaccaataatgagtaacaacatcgaattagtaataaaaagtctccccaataaaggaaagtccaggaccagaaggcttcaccgctgaattctaccaaacatttaaagaagaattaataccagtccttctcaaactttttcaaaaacttgaagcagaggagattcttcctaactcattacacaagaccagcatagccatgatatcaaaaccaaacaagaacaaaacaaaaaagaaaactacagaccaatatttctgatgaacacaaatgtaaaaatcctcaacaaaatactagcaaaccaaatacaacacatttatcccaagaatgccaggatgagtcaacatatgcaaaacaataaacaccatacatcacatcaatagaatgaaggacaaaaaccatttggtcatgtcgatagatgcagaaaaagcatttgataaaattcagcatctcttcatgataaaccaaaagtcaaagaagaaaagaaagatgagagaagaaatcaacaaaatagaaaacataaaacaatagaggaaattaatgaaaccaaaaatggattcttttagaagatcaataaaaattgataaaccttgaaccagactgaatattttaaaaagagagggcacaaattatcaatatcagtgatggtagaagggacactgctatgaatcccacagacattcaaagaatggtaaggaaatattacaaataactttatgccaataaatgtaatttttccacatactgtttgacagaattcttgatataggattgctgcttcaatgattaaattagtttctgccattcccatattaggttcaagttggaagtagttaattatgtatataaatgaagtggtgaattgtacttgccctctaatctacattttcaaaaagtatcttaaaacatcaatctcatagggtattgataactcctatagcagttttgatctatctttgggccataccaattaccccttacattattaatggtctttttatacacctctttctttcacagctccttctatatgtcatgcactgttgagaaaagtaataaaaagttctacgttctatgattctttcacctactccctaaggtgtagtgttgacacaacagctgtattcaaacaggtacattcagagttcaattgagatgaatagaaaaataaaatgttctccttataccttgctgtcattctctaaatggcgtaaaatttttctaaaaggcatcattagctaatgataaaaactgaaaatcccttatgtaaaattttagaaatgatatagtggtggttgtacaatactgtgaatgtacctaatgtcaatctactatacacttaaaaatggttgaaatggtaaattttgtgctatctataacttacatacatagtatatttatattttaatacaataaaaatagttttaaaaagtcaaaaaacaaaaacaaaaacctggaaatcacattcacaatctataaacttcagttttcttacctagaaaatggaaaataaagtctctggacttcacaaaaaacatcagtttttattaaaaatgtacacgttgattgttttaaggtacttcttaaaaatatagattaaagagcaagtataattcaatataagaggtttcattatagcagttatgaatacaattttgttggtaatatagatacagagtcaattctgctctgtcaattaaaagagctttaccgtgtgaacacagaatacccagctagccgtggcataaactaataggagcttttagtctcacataacaggaagctggagggggcagctgcagctttggttcagcactaaaccatgttaaggccagagtatctaccagccacccgcctgcccctcataatcactagacagttatgaggccacatccaagacacacagccgggaaatgtgcagtgctggtgcatgtgcctttttcacaaggaatgcaaaagcttgcctagaaaccctgagctccaccctctgcagatctcagcttatctcccattgaccagaattgtgtcccgtgggtacccctagcctcaagacagtctgagaaagcaggcaacccctgtcgtggaaagcagaaaaagaaaagggtttgaaagtgactgttggattagatgacaggaagtgaatcccagaacagcttactttctctgcgcttgggagtggatctcactgctctcaccagaaccctgtcctcccattccaggagaatggtggagagagcctggaagtgggcatctaaagattggctccaccacggaactgtcatctgcagctgtgtgtggctttgaggcagctataatttattccctgggatctcaatttcctcatccctatattagcaataatggtgcctactttataaaatacaggataaaatgaaaggatcaatgctcaatttaattgataaagtgttaactcattatcatgctaattattttctaacattgcagaaacaagtgttaaggtgacatcattggataccataagaagctgataggtccatctgcttccacaaagctagttggagaatttctgacatcctagatagagctcccaagggctcttaagactattttccttttgaaacatcacataattccctaccactctggaagatatttggtttcctctgagtgaaccgtaaacctacctgcatccaacagcaaaattagtgaattccttttgaagaaaattgtgtatataaaaacaagcaatcttctctaaaacaacaccaccgtatcaggattacatatcatatcaggattacgataacagagaaagtataaacaaaaccgccgtatcaggatcactgtatcgtatcaggattacgataacaaagaaagtataacacttttgtgctcataaagccactttatcttcaacaaaaagtgcaaaaaacagagccatccaaaaatgttgcttaattcatttgaaattatgagaagcctttgtgtttttaaagtaacatggtatttcttatagaaaagttaactatttctcggattcatcttcttaaagtatatcatgtcctggacataaataatccctaaaaatagaattttaattccttgaaaaagcaaaagcactggttaaaacgtggttgttttagatctttaccttgtgaactgccttgacacattgtaaccagtgcgcacaagcactgtaaacccatgggattctcacattttatgagaaaagttaatacatctacttccttaacaatatgattcaggtgaccatttggggcagccttaggagtatgttgtgggctcagacaccatacagggcctggatcgttacgacttctccaaggcgctttgaaatcatcatggaagggctttggcatctctagaacaccaagaactgtgataaagagttgaaaaaaggaggaaacattcctgaggcgccggagtggcgtgaaggccctccagctctggggcccatcagcacccggaaaagtaccactggagtggcacttaggtaggatcccccagcaaacacaggtgccccgggagctcagtaacgtggtttggaaggggacagaggccccaaaggcctgaaagcccaaaaggagtactttgtggcctgcacaccaaggtttttcctaaggttcatcctgccacagaaattctttctcctccttctcctcccattcctcagccactggcgtgattaggactggctacaaagactgcctaatttggagcatttggggttcctttcgtccttgtgatccccaatgcattctgccagcccctttctaaaagaaatggcttctctggaggagggcatctacagccttaaaattaattccaaacgtagctcctataatttcatgaaccctcaatttgcagctggaagtgagggtcaaaatgaaactgaggaaccaaacaagttccagaacaggtagggtagacctaaagatagcgacgcttaattgacttatgtgagggttctccaggagatcctgggagatgacatgccaaaaggaaaggaagaggctgtcactagttcacaatcaagcctaggagagtgtctctactacggagaaggacgagccaggaatgccactatctttgctcctcaaaaagagaaagagtcagccccagagatgagcagctcctgtgacaagagggtgattgttaatcctcctaagaaattcagtaaggggcgacctaataaccaaagtagagtcatttatgaaaaaagctctccgcctttaaattttctgggtgattataacccccattcaataatccaaaagcgacttagcaaccaaagtagtcatttgtgaaaaaactctccacctttaaattttcccggaagactagagctcccattcaatgttccaaaagcacaaagacaagatggtgattgagcgcccctctttagggtgtgactgatctgatgtaggtggaaccacagtcgtattctctgaagagaagccattctcactgtgtcttcctggagtgtcagagcctctgtactacgccactgactataccacttttccacctcattatagtccttggcatgactacaccagctcttggttcagcaataccaagtcttcttggtatccctccttgggcagcagcagtaacacattccaggctgggaagagcagcttcagcagcagcagcagcaacaacaacatattccagaatgagaggagcagccaccagagcttcctgagtgattattccaccaattttccagtgagtgtccaaaacatgtccagagacctgaagatgacagaggaaggcagatccaagaattcctccttatttcactactccagaaatgtggaagcagatgcgaaggaggagggagtgtatcaagaggagacattacaacgtccttatggaggacatgcatctagctttctgccaagtaccctctggcagccaaagcaacagggtttcattgttgatacccactgtcacttggacttgctgtattccaggctgcctttcaaaggcacctttaccaaattcagaaaaatgtatagcaacaccttccccaaggaatttcagggttgcatttcttgcttcgacaatcctcaaaacctaagggacaggctgtgggagcatccgttgaaagatgatcagcctttggctgatagcctttgactgttgccctcattttgcccattattataatgactatcaagaaagaagtattttaaaagccttacaacaccccaagtctgtggcatttggagaaatgggcttggattactccaacatgtgcaccacacatgtcccagagcagcagaaggtatttaaaagatagctgcagctggccgtctctcttaaagaagcccatgatgatccactgccgagaagccgatgaagacctactgggcatcttgaaaaaatatgtgccctctgaccacaagatgtaccagcattgcttcactggcagttacccagtcatcgagcccctgttgagccactttcccaacctgtatgtgggcttcatggcaattctgacttactcttctgctgagcaagcccgagaaactgtgaaaaagatcccattagagagaattattgtagaaaccaatgctcccttcttcctccctcactaggtttccaaaagccgttgccagtatgcccacccaggcctggccctgcatacggtgcgagagattgccagaatcaaagatctgttgctttcccacaccttggccatcttgcaggagaacacctgtcacctctaccatctttaaacagaaaaggcacagtcaggagtcttcctaagaaaggagaccagtagcctgacaaaacacatgaactagatttgaactctatgtcccgggtcaaggatgtgtttgaagaattcgttggcatggagtaaaccaggacaggatattttcctcaaaaccttttcgtaagacttctgcttctggctggtagggtggggtacaatgggatgggaggaaggctaaggtaaactgcccttgatgttattaaggtttttcttcccagcaaaaatgccttaaggtagccagtaaagaagagagtttgatagaatacaaagagtttcccaatctaaatccctgtcctctgcagcctgcttttgatcacttggtgaataaagtcacccttctacttgtctttaaaaaaatgtagaattttaaaagtgaggtaggtgatttgtatattatattcgtatattataggaattctatttaaaaatttaaaaatcggtcgggcatggtggctcacacctgtaattccagcactttgggacgctgaggcaggtggatcacttgagcccaggaattcaagaccagcctgggcaacatagttaaaactcatctctatttaaaaaaaaaaaaaaaaatcagctgggtgtggtggcacacacctgtaattccagctacttgggaggctgaggtgggaggatcacttgaatccacgagtctcaggctacagtgaactgtatactcacaccactggactccagcctggcaacagagtgaaactcccatctcttaaaaaaaaaaaaaaaaaaaagttttttaacaaaaaataggccagatgtagtggctcacgcctgtaatcccagcactttggaaggccaaagcgggtggatcacttgagcccaggagtttgagaccagcctaggcaacatagtgagaccctgcctctaaaaaacattttttaaataaaaaatgtaagtatacactcaaaaagataagcgagatctacacaccgagttttcctttccaaaaaaaatttctatcaaaaaaaaatttttttaattttagatggaaaaccaacctactcctctctccctgcatttttgtgtggcaaatttaagtgttacactctgcggtgtttataacatgcaggagagaaccttgctgtaatttatctttttttcttcaggaaaaggaatgagcattgtagttctgagtgtagtattatcaagagtagcctaaatcaaaaagcacaatctggccaggcgcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggttcggtggctgatgcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcatgaacccgggaggcggagcttgcagtgagccgagatcgtgccagtgcactccagcctgggcgacagagccagactctgtcacagaaaagaaaaaaaaaaaaaaacaaacctcaattttcatttatttattccattagtgaggtaaagaacagttcacctactcatgttactagtaaaatcttgcaatgcaaatgtgcaaaatttgggacactttgtaaatagttttctacttaagtgatagatattccatttaacctcaaagaattattatttagcatttatttttatggcatttggtgtgactaccctcccatcctggagacatcagagttgtgaaggtagccagtaatctagaaattcagtttactcttagtggtccctgggatattagtctggagtcacagagcctctcaaggcccattaacaggctcccccaaccttagcagtcctttcagggcatgtcaacatttcgcttcacttaaattttagaaaggcagctatttctacctttaaagctcaaaagaagcaaactgcccattttgtcttgggagacagaggaatttgctttttcagttggtttttattcatatctaacttcaaaattcatacctgcttattataaaagttttgagacaagtaaagcgaaaaaaatgtgatttttaaaaaacccaaacaaaataaaagcaacagaaggaaaaacgtacatggtaaaattgattttttttaaatcaatagtagagtcaaatattggcaaaatctggatatacaaaatttgactcaggaaaattgatcttggtagaaatgtgatcaacaaagaaaactcagactgtcaaaagccacaatggacagcattcatatagacaaaaattaatgaaccaaatgtttttagtaaattttattgtagaaaaaatctgttgaaaatatttcttaataggaaaatatggtaatagtttacctgcatggaaaaattgttcaaagaattaaagtagcttgcagtggggaaaaaagtaaaaatttttttgtttaggtataattctgtttgttttaaataatcaactcagactgcatgtgctttttcaaaactattgtttactgatacataaaattgtgctttgaaatttatttttctttctgttctctgatgtcgattttattgtgtattttctaatgtcttaagctaaatgcttagtttattttttatctggagagcaagaacaaagcagtcaataccacaaatgtgtctgtaattataactctgctgtatacatagatttttttattttgataaagtttactttacacattataaaaacacaaatgtattacaaaaatatggaaatagagagtagcaggaaaaagtatatggcatttctattacctagaaccccactgttgtaggtgtctttccttgacatagctgtgaccatatagctctgttaaattgcatatttgtctaaataattcatatttttttctatccctatcttgcgtttggagctcattttatgattgttattcttttatctttcaataaatactcaaaatgttaaaaaaatatgattcaggaatttttaattgtcttagccacaaatttataggatttccaggatctgtaacaatggataaataattttataaaaatcctaaatttacacagaattataaagatataatcattttaaacagcacctattttgcaaattttataaatctctttctaggactcatctctgcttctacaatcaacccagaatgtgactgtaaatgcgcgcaactcagaaggggaggtcacaggcaggttaaaagtcggtgagtccagcttcatcatggtgctttgcatgcatgttgtccatgaatagtgctaaatgaatgcattgttttttcttctaaagaaatcaaagctacttatgaacaaaatatgaattttctaaatatcatgctgtgttgaccacagactagcaccacagagtggggtggggggtgaggggacagcctgaagtgctttgattagagttatttttgttccaagaaatagaggacaattaaagctagtacaagaaacaaaatgtttattgtgggttaccaaagactcttgcagcaaccaaagggaaggaacccaagtagctggcctcaaagagcacagagaccagtggctgagagccacgaatacattcagttccctccccgttctttcttctcttttctctcctccccatgtgctccattctcctcctttccagtttatctttgccaccattttcacttggctgtatcacttctcactgtacagaacctatagggcctccctgattcttacctgctcggctgtagttatcaacatcaaacagtttagtcttcaattacgcaaattctaaatccacaaagtactctaattagcccaattcatctgtcccaccacattcctttgggtcagtcagctatgtacacccatccaatcaactaaggccagaggataaggtcacatgggagtgaggtcacatggaatcctgcaaagggagaaaaatgtcagcaagaagaaatatagatgaaagcaatatcagaagagcaaaccagctggtaagaaggaatgcaggccaggcatggtggctcacccctgtaatcccagcactttgggaggccaggatggaaggattgcttgaatctaggtgatcaagatcagcctgggcaacatctctaaaaaaataattttaaaaattagccaggtgtggtggtgcacgtctgtagtcgcagctactggggagtctgagacagggaggatcactcgagcctaggaattcaattctgtggtggaagagaccctttgtttgaaaaaaagagaataagaataacgaagatatatatattcactatactattaacattggatagatttgctaagtctaggaaactggatggcccttgtcattatcagaaaataaatgagaggtgtactgccaacacaaacttccaatgtctctctttttaatggtacttttacaaaacagaataatgttacatgggaaactacagccttatgttaatctgatgattcctttttcttatactaatacaagatgttctgtactttatcctctgctttataacttattcttgatcataacttgtatctctctttggcctggaagttttgtttaataactaagtccagtgaaattctctgtggatcaggagatgaactccagtttttcctgcatatacgttcttaagatgtatttaaaacaaattatattttcttgataaattatacagtattatcatttatctttaccatcatttcttgaaaatcttcaactgcctatagctttcaagtgtttgaggaatttttgcccattttttctcattcattccaacaaatatttgttgaatgactatgggctaccttatatgctatcaagtaataataataaagactatgtaattatttcttagaagctataaaagtagaagaatcttcttatattcctataaaaattaattagcggccgggcacggtggctcacgcctgtaatcccagcactttgggaggccgaggtgggtggatcatgaggtcaggagatcaagaccatcctggctaacacagtgaaaccacgtctctactaaaaatactaaaaattagccgggcgtggtggcggtcgcctgtagtctcagctacttgggcggctgaggcaggagaatggcgtgaacccgggaggcggagcttgcagtgagccaagatcgcatcactgcactccagcctgggcgacagagtgagactgtgtctcaaaaaaaacaaaacaaaacaaacaaacaaaaaagttaattagtacaagtacacattcctctgtttatctttttgttgggtgtggattttcgtatattatgcaagggaatttagatataatataaacctgcctctcatttcatagatgaaaaaactgaaggactaaaaagcagatttgctcaagagcacatagctagttagtagagaagtcaaaacaggaaagactgagggcttacttctctcagccagctgtttccactggccctcctctctaatcagatttcttgaaattatggcatgctagtaactgttctagttgcttcaaatatagtttccatttcatttttgtcaccaagaaattaccaggggttttaaaggttttgttttgtttagtttttctttttttaaaaaggctgggtcagtggctcactcccgtaatcccagcactttgggaggctgcagcaggaagactgcttaagcctaggagttcagggcttcagtgagctatgatcacgccattacactccagcttgggtgagaaagtcagaccatctctaaaaataaaaataaaataagttacacatcaaaatctctttggtttgaactgttcgcctcaatctctagttttaaccttggtgtctcatgcctgagaaagtgatttaattagtgatttctagtaaatctttagttggaaagtctctgttatattgagaaccttgagctaggaaatagcaccaagctcaccaaatccaaggttttcttccgtacatgacttcccacagttgcaacccttctagtctcatatttcctggaagaagttaaattttgccaatttgggtattaaaatgtaatttatgtgaactagccatattaatctcatttaattaagtgaataagtgttttctacaaaaccactgaaaacaatttgcattcaatacagtcaaaaccaaaaatcccaattaaattctgacatgatttggatgtgcgtcccctccaaatgtcatggtgaaatgtgattcccaatgtggaaggtggggcctaatggatggtattgtatcatgagggtggatccctctcaaacggcttgcaccatacccttggtgaagagtgggttatcactccattagttcacatgacatctggttgtttaaaagagtctgggacctctctcttctctcttgctcctactcttaccacgtgatgcacctgctccttctttgccttctggaatgataggaagcttcctgaggccctcactagaagcatacgctgaagccatgtttgtacagcctgcagaattgtgagccaattaaacctcttttctttataaattacccatcctcagttatttctttatagcagtgtaagaatcgagtaacacagaaaattggtactgaggagtgagccattgctataaagatacctgaaggtgtggaagcagctttggaactgggtaacaggcagaagttagaagagtttggagggctcagacaggaagatgacagaaagtttgggacttcttagagacttagtaagtggctgtgaccaaaatgctgttagaaatgtgggcagtgaagatcaggctgaggaggtctcagatggaaatgaggacgttattgggacctggaataaacatcacctgtgtaatgccctaggaaagagcttagctgcattgtgtccacaacctaggaacctatggaagtttgaatttaagagtgatgacttcgtgtactgcagaagaaatttctaagcagcaaagtattcaagaagcagtctggctgcttctaataacctacaatcagatataagagcaaaaaaaaaaactttaaaatttgaatttatatttaaaagggaagcagagtggaaaagtttggaaaatttgctgattggcactgtggtagagaaagaattcaagcaggctacagagcaatcacttactagagagctcagcatggctaaaagggagccaagtgctaatatccaagacaatgggggaaaggccctgaagacatttcagagatcttcgtgacagcccattccatcacgggcacagaggcctaagaggaaaccatggtttcagggacactgcttcccacatcacagctgctctagctccagctgtgcctcaaagggccccagatactactcaggccatcgctgtggaaggcgcaagccataagccttggtagcttccacatggtgttaagtctccaggcccgcagaatgcaagaggaagcttggcagcttgcacctaggtttcagaagacgtgtagaaaagcctggatgtccagtctgaaacatgctgcagggacacaggccccacaaagatactgtactagaacagggctgagaggaaatgtgggggtgaaagccccaaagtccctactggggcattgcctagtggagctatgggaagggagccactgccctccagaccccagaatcgtcgagctaccagaaacttgcatcttgagcctggaaaagccaccggcactcaactccaacccatgagagaagccactgggactgcaccctgtaaagccacaggagtggtgctggtcaccttgaggtgccatcttattgcccctttcctttgactgatttctcccttttggaatggcaacatttacccaatgcttctactaccatcatatcttggaagtaaataacttgtttgtattttataaactcaaagtggaaagagatgaatctcagatgagacttaggacgttggacttcatgctggaatgagttaagactttgggggacttttgggaagggatgattgtattttacaatgtgagaagaatgtgagatttgggggagcaagggaagagtgatatggtttgaatatttgtcccctacaagttgcatgttgaaacgtaacctccaatgtaggagttggggcctgatgggaggtgtttgggtcatacaggtagatccctcatgattggtttagtgccatccccttggtcatgagtaagttttcactcagttagttcacaaaagacctggttgtttaagagtcggggttttaagggtttttttccaagatggaagattagaggcattattagcatgcctttcctacttggaaagacataacagtttgtagagaattatgctgtgaacttgcttccaagaaacaacacaggaacttaatttaaaaagctgaaagaaagcacactttgaaagaagcagtgggcagcagcttacaccatgaaccaaatgggaagctccccacaggagacagtgaacctgctcacacacccagcatgtcactactacaaccaacatcttagaaagccatcacacagattctctataaccaaggaactcatacagactcttcaccactgaaagtacccatagccaaagctagttgacaataacctataaatattaaagtcatatcctcaaggtgcaaaaaagaattttaaaaatcccagcagaatcaaaaaataaatgcaaaattaattagaagaaatagttacccaaatgagaaggaaccagagaaataattctggccatatgaaaaaacagggttttataaaacttgcaaaagctcacattgagtctccagcagtggatctaaaccaatgaaatctttgaaataccagataaataattcaaagtgtttattattaagttactcaaggaaatacaagaaaaaagtgaaaactaacatgaaaaacttttttttatatactttaatttctagggtacatgtgcaaaacatgcaggtttgttacgtatgtatacatgtgccatgttgctttgctgcacccattaactcgtcatgtacattaggtatctcccctaatgctgtccctcccccattcccccaccccacgacaggccccagtgtgtgatgttccccttcctgtgtccaagggttctcattgttcaattcacacctatgagtgacaacatgcagtgtttggttttctgtccttgcaatagtttgctcagaatgatggtttccagcttcatccatgtctctacaaaggacatgaactcatccttttttatggctgcatagtattccatggtgtatatgtgccacattttcttaatccagtctatcattgatggacatttgggttagttccaagtctttgctattgtgaacagtgccacaataaacataggtgtgcatgtgtctttatagtagcatgacttacaatcttttgggtatatacccagtaatgggatcgctgggtcaaatggaatttctagttctagatccctgaggaatcgccacactctcttccacaatggttgaactagtttacactcccaccaacggtgtaaaagcattcctatttctccacatcctctccagtacctgttgtttcctgacttgttagtgatcgccattccaactggtgtgaaatggtatctctttgtggttttgatttgcatttctctgatgaccagtgatgatgagcattttttcatgtgtctgttagctgcaaaaatgtcttcttttgagaagtgtttgttcatatcctttgcccacgtttttgattcgcttcttataaatttgtttaagttctttgtagattctggatattagccctttatatactttaatttctagggtacacatgcaaaacatgcaagtttgttatgtatgtatacacgtgccatgttgctttgctgcacccattaactagtcatttacattaggtatctcccctaatgctatccctaccccattcccccaccccatggacaggggtgggcatttagtgctgtaaatcagatgagtagactgcaaaaattttctcccattctgtaggttgcctgttcactctgatggtagtttcttttgctgtgcagaagctcattagtttaattagatcccttttgtcaattttgactttggttgccattgcttttggtgttttagtcatgaagtccttgcccatgcctatgtcctgaatgttattgcctaggttttcttctagggtttttatggttttaggtctaacatttaagtctttaacccatcttgaattaattttcatataaagtgtaaggaagagatccagtttcagctttctacatatggctagccagttttcctagcaccatttattaaatagggaatcgtttccccattgcttgtttttgtcaggtttgtcaaagatcagatggttgtagataagcggcgttatttctgaggcctctgttctgttccattggtctatatatctgttttggtaccagtaccatgctgttttggttactgtagccttgtagtatagtttgaagtcaggtagggtggttcctccagctttgttctttttgcataggattgtcttggcaatgcaggctcttttttggtttgacatgaactttaaagtagttttttccaattctgtgaagaaagtcattggtagcttgatggggatggcattgaatctataaattatcttgagcagtatggccgttttcacgatattgattcttcctatccatgagcatggaatgttcttccatttgtttgtgtcctcttttatttcgttgagcagtggtttgtagttctccttgaagaggtccttcacatcccttgtaagttgtattcctaggtattttattctctttgtagcaattgtgaatgggaggtcactcatgatttggctctctgtttgtgtgttattggtgtatagggatgctcgtgattttggcacattgattttgtatcctgagacattgctgaagttgcttatcagcttaagaagattttggactgagacgatgaggttttctaaatatacaatcatgtcatctgcaaatagggacaatttgacctcctcttttcctcactgaataccctttatttcttcctcttgcctgattaccctggccagaacttccaacactatgttgaataggagtggtgagagagggcatccctgtcttttgccagttttcaaagggaatgcttccagtttttgcccattcagtatgatattggctgtgggtttgtcataaatagctcttattattttgagatacatcccatcaatatctagtttattgagagtttttagcatgaaggctgttgaattttgtcgaaggccttttctgcatctattgagataatcatgtggtttttgtctttggttctgtttatgtgatggattacgtttaatgatttgcatatgttgaaccaatcttgcatcccagggatgaaaccaactagatcttggtggctaagctttttgatgtgctgctggatttggtttgccagtattttattgaggatttttgcatcgatgttcatcagggatattggtctaaaattctgttttgttgtgtctctgccaggctttggtatcaggatgatgttggcctcataaaatgagttaggagaattccctctttatctattgattggaatagtttcagaaggaatggtaccagctcctctttgtacctctggtagaatttggctgtaaatccgtctgctcttggactttttttggttggtaggctattaattattgcctcaatttcagcgcctgttattggtctattcagggattcaacttcttcctggtttagtcttgggagggtgtatgtgtccaggaaatatccatttcttctagattttctggtttatttgcgtagaggtgtttatagtattctctgatgatagtttgtatttctgtgggatcggtggagatatcccctttatcattttttattgcgtctatttgattcttctctcttttcttctttattagtgttcctagcggtctatcaattttgttgatcttttcaaaaaaaccagctcctagattcattgattttttgaagggttttttatgtttctatctccctcagttctgctctgatcttagttatttcttgtcttctgctagcttttgaatttgtttgctcttgcttctctagttcttttaattgtgatgttagggtgttaattttagatctttcctgctttctcttgtgggcatttagtgctataaatttccctctacacactgctttaaatgcatcccagagattctggtacattgtgtctttgttctcattggtttcaaagaacatctttatttctgccttcatttcattatttacccagtagtcattcaggagcaggttgttcagtttccatgtagttgagcagttttgagtgagtttcttagtcctgagttctaatttgattgcactgtggtctgagagacagtttgttgtgatttctgttcttttacatttgctgaggagagctttacttcccagtatgtggtcaattttggaataagtgtgatgtggtgctgagaagaatgtatattctgttgatttggggtggagagttctgtagatgtctattaggtcaggttgctacagagctgagttcaagtcctggatatccttgttaaccttctgtctcattgatctgtctaatattgacagtggggtgttaaagtctcccattattattgtgtgggagtctaagtctctttatgtatctctaaggacttgctttatgaatctgggtgctcctgtattgggtgcatatatatttaggatagtcagctcttcttgttgaatttatccctttaccattatgtaatggccttctttgtctcttttgatctttgttggtctaaagtctattttatcagagactaggattgcaacccctgcttttattttgctttccatttgcttggtagatcttcctctatccctttattttgagcctgtgtatgtctctgcacatgagatgtgtctcctgaatacagcacactgatgggtcttgactctttatccaatttgccagtctgtgtcttttaattggggcatttagcccatttacatttaagattaatattgttatgtgtcaatttgatcctgtcattatgatgttagctggttattttgcccattagttgatgcagtttcttgctagcatcgatggtctttacaatttggcatgtttttgcagtggctggtactggtttttcctttccatgtttagtgcttccttcaggagctcttgtaaggcaggctttgtggtgacaaaatctctcagcatttgcttatctgtacaggattttatttctccttcgcttatgaagcttagtttgaaattctgggttgaaaattcttttctttaagaatgttgaatattggcccccacactcttctggcttgtagactttctgccaagagatctgctcttagtcttatgggattccctttgtggataacctgacctttctctctggctgccgttaacattttttccttcatttcaaccttggtgaatctgacaattatgtgtcttgggattgctcttctcaaggagtatctttgtggtgttctttgtatttcctgaatttgaatgttggcctcccttgctaggctggggaagttctgctggataatatcctgaagaaatttttccagcatgattccattctccccatcactttcaggtacaccaatcaaacgtagatttgatcttttcacgtagtcccatatttcttgctttgttcatttctttttattctgaaaaattttttttttaatttcagttatgagtaaaaaaaaatctctaaagagatagatcaaaaaacaaaaaccagtcagaacttttggaaatgaaagacacatttagggaactataaaatgcagtggaaagttttaaaaatagactagtccaaatagaagaaagaatttcagagctcgaagacaagtcttttgaattaactgaatcagacacaaataaagaaaaacaaatttaaagaaatgaacaaaatctctacaaaatatggaattatgtaaaacaaccaaactaacaatcttaggtgtcctgagagaaaagaaaaaacaaaatgtttggaaaatgtatttaagggaataatttaggaaaactttcctggctttgttagagatttagacatccaagtacaagaagttcaaataacttttgggagactcattgcaaaaaggacatcaccaaggcatatagtcatcaagctatctgaagtcaatgtgaaggaaaacattctaagtgcagtgagacaaaaggatcaggtaacctataaaggaaaacctatcagactaacagcaaatttcttagcagaaaccttacaagtcagaaaggattggggtactatctttagtatcattaaagagaacaactgtcagccaagaattttgtatccagacaaagtaagtttcataaatgaaggaaaaataaagtctttatcagacaagcaaatgctgatggaatttgtcagcactagactaaccctaaaagaaatgctgaaaggaattctaaatgttgaacaaaaggtcaatacacaccagaatagaaactcctgaaagcacaaaattcacaggggttataaaacaataacacaatgaaggaaaaacagtcactaggtaacaatcaacatgataactcgaacagtacctcacatctcaatattcacattgaatgtaagtggtctaaatgctccacttaaaagatacagattagcaaaatggattaaaaaatcacaaaccaaatatctgctgttttcagcagacaacatggaaggattctcatagactcaaggttaaggggtcgaaaacaatatttcatgcaaatggaaaccacaagtgagaatgagtagctattcttacatcaaataaaacagacttgaaagcaacaatgtaaaaacaaaaccaaaaaatgtagttatataatgatgagaggatcagtacaccaagaagctataacaatcctcaatatatacgtacttaagtccagagctcttagatagataataaaaaattactactatacctaagaaaagagatagacagcaaaacaataacagtggaggacttcaatactccactgacggcattagacaaatcattgaggcagaaagtcaacaaagaaaactggacttaaactgtactctagaacaaatacacaaaatatatttaaataacattatactcaacaagtgcagaatatccattcttcccatcagcacatgaaacattctccatggtagatcatatgataggccacaaaccaagtctcaataaattttttaagagcaaaataatatcaagtatcttctcagaccacagcaaaataaaactggagataaattccaaaagaaaccctcaaaattatacaaatgtatggaaattacagaatctgctcctgaatgattttggggttaacaatgacattaaaatggaaatttaaaaatgtttcaaagtgaataagagtgagtcaacttatcagaacctctgggatatagcaaaagcagtactaagaggaaagtttatagcccaaattcctacatcaaagtttgaaatatcacaaattgcaaacctgacatcacacctcaaggaactagagaaacaagaataaaccaaacccaaagctaccataggaaaagaaataacaaagatcagagcagaaacaaaaaaaaaatacaaaagatcaatgaaacaaaatctgactttttgaaaatattttttaaaatcattagctatattaatcaagaaaagaagagagaagattcaaataagctcgattagaaatgaaaatggagacagtgcaactgacatcacagaaatactaaggatcatttgagtttcctgtagacacttctgtgcacacaaactagaaaatctagaggaagtggataaattcctggaaacaaacaactcctttagtttgaatcagaaagaaatagaattcctgaacagaccaataacaagcaatgagattgaatcagtaatagaaaaaactgctgaaaacaacaaaaaagctcagggctagacagattcacatctgaattcaaaagactgaggagaaagaaatcctccctaactcattatacgaacccagtattaccctgatatcaaagccaggaaagaaaatattagtaaatgaaaactacagactaatatccccaaagaatatagatgcaaaaatcctcaacaaaatactagctgactgaatccaacagcactccaagaaaatcattcaccatgagcaagttggtttcattctagggatggttcaacatatgcgagtcaagaaatttgattcgtcacctaaacagaattaaaaacaaaaaccatatgatcatctcagtagatgcagaaaaagcattaaacaaaatctagcattcttttctgataaaaaccctcaaccaactaggcatagaagaaatatatctcaaaataatagaagccatatatgacaaactcatggccaacattatactggaaggaaaaaagttgaaagcattccccctaagaactattacagaacaagacgaggatgcccattttcaccacttgtattcaacatcgtactgaaagtgctagccagagtaatcattgcaagataaaaaaacaaagggcatccaaattggaaaagaaatcaaagtatctctgtttgccaatgatgcgatcttatagctagaaaaccctacacactcctccagaagactcctagatttgatgaatgaattcagtaaagtctcaggttacaaaaataaatgtacacaaattagtagcactgctatacaccaacagcaaccaagccgagaatccaatcaagaagtcaattcattttacaatggttacaaaaaaaaaataccgagaaatatacttaaccaaggagatgaaagatctctgcaaggataactacaaaacattgctgaaagaaatcatagatgatgcaagcaaattgaaatacatctcatattcatgtattagaagaatcaatattgcaaaatgaccatactgaccaaagcagtctacaaattcaatgcaatttctattaaaataccagcatcattcttacagaattaggaaatataatcctaaaattcatacggaaccaaaaaagtgcctgaatagccaaatacatcctaagcaaaaagaataaatctaaaaatatcacattaccggacttcaaattatactacaaggctgtagtaacccaaacagcatggtagtggtataaaagtagatacatagatcaatggatcagaatagagaacccagaaataaagtgaagtacttacaactaattgatctttgacaaaccatacaaaaacataaactggggaaaacacatcctattcaataaatggtgctgggaaaattggattgcctaggtcgtgtagaagaatgaaactggatttctactctcaccatatacaaaaattagctctagatgggtttaagacttaaatctaagacttgaaatcataaaaattctagaagaaaatctatagaaaactcttctggacaatgatttaggtgactaaaacctcaatagtaaatgcaacaaaagcaaaaataaatggaacctaattaaactaaaaaacttctgcacagcaaaataaatactcatcagagtaaacagacagcctatagaatgggagaaaatatgtactaattatgcatctgacaaaggactaatatctaacttgggaaaaaagatttttaaaaaagttaatatctggaatctacgaggaaataaaacagatcagcaagaaaaaaaaaatgaataatatcattaaaaagtaggcaaaggggccgggcacagtggctcatgcctgtaatcccagcactttgggaatccgaagcaggaggatcacgaggtcaaaacatcaagaccatcctggccaacatggtgaaaccctgtttctactaaaaatacaaaagttagctgggtgcagttgcacgcacctgtagtcccagctactcaggaggctgaggcaggagaattcgcttgaacctgggaggtggaggttgcagtgagccaagattgtgccactgcactccagcctggagacagagtgagactccgtctcaaaaaaaataaataaataaaataagtaggcaaaagacattaatagacatttctcaaaagaagatacaaaaatagccaacaaatatgaaaatacactccataccactagtcatcagggaaatgcaaattaagaccacaatgagataccaccttatgccagccggaatggccattatgaaaaagtcaaaaaacaatagatgttgatacgaatgtggtgaaaaaggaatgcttagacactgctgatgggaatgtaaaattagtagaacctctatggaaaacagtatggagatttctcaaagaactaaaagtagatttaacctagcaatcccactgctgggtatctacccaaaggaaaagaagtcattatatcaaaaagacacctgcacacacatgtttatcacagcacaattcaaaatcacaaagatataaaatcaacctaaatgcccatcaaacaatgtgtggataaagaatatgtgatatacctgaggtcaggagttcgagaccagcctggacaacatgttgaaaccccatctctaccaaaaatacaaaaattaggtatggtggcaggcgcctgtaatcccagctactcaagaggctgaggcaggagaattgcttgaacctgggaggtggaggttgcagtgagccgagatcacgccactgcactccagcctgggcaacagagcaagactctgtctcaaaaaaaaaaaaagtgctatatcacatatatatatatgatatatgtaattgtggtgtgtggatatatacaccatggaaatatattcagccatgaaaaagagtgatataatgtcttttgcagtgacttggatggaattggaggccattattttatgtgaagtaacactcaggaatcaaaaatcgaatgccacatgttctcacttataagtgggaattaagctatgggtatgcgaaggcatacagagtggtaaaatgagcgttggaggctcagaagaggggaaagtggagggtgagaagtgggtgagagatgaaaaactacctattgggtactatgtacactacttgggtgatgagtgcactaaaatcctagacatcacaactatacacacataaccaaaaaccatttgtacacctaaagctattgaaataaaagaatagtaaataaataaatttaaattctctcttctctcttctctctctcttgcttctgttcttgccataagatatacctgctccctcttttccttacaccatgattggaagcttcctgaggccgtcaccagaagtagatgctggcatcatgcttgtacaccctgcagaaccatgagccagttaaataccttttctttgtaaattacccagcctcaggaatttctttgtagcaatgcaataatgaactaacacaaattccaaagaaagtcaaacattgaaaagcaagcactagtaactagcatttcaaatctgtgaaataaaagataccaaattataaacaacagtggaatcttaccactgataaatacagctctggttactgttgttcactttctttctatttccaataagaaaaatcaattttgttaaacttaaatatgagacacacccagaaagatgcaagttgtgcccacacaagttgatgaagtttggcagttgggttttctgagacccactgagccaggctgcagctaatttgtcccaactgcctagcagcctgatgcacgaacagaatctgatccaccaggaccactggcctctactctgaggagtgtctacaggagcatggtcactacagacctgatgtggagattgacaaattacaacgaaatcaacccctgggggagctggtgatgtttgtagcacacattggtcactgccacccagataatccaagtcacttttttcaattgctgaacgatctgctgtgctacagccacaccgtcttggatccagaacttcaatgacattttgcaaatctttgatcttcctttgaaataagaatcacagcattcaaagagttgcagttacaagcttctcagaaggcttgtacactcagagtgtggctgatatcaagaatataaatgtaaaatacaagaacaataaagtgaatataggatttcagaattccacgcacacctaagagacagcaatgccatcacagctaaaatatccttgtgtgtaatgattgaactcaatggaagaaacatttggaatgctgcccaaactgtcagtgttatcttaagtgtgtgtttcactaaagtcaccaagatacaggctgctgctttgaaattcttctaaggaaacggggtggcaactcaggatctgagtatgaaggaccttccagcgtagatgccacagggaggagaagcttcaaacgcaaggctggaacaggctttggaagtgctgatactagaagaagaagaagaaataaaagaacagtagcagagatatttaaatttccagccattacttgattaatgatcctcaaagttctgcagaaaaatgactaaagcagctggagagctgtaaggagaggtatgaagtgaggctgatgcccaggaacctaatctccagattggtggaaatttatgggctttttctcttttgtgttgatcctctcgtgcggagatttctgcagcctaatcgaagagaagtaatcagatccttctgtctgctccacaagtaggtggccaacaattctgtaagggagaggagccctggggtgtcatgacagtaggaatcaatgctataaaaaaagtaacaacttgataccctcacattgtgactaaagaaccccccagttttggcccagtgaggaatacacaaacataaagatgtgatcatttctgctaggattttgattctgttcttctgagtgccaaattctcagatactacagaagagattctgagacaagcctacagaggcctcaaaagaagcaagagtgcaagaatatggataactaaatgctacagattacatttcaggagggggaattctgaagtcaagaaagagaatgttgtgaacagtaaagaagggtggggaagtaccagtcctgaggaggagggagatgcccatggtgggtgggttgacgtgtgtcactcttctgtgaaaaacagcagggactttccaaggaggtgcccagcatgcctgtggaggaggagggagccaaatctgctgccctcagcaccagttgccttctaagccaggaagacttccagaaaatctacatggcccaactgtataatgaacccagggctgccctgggaaagccacaaactgaaagatactgaaataaacagcattgatgggccaagagacaagttactgtcagttgaggatattgaacgctttaaaaaaaaaaaaaacactcatcttcaggaagactagccgctgcagtggctggaaagactgactgaaaagaatatgttagaaagaaaaccaatatgagtgcagtttccagtgccccaaataaagagaagaaaactaactttatatgataatgtattatagccagaatgtccagtcaaaaaatagatgttccttcagaaaaaaagcaactggcaccatgagatgtacttttggaaaaaagggaaatagaataaattatcttccaaaccagtttttcattccaaggataatgctgaatttgtgtaattgctctgaatattagtcaatagtcaatccaaaaatatttgcttatgtttaaaagtacagagataagatatttttgaaaaccacagtttgtaaaaagataaagggaattttatttgaaggacaggataacacagtggctattttggagggtgtgtgctgcagtggggtgcatgcatcgttactattggttgcagactcagatctgaacaaaaagatatagtcaagaaagtgtgacttcttcatcccgtctgcctcagtccccagccccttcctacctcttgctcacccacaccctctcagtagccagtcttttccattttaggtttatccatcctccatttcatttgcaaaaaatgaccacatatatgttttcttaggctcccatcatacttacatgaggatagcatacggtaggtagtcttttgaactttactttttcactgaatagtatggccctcaaaattactccatattaattcataaacatcttccttattatttttcacagctgcatagtaccctattatgtggagttgccgtgattattcagctattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagctgggactacaggcgcccgccaccatgccgggctaattttatgtatttttagtagagacggggtttcaccgtgttagccaggatggtctccatctcttgacctcgtgatccacccgcctcggcctcccaaagtgctgggattacaggcgtgagccacgtgcccggctgtattttgttttcttggaggtatatcctcagggtagattcctagaagtgggattgtggatatgtacatacttagttttgttcagttttatcaaattgtgctctagaagatggtaacaatttagattcccagcggcggtgtaggagagtatattttctgacagcctcagacaacacaatgtgtctaaattatttccagtctcacaggtgagaaatggcatgtcagtgttgctttaatttgcatttctgtaatgatgagtgtgtttgaacatttttttcataagtttgagggccatttttgtatctttgttgtgaattatctcatgactctttttccatttttctatcagaattgtcattttttattcctcagtagttaagaattctttaccaattaggcattttaactttctgcccagggtatatgttgctaagatttttctatccaatttttaagttgtcgtctaacttaatcaggtattttaaatcatgtaacacttttatttttacttgttattgttatgtattcaaacatagaatctttttttcattgcctctagatgttgagtcattgcttgaaagacttccttgtaccaaggttataaaggaattcacctatgttttcctgtagtgtttgtatgatttcactttttaacacttagttccctaatttatgtgaagtttattcttgtgtggtatgagatatgaatctaaatttatcttttctaagttgttatctgaacatcatttacttaaaagtccatccttaggccaggtgcagcggctcacacctgtaatcccagcactttcagaggctgaggcaggtagatcacctgaggtcaggagttcaagaccatatggagaaaccccgtctctattaaaaatacaaaaattagccaggcgtggtggcacgcgcccgtaatcccagctatttgggaggctgaggcaggagaattgcttgaacctgagaggcagaggttgcagtgagccgagatcacgccactacactccaacctgtgtgatagagtgagactctgtctccaaaaaagaaaaaaaagtccatctttaaacttgaaatgccgtcattatcatatactagatttccatgtctatcagagtctaattattactttatcccactagtccagtggtgtccagtcttttgccttccctgggccacactggaagaagaataattgtcttaggccccatataaaatacactaatgatagctgatgagctaaaaaaaaaattgcaaattaatctcataatgcttaaagacagtttacaaatttatgttgagctgaattcaaagctgtcctgggctgcatgcagccggcgggctacaggttggacaagcttgcactagtctgttcgtgtttccatgcctagataccacattcttttaattatagagacttcatggtatgttttaatgtctagtggggctggcctttcttgtgttttctttttccaagctattcttgtatgtttgtttttacatatgaacttttgcatcaatttgctcattctataacatagtttattggcattattactgtattgcattgaatttataaattaactctggaagaaatgacatcctataatgttgggtcaccctatccaagaatgcggaatgtcttttcatttattcaagtgtctttcagaagtattacaaatttttcctcatatatttttcacacacatcttattaaatgaatttctaaatttttaatcatctttgttgttattgtaaatggcactttctccactattatttattttaacttttgtttgtatgtattcaagttattggttattgtatgttaattttatatcctgccagtttgctgaattttttattagttgagttacttttatcagagactttggggtttgtcagatacactattatatcatctgcaaatatacaatgttactttactcaatcacacacctctaactgattttactttataaataagtttcattgactaaaacctctgctccacaatgttgagtagcagtggacaaagtggatatccttgccttgtttccaatcttagtggaaatgcttctagtctttctgtattaagtaaaatacttgccttagggttaaaatacatcattttaccatgttaagacagcatccctcaatgcctattttctagaatgttcattgatcataaatgtgtgctgaattttgccaaatactttttcagcatctatgaagataatatgatttatttttattagattaattagtatgatgttaatcattcctcacttaaagtcaatcttgcattcctggaataaatctcactttatcaaggtatattattttcttaatgtggtgttgcgctgtgcttctttctggtacttctatttagaattttttgcattcatgagtaatactagcttatagtatttttttccttatgcttgcttttctcatttaagtatcagtgctaagcttacttactttcaatactctggaataatttacagagcattgtgactatccagcttttgaaagtttgttagaattcgcttgtgacaccatctgtgcttggttcttttatgtggggtagttttttaacttccccatttcttgtataaacacaggtctgatcaaactttctcatttaatgagatcaattttagcaatcactatttccctgtggaactgcctgtttcatcatggttttcaagcttatttgcagagttctgcatagttgtctctccttttttatttcttctaattcaatggttacttttcacttgtcattccatgtgttgtgtatttgtgttttctcatttttatcaacttagctagtgttttatttattttgctaattttctcaaaaaacagaattttgatttattagatctcttttatactgttttcttccttgttaatttctgcttctatctttattatttccttccttgtgctttcttttgactcactttgttgttctatttctaggcttttgaattacgaacttagttcttttttttttttttctaaacagaattttcgctgtgttgcccaggcttcagtacaatggcacggtctcagctcactgcaacctccgcctcctgggttcaagcaattctcctgcctcagcctcccagatagctgggattacaggcatgtaccatcatgcccagctaatttttgtatttttagtagagatagggtttcaccacgttggccagtctggtctcaaactcctgacctcaggtgatctgcccacctcagcctcccaaagcgctgggattacagatgtgagctaccacgcccagccagttgatatttttattgacagagatgtttagtacaatgaaatttcctcttgtcactgctttacatgcatgccacagattctaaaatatagtgttttcaagtcataattttccttaattctgtaatttctgtttgtatttcacccaaaagttatttaaagagagacttttaaatttctgggtgaatgggtctttttgctttttatttgtgtcagcaaattctagatttattgtattgtgtttagggagtattatgtgtggtctttctacgttatgaaagtcattgatgtttgtttaccttgtgccctgatgtgtgatcagtttcagtgaatgtgccccgggcacttgaggagagtgtgcatcctccattatcaggacttcaccgtcagtatatgtcataagacttgccttgttgagttctttttaggtcatctcctcacttgttattccacttgacctgtcttgtactgaaagttgtgtattaaatctagcattattagtgtgttctgtgggtcctcacatcttttatttttgtttcataaaggtggtgtctgtgatatttgcgggataggtatttgtaaatattatgtctgtgttgtgggttgtaattttagcattaaaaatcttttttgtcatatttaacgcttttgacttgaattccactttgtctgatatcaggatttttatcccagctcatttagtattcatttcctgcattacttttgtccattccttaagtggcttctcactaagtctcctcatctgtcctctccgtggccttcactcaccataattcctgtgatggagcaggtgtgtgagaagttgtagtcctggcacttgttaatttttctccctcaactcacagttctgcctttaagtaatgcaagggtgtgtttttctttctttctttctctttttttttttttttttttttttttgagatggggtcttgctctgtctcccaggctggagtgcagtggtgcgatcttggctcgctgcaagctccaccccccaggtgcaagctccaccccccaggttgacgccattctcctgcctcagcctcctgagtagctgagactacaggagcccaccaccatgctcggctaattttttgtatttttagtagagacggggtttcaccgtgttagccaggatggtctcgatctcctgacctcgtgatccaccggcctcggccttccaaagtgctgggattatgggcgtgagccactgtgcccggtctgtgtggaatttttatggctgtgaaactattccttagagtatggggatgaccttttgggaaactgattactatatagccagcgtggtcatcagccacccagaagtccatccttttccaatttaataatgctatgaaattttaaaaattcatagcattattttaatggctatgtaatatttcaaggaatacatgtataataatttgattcactaattgaaattagattttttcagttcagttaatgccacaattcataattcaggctacccttttatatttaataggttatacaataaatttttgttaaataaatgaagagaggaatgaataaaagattgtgtaggatgggatgggctgagaaaccagttggcaggtaggatagtgttctaatggatggaatatatatatatatatatatatagaaatgaggacgttgtttaacctttacaatgattgattattacagtcagggtttccagatggcagaagattggttaaaagtgatcatctggctgggtgcagtggctcatgcctgtaatcccagcactttgggaggcagaggtgggcggatcacttgaggccaggagttcaagactagcctgggcaacatggcaaaactccatctctactaaaaatacaaaagtcagccgggtgcctatagtctcagctattcaggaagctgaggcaggagaatcgcttgaacccgggaggcggaggttgcagtgagctgagatcatgccactgcactccagcctgggcgacagagcgagaccctgtctttaaaaaaaaaaaaaaagtgatcatcttacagcatttttggaaggctgtgtaagttttgcatatgattatcagggacatttactagaaataacctaagtttcactggcatagcataactagctttgtctgctcaggaaattctcaagcctggtctcttattttatttcattttattttatttaacacaagtaaaggtcattagtgccaggcttatgaagtagaactgtataatacaagattttgccacaaaagtagtagagctaacaagcacagctttgtgcttccagcccagtcctttctctgtgataccacatttgcaacagcagaatatacgtttccttttttttaaaggactttgcaatatttgtttctaaatgattttattttaaattaaagatatcctgaggaacaaaagaagtttgctaatgagacacattgtatataaggaagaatttgatggtattttcaccagaaaaacccttaagctaatttcccaaacttaattaatcagatcacaaaaccattaactttttctctttgtaccaaagcctttcattaaaaatggtgctgtacagatagctcttttcttatcaacaaggtagaatttaaattttatttcttaaagacctctactgcaaaagacgattacatcctcagctctaatcaatgtccaactaggttaaaaaaaaaaccgctagaatattaataaaagttagaagattaattacaaactccataactattgaagaaagtgcagttgcctctgaagtggaaagcgtatttaaatttaaacatgcagggtctatttttaataaaatggaggtgggattttattcaccgctatgcctttgctcaagtagtttcctttacctggagatccctgttcttccttcatcagggaagcatgaacgctttcttttttagttttctttttttttttttttttttgagacagagtctcgctctgttgcccaagctggagtgcagtggcctgatctcagctcattgcaacctccacctcccgggttcaagcaattctcctgcctcagcctccccagtagctgggactacaggcgcacgccgccacacccagctaatttttatattttcagcagaaacggggtttcaccgtgttgcccaggttgtcgcgaactcctgatgagctcaggcaatctgcccgcctcggcttcccaaagtgctgggattacaggcgtaagccaccgcgcccagcaggaagcatgaactctttcttccaaatcagttgcaggcatcgcgtctccggacgctgctcttagcctcgatggatggaccatggattcctagtcaagactctctcatgcttgcatcccaatgcttagcaaattgtcctgaaaccaggcttacatgcttttctttttagtgaaccacagaattctttaagctgtgagctatatctcactcatttgcacattgtcaatgcttagcacagaaccttgtacataaaaagcatgcaatagatttgtattgaatggaaccattcactttcctgcattttctttgatttgaggaacagtttatgtggatttgctgctcagacttactatgaaaataaacttatttgttgactattttattgatataataactatagaaaaaaaattgtcacagttcaaccccttatacttaataaggcctcctagaattgtaagatgaacctctagtgagcaaaacagtgaactcttactggattaattattccaattatttctcaattttaaagtcagataacttgatagtcaccattaaatgcaaatcagtgtttatataataaatacataggcatatcagtgacccagaagagataaacaggaactctgagtctcagatggggaaaataacattacaaataccaaaaaataaagtgaagcttttaaaaaaaaaaaggagatgtaacatagagaaaaaagtcaactttataactggcactcttgccaaaaatatttatttatttaaatgaagactcactggagggttttaaatacaaattaataaaattaagaacacttggatgaccatgtccaaaacggatcaatgcattaatagaaaggctttacttaatgtctaccaggtatccaaaaatttttatgagaactgttagggtcagaggggacacacacaaaaaaaattataacatatgacttattttctcaacttccttttttttttttttttttggagaggtagtctcactctgtcgcccaggctggagtgcagtggcgtgatctcggctcactgcaagctccgcctcccaggttcatgccattctcccgcctcagcctcccgagtagttgggactacagatgcctgccagcacacccagctaattttttgtatttttagtagagactgggtttcaccgtgttagccaggatggtctcgatctcctgacctcatgatccgcctgcctcggcctcccaaagtgctgggattacaggcgtgagccaccgcgcccagcctaatttttgtatttttagtagagatggggtttctccatgttggccaggctggtgtcaaactcctggctctcaggtgattggctcgccttggcctggcaaactgctaggactactggtgtgagccactgtgcccagcctcaacttacttttacagataagaatataggccagacatggtggctcacacctgtcatcctagcactttgggaggccaaggctggcggatcacctgaggttaggagttcgagacaaacctggccaatatagtaaaaccccgtctctactaaaaatacaaaattagccgagcgtggtggcgcatgcctgtaatcccagctactctggaaggctgaggcaggggaatcacttgaacttgggaggcggacattgcagcaagcggagatcgcaccattgcactccagcctgggcgacatgagcgaaactctgtctcaaaaaaaaaaaaaaaaagaatataaagctaacataaacaaattggggaactcctaatttcttaagtagatgatgaaggctgtgctctaggaagattaatccatgaggcctgggttagaaagtgtggaagcatcaaagaggaattggggaacacataattatgagtgcctgaggtgcgtgtgtagctgagtgagtgggaggtgtgacctcaccctcacatgtctggatggcacagggtgagtgagcacccacaaaacacctgctgaatagatgaaagagctggaaggcaatgggtctagagctcaggtgaagggcataaccttggatacaaaagtgaaacagaaggcatggcaaagacaaaaatgtcttaggggaagggcaaaaacaggaaggtgttcttccacagtgatgcctgttttccccgtggggtaaggggtgagcagcccttctgagaataatggcagagaaaagtttcaggatatgatttatcttctaggttaactttgaccattaaagtgagccattcgtaagatggtctttcacaaatctcacatttcagaatgcaagattcttaggtggttaataaccaaaagaatacaagtttaaccatgaataggaaaactatattattttgggcaagtatttaaaatcttaaagaagaaactcttaaataatgtatttgtacatatattgatataggttaacatatgtttgacacaattaattttaataatacaatagatttagacttaaaagttgcaaagtttaatcacagaatcaatcaataccactaatggtaacaaataccaagtctttagatacttggtattgtagggttgacgtggcatgtgtaaaaatagagatttggacactgcttgtagtgaacagtttataataaactgttttaattcttcaggtcccaaaatggtagaagtccagaatcaacagtttcagatcaactccaacgacggcaagccactatttactgtagatgagaaggaagttgtggttggtacagataaacttcgagtaactggtatgtactaactcgagaaaaacacaacattccatggagtacacatctgcaaaaacacattgtactattgacaagtttatgtggaatctttcaagcagataagagagtttgaatgtgttgcattttctccattgcatttctgttgaactccctcgatgctctcctagaagaacaaaatcctccccacagatcttggcccacccttcttccatcacagttttaccctttgtcccttccttcctcccttccttcttttttttttctttttagacagagtctcgctctgttgcccaggctggagtgcagtagcacaatctcggctcactgcaacctttgcctcctgggttcaagcaattctcctgcctcagcctcccgagtagctgagactacaggcacccgccaccatgcctggctaatttttgtatttttcgtagaggcagggtttctccatgttggccaggctggtctcaaactcctgacctcaaatgattcacccaccttggcctcccaaagtgctgggattacaggtgtgagccacaacaccctgccaccctttgtctttttctaattggagtaacccacagactcatcaaatgtcactattatctgtgcagttcaagtacctgtttcccaagtttcttttattctcatcacatcatgtacttgaattactcatatttctacaaaaaaaagttctctttttgaactaaaagttgaataggggtctcatagcactcatttttaagactgagaagagaaaattttatgaaaaaaatgtttcagaacatattctaaattcacttgccaaagactagaagacacaggcagatacttgttaaatctatcccagtgcctttctgtactactgtgaaaaccaatagcaatgttattgtctcacacaatactaccaatactcccaaatgaaaaagaaataatatttcctggccaaggaagtagactccaccctattacaggccctaacaaactataaagatcataacctaatgttgcatactctaagacagtaatgtatctggttttgttactaaaatgaaggacactagcgcatttaattaacggaaattggtaattgtccaacaaagcaccttaagcatcagaaatgcactgttgtgtaggataaagaatatgggctgggtagacttggattccattcctacctctgcaattactagctgcgtaatttcaagcaagttaatttttattttctgtttcctaacttctaaaagtgagttgataatatcaactgtactatcattgctgggttaagtggattaaatgtgcaaaggacagcagagttcttggtagagtatcattgtactgcagggcagtgaaatctgcagggaaaatagtctaacagcttagttcacttcaaacccaagccctcctactcagagaatcaataagatgaacttttccttagcccagggctccttccgggccatgacatcaattagaggaacaggtgagaaaaattgataagcaactgtattatttattacctgtatgcatgcatcagagccatccggagggtttgtttaaaatatactgctgggggccaggcagagtggttcacacctgtaatcccagcactttgggaggctgaggtggatggatcgcttgagctcatgagtttaagaccagcctggacaacatggcgaaaccccatctctacaaaagaaaaagtacaaaaattatccaggcgtagtggtgcgtgcctgtggtcccagctacttgggaggctgaggtgggaggatcacctgagcctgggaggcagaggttgcagtgagcagagattgagccactgcactccagcctgggcaacagagtgagaccgtgtctcagtaataataataataataataataataataataataataataatagtgctgggcctcatccccagagcttctgattcagcaggtctgaaatgtgacttgagaatctgtgtttctagagagtccccagttgctgctgatgccacagctctggggaccacactttgagaaccactgctgtggactaacatgaatcagcaggagaaacaacaggtcagcaacatgttgacgctctctgtagaagagcagtccccaaccattttggcaccagggactggtttcatggaagaaaatgttttcacagtgtgggagatggttttgggatgaaactactccacctcagatcatcaggtattagattctcatcaggagcacgcaacctagatcccttacacatacagttcacagtagggttcgcactcctatgagaatctaatgcctctactgatctgataggaggcggggctcaggcagtaacgctcgctggcccactgctcacctcctgctgtgaggcccagttcctaacaggccacaggccagtatccgtctatggcccagggatccagagtccctgctctagaacatgctttcaagttatccttttaaaggacaagttataatcttctctttcataatttttttgcctgaggcacaattttctcccaaactcctcctctgaggtgcagctaactagagcaaaatataccccacctctaatgactatatgctttccttgttattttggtgttgcaaacatttctagttcttattgccagagacaccatgaactgtgagtgtacagacagtacaattttgagcagaccataactcttctcaattttccagtatgttaatggcttccttacattttgtgattaaagaaaccaagagattccacggttttgatggttcgcttcttgttttgtctctatccaaggtctgactctctaaacattgtgtagtgcaggctttgtcgatcttaacactgtttttttgttttaaacttttactttaagttcaggggtacaagtgcaggtttgttatataggtaacttgtgtcatgggggtttgttgtacagattatttcatcacccaggtattaacccaggttattagttatttttactgatcctctccctcctcccatcctccacccttcagtaagcctcagtgtgtgttgttctcctctatgtgtccacatgttctcatcgtttagctcccacttataggtaagagcatgcagtatttggttttctattactgtgctagtttgctaaggataatagtctccagctccatccatgtccctagaagggcatgcatgatcacattctttttaatgactgcatagtattccacattttctttatccagtctgttactgatgagcatttacggtgattctatgtctttgctattgaacctcagcattgttaacattttgggctggataatgtttttggtggaggttgggggagactgtcctgtgcattgcaggacatttagcggcattcttagccatttagtggcatccttagccagtagtcattcaggagcaggttgttcagtttccatgtagttgtgtgcttttgagtgagtttcttaatcctgagtcctaacttgattgcactgtggtctgagagatagtttgttatgatctccattcttttgcatttgctgagaagtgttttacttccaattatgtggtcaattttggaattagtgtgatgtggtgctgagaagaatgtacattctgttgacttggggtggagacttctgtagatgtctattaggtctgcttggtccagagctgagttcaagtcctgaatatccttgttaattttctgtctcattaatgtgtctaatattgacagtgggatgttaaagtctcctactattattgtgtgggagtctgagtctctttgtaggtctctaagaacttgctttatgagtctgggtgctcctgtattgggtgcatatatatttaggatagttagctcttcttgttgaattgattcctttaccattatgtaatgcccttctttgtctttttttatctttgttggtttaaagtctattttatcagagactaggaatgtaatccctgctttatcttttttccatttgcttggcagctcttcctccatccctttattttgagcctatgtgtgtttctgtacatgagatgtgtctcctgaacatagcccatcaatgggttttgactctatccagtttgccagtctgtgtcttttaattggggcatttagcccatttacatctaaggttaatactgttatgtgtgaatttgatcctgtcattatgatgctagctgatcattttacccattagttgatgcagtttcttcgtagtgtcaatggtctttacaatttggtatgcttttgcagtggctggtaccggtttttcctttccacatttagtgcttccttcaggagctcttgtaaggcaggcctggtggtgacaaaatctctcagcatttgcttatctgtacaggattttatttctcctttgcttatgaagcttagtttgaaattctgggttgaaaattcttttctttaagaatgttgaatgttggctcccactcttttctggattatagggtttctgcagagacatccactgttagtctgatgggcttccctttataggtaacccgacctttctctctggctgcccttaacatgttttcctttatttcaaccttggtgaatctgacaattatgtgtcttggggttgctcttcttgaggagtacctttgttgtgttctctctatttcctgaatttgaatgttggcctgtcttgctagtttggggaagttctcctggataatatcctgaagagtgttttccaacttggttccattttccccatcactttcaggtacaccaatcaaatgtaagtttggtcttttcacatagtcccatatttcttgatggctttgttcattccttttcattcttttttctctaatcttgtcttcatgctttatttgattaagttgatcttcaatctctgatatcctttcttctgattgatcaattcggctattgatacttgtgtatgcttcacaaagttctcatgctgtgttttcagctccatcaggtcatttatgttcttctctaaactggttattctagtagcaactcctctaaccttttttcaaggttcttagcttccttgcattgggttataacatgctcctttagctcagacaagcttgttattactcaccttccgaagcctacttctgttcaattcatcaaactcattctctgtccagttttgttcccttgctggcaaggagttgtgatcctttggaggagaagaggcattctggtttttggaattttcagcctttttatgctggtttttccttatcttcctggatttatctacctttgctctttgatgttggtgacctttggatggggtttcatgtagacgtcctttttgttgatgttgatgctattcctttctgtttgttagttttccttctaacagtcaggcccctctgctgcaggtctgctagagtttgctggacgtccactccagcccctgtttgcctggatatcaccagtggaggctgcagaacagcaaagactgctacttgttccttcctctggaagtttcgtcccagaggggaacctgccagatgccaggcggagctctcctgtatgaggtgtctgtcgacccctgctgggaggtgtctcccagtcaggaggcacaggggtcagggacccacttgaggaggcagtctgtaccttagaatagctcaagcgctgtgctgggagatccgctgctctcttcagagctggcaggcaggaacatttaagtctgctgaagctgcacccacagccgccccttcccccaggtgctgtcccagggagatgggagttttatctataactccctgactggggctactgcctttctttcagagatgccctgcccagagaggaggaatctagagaggctgtctggctacagcagctttgtcgaggctcggtggggatccacctaggtcaaccttctcagcggctttgtttgcactgtgaggggaaaactgctaactcaaacctcagtaatggtggacgcccctcccctcaccaagcccaagtgtcccaggtcaactttagactgctgtgttggcagcaagaatttcaagccaatggatcttagcttactaggctccatggggatgggatccgctaagctagaccaattggctccctggcttcagccccctttccaggagaatgaatggttctgtcttgctggcattccaggtgccactgtggtatgaaaaaaaactcctgcagctagctcagtgtctgtccaaatgaccacccagttttgtgcttgaaatccagggccctggtggtgtaggcacctgagggaatctcctggtctgcaggttgcgaagaccatgggaaaagcatagtgtctgggctgaatagcaccatccttcatggcacagtccttcacggcttcccttggctaggcgagggagttctccaaccccttgcacttcccaagtgaggcaacaccccaccctgctttggctcaccctccgtgggctgcacccactgtctaaccagtcccaatgagatgagccaggtacctcagttggaaatgcagaaatcacccatcttctgcattaatctcgctgggagctgcagaccggagctgttcctgtttggccatcttgccagacaccaccaaccaacaatgggtaactttttgagaattagactgagttccaatcccagctgttccattaagtaagcacatgacctcaaatgaatatttcacctctcagtgctttatactacaaagatctgtagccactggtctctcaccattacaggacagtatacagaattcaacaaagcagatgcaaattgatcgtgaaattaaattgcatgtcttgcaaaagatgtagggtttaggaagtcagaaatgatgagaaatactggaattgctggcaaagccactaacaaaagaccaggaaagttagacttgccagcaactaaagaagtgaaaatcagccatgatgatgacatgatagtcatttcaaagatcggtaaccttaacttcacaagattaatattcactcttgtgatgactgacaatgccctcaatttaactattacagttgttcctcattatcttcaggggatacgttcaaagagccccaggggatacctcaagctgcagatagtactaaaccctatatatgctgcactgtgttttttcttatacatacatactgtgataaagttcggtttataaatgagacccagtaagagattaacaacaatagctcataataaaataaagcaattataaaaatatactgtaataaaagttgtgtgaatgtcatctctctctctgtctcagaatatcttatttgactgtcctcacccttcttgtgatgatgtgagatgagaaaatgcctacatgataagatgacccgaggtgaatgatacaggattgtgtatagtgcttaacacttatgaattgtttatttctggaattttccatttaatattttaggacggtgggtaactgaaacctcagagagcaaaattgcagaaagtaaaactgtgataaggggggactattgaattatagctttatcgccaatggtaaacatttagtgaacaatgtcctattgtgccactagggtaggcagaattctaaggatgcccccactgagccctgtatatttccttctcctttcagtgtggatggaatctgtaaatatgagatgtctctcctgtgattatgtcacttatatggtaagaggaaggtaatctgggtagcccaatctatcccatgagccctttataaccagagaggttaatctggctggtagtagagggggaagtcagataaattggaaaagcaagaaaaattcactgctgtgttgctgaaggaagaaagagggaccatgtgacaagaagtggtggcctctagaaagggaaagaggcccttggctggcagcaggaaacaagaaatgagcctcagtcttgcaagcacaaagaactgaatgaattctgccaacacctgcatgacacagaaggtagagtctggccctgggcttccagacgagagccctgccttgctgacacctgtgagaccctgagcacagaacctggtcagacactctgggtaggacctgaaaccaacagagctgtgagctaacacatgaggatcgttttaagtagctaagtttgccataattcctaacagaaatagaagactaaatagagccatcctacaactccaactatgtttgaaaaagtgacaccaaaaaacttgacttattcttttttatttcatataatttcacagttttttgttaccattatgaccagggttttttgtttgtttgtttgtttgttttgttttgttttgagacagcgtcttgctctgtggccaggctgggtgtagtggcacgatctcagctcactgcaacctttgcctcctgggttcaagcaattcccctgcctcatcctcccgagtagctgagaatacaggctcatgtcaccacgcccagctaatttttgaattttcagaagagatggggtttcaccatgttagccaggatggtcttgatctcttgacctcgtgatctgcccgcctcagcctcctaaagtgctgggattacaggcgtgagccactgcgcccagccaataagaatgtttttataagctttaatgcttccacacaaattcccattaaaacttttctccactacctgtgataacagttgggtccctatttcaagtggattgactccaggtagcctttggagtttctcaggtcagcaaacgcaacagtagttgacagccaaggaaagagaagtgataggaaaagagacgggcagcctcactctgaggactggaaagaaaattcaattctttgcttcttttctccgcccttgtcacttgcacagcagcccatagctctggtgaaaggggaagataaggtggctctctccttaagatggtgcactcgaaactcctgactgcaccaagtcctaatcctgactcaaattgccattctttgagcaattaagacaattgctgttgctattatcttaattactcaaataagctaaaacctctctttaattcttaaacagcttccatttagattttagtcaactaggatactgaataatagtttttaagcgaaatttatggaagcgattaaacaatttcagcagttcagtctgaaaccaatttaggcctttaagcaggctcatcttcctcccccacaaaattagacaccaagtggccaaagttaacatttcttttattaactcaagttacagaacatactattggaataacatcaaaatgttgtcttcaaaaaactattctacaccattgccagaactgacttctggcagatgacaaattgttagtttggctgccctaagtgtattttagctccctggcaacaatttgctaggctcagtccatttcccaatattatctttaaaaacagagttctataatagtatccatttcccaccactaataagaaaaaataagatctagcaatagtcccaattccatttctttatgccttctgtgcagctaagcaagatcacataaagtcaaaagtgatagtgtagaaatgccagagtcacccataaagccagtgacaaaaatggacctggagaacaaagtgttcagcaactgaagaagtgaaaataaacaaggatgttaagtcgaaaaagacgtgaagacagatatctggaaggtgcttttaggagtaccatatccttcaaacacatacccaagggcacagaacactgtctgatgcagcactgcacgcagcgatcaacgccgtgctgcagtccatggtatttcagctgaaaggaacaagagtcccaattaaaacaggcttaaactggaaggacatgtattatctcacataggaaggctggggaaagggtaactccaggttgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgagttttaatgtggaatttaaaactcacattcattgtgataagttctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcattatacatcttaagatcaatccaaccattacaaaggaggttggaggaaagaatggaggcagtaagaccagttaggaggatgtcaattgtagtacacgtaatcagcgaaggtgacctggattgggtggtagcaatggtcagagagggaagtgaattactccagtttaagatctgacagctacagacttgcctatgaatcgggtgtatggcaggcagccaggaggagactcaaagatgatatttgttttggttgatggcattactctctgggtaacggagaggcctgaggaggaggagaattcatttgcagggcagacagcatcaacagttaatattttagacacgtaaattgaagataatctgggaaaactgccaagtgcatgtcatgtcagctattgggcatgtgagttagctactgctcagagcagaagtctagactagagataaatgtgggtgtcatcaaccaactgagctccaaaaaatgccaacagtagaggccaagtaaaggcagagcagccaccaaaggagaataagggacagacaatgcggtgggagggatattacgataatcgtttttctggtgtcaagagagactattttctcagaatttggacccaggagagatgacagaaattgtcattggatttattattacggaagttattgctatcttaaggagagcatttttcattggagtaataaaggcaaaaggcaggttgaagtggttacaaagtgaataggacgggaggcagtagaggcattatgtggtgacattaagcggaagtttggctgaacgagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaatattgaattcaatgtatttctataattgaaggaacctagaaacagcagtatgttgcaaagaatggaacaacttagagttatttgccgttcagttgctgagctctgtccaagagcaccctgattgctgggctctgtaccatgatcttttcaactgccttcatgaccgtctcaatccatcttgcaccacagtcttattacagatcttcatgtgagcatcattcatcatataatgctctaggatccagaagggaagaatggtgttgtttgagtactactccttcacagtagaattggacaaaccatttaccatgtctaatctcaatgacatattctaaaaataaaaaagttaacattattagactaggctttcttttattttcctttttatttatactttcctgtataaataatgcatattatacagggtcattttaatgcatgatttatataatgatagtttatagtagaacttttttcctgtctaaaattttagattatatgacttcaaataatatgtttcattttccacaaagaagaggtattataccaattatatttcttatatcatcttgattgtgaatatttaaatgaatgcaaacataaagaaaatgcaattaaattgaagatcaacaaccatttcctgagaatcattttatgaaatcatttaggaaaattcattttattatacgcaaataggttctgaggagcatttaactttgaggctgaatagtgatgatataatcaagagcatataatttggacatttatcatttcaatgtagagaaactgctgctcttatttaaagataatacatatcagtttatagattttatatctccctgtaagtacattaccataatcatatgtcaatataatatcactaattatagttacattagaaggtaagtaattggcatgcatttaaaaactaattactgagttttattgccactgaaactctttgaataaattcagctattgggggaaaagaattgacgctgctgtgaaagttgattatatgaaatgggtcattttgtcatacccaagtaaatcgaggggctggggaaaaagcactcagggcatgtagcacctttttcaagaactgaattttcctcaagcctagctgctgaaatggcctgctgtcaccctaagaccagtgttacctagtaaatgctgaaacaacctgctgtgacaccaagagttctacctgctgccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaacctctgcctcccaggttcaaatgattctcatgcctcagcctccagaatagctgggattacaggcgtgcgccaccacacctggctaatttttgtatttttagtagagacgggatttgatcatgttggccaggctggtctcgaaatcctggcctcaagtgatctgcctgccttggcctcccaaagtgctgggattaccggcgtgagccactgcgcccaccgacgtttctctttctaataaaactcccaactttctctttgttctttggagatatgccccaaattgcaattctgtgattgccccaaaaaccatttaatttagagattcatctctgtatttattttgacccaacactgtgctcaaataaaaattgcctatggaagtggaatagattgcagtctccagttttgttttacaagggtatgtgttatagaaagttaaatgtgttgacttttttctcagtcataatatcatcttgtttatataaaaatagagaaaataattacagaaaactttatgcccacattccttttgtttttatatcttagttatggaaagaaatcattgttttttgatgattcataaagctcactctagtttcgtgataacaaagcattacttgggtttcaaacaatgctacataaaccacagtaaatatacttatataaaattaagcatagctctgcttgtcttcttgggaattgacttgaggtgtattaaaatttacattttctattttgcaaatcagaagaagcaaggaggaaagaaaaggataaaatgaatacatatcattatacaaattagtatgttaaattattttcctctctatgccaagcaggaaatgttgtcaacacatcagcaaaccagacattgtactctaaaatttgactggcaacatttattgtggaaactccagtggttggtatagcctaactttacgtaatgatctccattatcgtttaggtttgcttaagtggtattttaagaaaatgtgacttgttacagcatacacgaagatctgtttcttatctgagtataatttacataaattataattttcatgaaacattaaccttcacttttgtgtgttcctttatttcagttgattatagtttttatgtaaatcatcctactaaatctgtttgtaattttaaaatttcactttgttctgatttaagtctgttttgcttttgtgccacaagctattatttcttggataagggcttttttccagcgtgggtttttatcatatcttcatatttaaataaaattactaaggaagtagtaattataataacaaagctaatatagccagtaatactgtggagaaaatgtgaaggtactgtgaactgtagggctggctgggcgcggtggctcacgcctataatcccagcactttaggaaggccaaggaagacagatcaccggaggtcaggtgtttgagaccagactggccaacatgttgaaaccctgtctctactaaaaatacaaaatattagccgggtgtggtggtgggcacctgtagtcccagctactcaggaggctgaggcaggagaattgcttgaactgggaggcggagattgcagtgagcggagatcttgccactgcccttcagcctgggtgacagagtgagattccgtcttaaaaaaaaaaaaaaaattagtaagggctgctcaaaagatcttttgcccaggatgaggatttctcaacacagaggctgggaaacctttacccaggcaatttttcttcagtgtccaatattgaaactagtacaagggttgatttaaaaataaaccttgtaattgtttcattatagaagctcctcaacttgcaatggcttgccttctacaaagccatggcaagtcggggaccctctgtatttcctaaagaggaaagtgcacagtgtgaggatgaatcctgagattcctgtggaaccacaagagagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttgtatctgtgaatatgcccataaaattcaagaggatatagatttaaatataatgtgaaatatacgtttgtattccatgtagaatttgttgcttccagtgaattggattatttgtttattcctggacactcagcacattttcctgctcctggactgctgctctttttgaaattcttgctctcaatctccatatgttcataaaagtttatttattttaaggttcagacccacttcattttcctatatgaaaataggaaatagtccctgatgccttaaagtaattcttccccattgatgaccctccaaataattttgttgcactttgctactggcacattactttctatcacatattgttatttatgtatgaaaacccctatagcatatagattaaacgtgtgggctctgaattcaaattacagccttgccacttctcagctgtggaactctaggcacgttaattaacctttctcttcctcagcttcctcatgggtaaataggaaaatactacctgcgttgcaggggtctgagtattaaacaagttaggatacatcaaagagcatgtcactttcacctgtgtttttctgcaccccagctgacacagggccttgcatataattaggttctcagactcatgaaacaactgggaacatactgatttctaggaattagaaggttcattttaaatatttaaagcttttaatttttctgtaaatatcctgactaccttagaaacaaataatacaagatacaatttttatacataaaatctagagaattagttaaattactattacttaaaatatatgggtgtatgcaattttcagaaggactttttttcttttttgatttgaagactaatattgctttctagttttaaaataagcctgctaatttgtaattgctttgaaaaacatattttgtttataggaacataatgaaattgtgatagcctcagaaaagtagggaaagagttgggcctatttttctacctgtaactcaaacatctgcaaaaattctgcaagaaagaacaaaatccatatgttctttaatatctaggctaaatgtttattttgtttggtgtcacttattttacttctgctcctgatacatctttgttttttgtttagggcctgaaggggctctttttgaacattcagtggagacaccccttgtcagagccgacccgtttcaagaccttaggtaagaatttttgttcaaatattaacaacctctcctgtagaagacaagagggtatgtgctggaataatgttagcagtgactacttcctgactgtttcttatttcatcagttgcctttattttcaagactttccgcttataactagatagtatttattaaaatccaaaggaggtcaaaaagtcctactgactccacacttggtgcctgttcacagcctcctccttcctcctccttcttcctctccaatctgcctctcacactggtatcaaaatgactttgctaaatgcaagctggttaaaatgcttcatcgctcccacatcacatcagccataggaaaatcctaagtgctccactgggcacccacagcccttcatagtctgggctgtgactggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatgctacaggtttatgattcatatattttacaaacctattattttctcctgaaaagtgtcagcatacgtttcctgaagttttttacaattcttaacacaaagcatgtgcatatatatattacattatccatctctacactatctgcaaacaaggcaaaacctttgcactttttagtggaagacaaaggtgccttatgtggccgtgaaatgtgcaaaaggcactcttgaaaatgtcagtttactttaaatttttaaaagatatatgcactattagtagtgaaaataacattataaaaaccaagtgcacaataaatccatatttgcaaaatagttggaaacatttggtgtatctcttttttaatttgtagtaacatgcacataacataaaattcaccatcttaaccatttttagtgtacagttcagtagtcttaagtacattcatattacttcgtggtcattaccaccatccatctccagaactctttttatctcgcaaaactgaaaccctgtatccatttaacaagtcctcattctctgctcccggtcacccctggcactcaccattctactttctgtctctgtggatttgactaatctgggtgcctctcatatgagcgaaataatacagttttttccttttgtgcctagtttatccgacttagcatactttcctcaccctttggtatatctgtacataataccctgaatatataaaaatcacccagttccatacataaatttattattttttacagaatctttgtgtctatgtgtattttaccttaccactaggctactgaatgtcatttacacctataactattcattccaataatatatttgtattttataacaaaaccaaataatattttaaatggtcttaaagttcatgctatcacttaaaatcacatttagaatttaaacttgaagtgaatgcaggacaattaatatattttaataaattatgtataatagggaatacaaggtacagtaggaatcccagctttacacagacaagccggctgaccatggccaaactaacctttccagactattttttctcatattaaacattactgatagtaatccttacctcagagtattctaggaaagatttaataagatattatgttaaaagcattttgtaaactgaaaagtcaaacacagacaatcttttattttttttttttttgagatggaattttgctcttgtttgccgagaccagctcggtcagggagaccctaacccagcagtgttagaggaattaaagacacatacacagaaatatagaggtgtgaagtgggaaatcaggggtctcacagccttcagagctgacagccccgaacagagatttacccacatatttattaacagcaagcgagtcattagcatggtttctatagatattagattaacaaaaagtatcccttacgggaaacaaagggataggctgaaataaagggatggttgggctagttatctgcagcaggagcatgtccttaaggcacagattgctcatgctattgtttgtggtttaagaacgcctttaagcggttttctgccctgggtgggccaggttttccttgacctcattctggtaaacccacaaccttccagcgtgggcattatggccatcatgaacatgtcacagtgttgcagagattttgcttatggccagttttggggccagtttaaggccagattttggggggcctgttcccaacattgttgcctaggctggagtgcaatggcacactctcggcttactgcaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggcatgagaattgcttgaacctgggaggcagagtttgcagtgagccaagaccatgccactgcacttcagcctgggcgacagagccagactccgtctttttatcaaggggaaaaaaaattgttattatactacatagatattctccctaaataataaaggattaggaaaagcagcattttttatatatttaatgtccaattaaatattcatcaaaagcaaataggagttcaatttatcttacccacaaagtgaacatgtgtaacataaaaatagattgtgactataattaaattataacaaggtttaattttgaaaatggataaaaagattaacattaaagaatttttatagagaagaaaaacattttattttcctaggttagaaaaatcattcaaatctgtggaaataatcccattaaagccaatttaaaattataaaataatatagattgtagaaatgccaaaacacttttaaagtaaatgtcaatttaaaaaatatatagatctcaattaaataattcatctcatgttatcccattaaatcttctcactgtatatacggcaggctcttactgaaaaagaaacggcacaagagtattcttttgctttctaaaaggcggtactgaggaaggattgagcaacttgagtgttaaaaccaaggcaattgaaaaaaataacaaaactgcaaggaaatgctcgaggagtgtggtgaggatgggaggtgggaactaacattcactgaatgcttttgactgccaggaactgtgctcggtgctgtcacagaatttgtttcatttaattatgaagtgattggcaattttatccccattttataaaggcagaaactcagatctagatagttccatgttgtaagtcacaaaactaaaaaggtagccactcataatcgaatccagctttgactccagagcccatgtacatccagtttgctgtctccaccacccagcggatccttgagagattgattctttgatttacactgagatgcctctgactgattatatgatggtcatatcttcttcttctgcaacttcttgccatcaactatgttccactttttatttctggttccagcagcattactattcctggcctgattacagtaaaaagattctggaatatcttagttggcatatatatatatatatatatatatatatatatatatatatatatatatattttttttttttttttagtcggagtctcactctgtccccaggctggggtgcagtggcgcgatctcggctcactgcaagctccacctcccaggttcacaccattctcctgcctcagcctcctgagtagctgagatgacaggtgcctgccaccatgcctggctaattttttgtatttttagcagagatggggtttcactgtgttagccaggatggtcttgacctcctgacctcgtgatccgcccgcctcggcctcccaaagtgctgggattacaggcgttagccactgtgcccggccttagatttacatttcttatggcaaaatcatttgcaaggaaagtatgaatgctgacaaactaccttaaagcaaccttgcattcacacatgatgtaattcattcttttttaaaaagtcagcaaaagtgtattaaagtgtttatgtgccagatataaaaggcatggtcgttgacctcaatgagtttacagtctattgagaaaagaaacttgcaaacaagttagaaaagtatatttaactgctatgataaaagtacaacttctgttggaggcataggcaaataaatataaaatcttcccagggtaatctgggatgataccccagaaaagggaggagttgaattctgtgtaacaccataaggatgtgatgtcaattaagtaagttattatttccacgtctgttcatttacttatctaaggaagatacacatatactactgtgtggatggaaacatttgcacctgttgcaagcacttgcaaatatgaaagtttacctagtaagtgtttataaatactaagctcagttagaaaccaagaaagggtaattcccaggtcccaacaataaagaggcagctcatggtcagagtagaggaagagttaagctaagctactcatagagaaatcaggatacatagagactagctgctgagacattaatgctgatgtgggagtgagattccaagtgattgttcagtgtgcatgaaacaccctggctgagaaacctccgaaatcctgacctcccatgaatcaggtatttcacacaatatgcccatcagcccaacgatgtcacaagaaagattgctattttaggccatgggttgaaaaattacccacaagaaatcatgacctgcaagccgttgcctggccgaggtagaagcaaacgcatactacttcacggtataggaactccgaggtggcaaattaacagtaaaaactgcaccaaagtctgtgaaactcatagaaccatttaaaaacagagagaaacgacattgaagaagttatcccatcacacatgacataaagacacttaaggaaaacaatacctgctaatgactagtttactaaaaaaaaaaaaaaaaaaaaaaagggccgggcgcggtggctcacgcctgtaatcccagcactttgggaggccgaggcgggcagatcatgaggtcaggagatcaagaccatcctggctaacacggtgaaaccccatctctacgaaaaatacaaaagaattagccgggtgtggtggcaggcacctgtagttccagctactcaggaggctgaggcaggagaatggcgtgaacccaggaggcagagcttgcagtgagccgagaccacgccactgcactccagcctgggcgacagagcgagactccatctcaaaaaaaaggaattgaactaccatggagaagaattagaattagcagctgctacaaataatctcctggaactgttatgtcatagagcaaagcaaagagatttttagaacaagtataaataaaatgctcaaatgaggaaaaaaatgaatagaaatgagggaaaaaatgaatagaaatgtaagacaaagacaagatattttgaaaaatggcagatttgggaaataacaaaatagaaattatagaaatgagacatgaagtaattaaaataaaatcactggcccccagaactttgtttctcataccattctccaaggaaccgggacttcttagagaagtggctgatcccagggctgggccagggaatggtgaagatggggcttggagcagcctaaagttcagggaaatgctaaccaaaagaaagtaggcatcgcgatattaatagcagacagaatcaaaattaggaaagaaatagcattaataagaatcaatggggtccggcgcggtggctcacgcctgtaatcccagcactttgggaggccgaggcgggtggattacctgaggtcgggagtttgagaccagcctggccaacatggagaaaccctgtctctactaaaaatagaaaaattagccaggcatacatagtggtgcacacttgtaatcccagctacttgggaggctgaggtagaagaattcgcttgaacccgggaggcagaggttgcagtgagctgaaatcacaccactgcactccagcctgggcaacagagcaagactccatctcaaaaagaaaaaaaatcaatgggaacactacttgatgataaaaggaaatatttaccaagtcagtttagcaatgatgaccttttatggtttaaataacataaataattttgaaataaaattattttcattactttttaaaatgtatggatggaatctaagaagcatggatatttgatacccaccatcaaagaactgaaaaacatacaaacaagctcttcttatggagtcagaaaagttttctttttgtccttgacctaatacttacagttcacttacccaaaattttttcctaatatacactacttagtgattgacagtatttcattgatcactctatcctatttctccacaagaaatatatttatataattatatatataattacttctagtgactatagaatttttaaaatttcttttggatagagtcataatttaaggagaaaacaattgatcaaaacagtatagctgtagtcaccctacagtgctatagcacactagaacttattcttcctatgtaagttgtaattttgtatctattagccagcccctccctatcctctcctcctcccattattgtatattttcaaataactaaaggagagaatttcagatgttcccaacataaagaaatcataaatgcttgaagtgataaatatgccaattactctgatttgattattacatattgtgtatatgtatcaaaatatcactctgtactccataaatatgttcatttattacatatcaattaaaaataatttttaaaagaaaaaatcaatatattaagatttttgatagtaacaaaaagtaaaattgtataaaactacatcttttaatgaatggttggaactttttaaaaactatttgatagatctgctaataaatatagcttattaatagaaggagtcaagatcaggcatcaatatctttcctgttttttaagtagatgtcccaaggagcctgttcacataagtaagtaggtatgaatcaaaaagttttattttttaaaaagtcactctacgttctgaactcttccctaaatacacaccattaaaagttatttgtaatgactatcggcgacaattcattaggtctttcttcaatttttgttgaaagtaaagaattagaaactgtgtaacttgccaaatgattacctcgtaatcactgtagtcattcaatttgtcaattctgtcaccaattttttaattttcccttgcacattacccctggaagtatttctaccccagtgtaatacattataatcgattcagaatgaatgagcatgtcttttctttataaagtgggagaaggagattgttaaaaaggatctgggaaggggaacccctgcaagctcccagcctggcagttcggggcaacagtcctcttctgcccctgatgaagtaactgggactggatgcaccatctctggtaaccaggagaacacttgacaaatatatgaaacaaccactttcagacactgggtagcacgaagtgcaaaacaagacagaaactaatgaggtgagccctacacttgcccgagctctctgcccacaggcatgttcagaatcagggcacagggaaggggaatccagtcagtgcacgggaacctctgggagtggaggagaaagagatccgagagtggggagttgaggctaatggagtctgtggggcacaggatcagagaagagggcatatgccaggaaagagctccggaaatcgcatacaagttcccaggtatgcacgtatcagaggtttttcaactgctcccctatatatgggcacctgatttatttacaatgcgcttgtgcaggtaaattttcatattgttggagatatagctccatgataaattcctggaagaggaatccatgggtgaaaaagataaatgcacatattgtttactcagataatgccaaattcccctttcggtgactttcccctccattgaggtataccaatttgcacactagcattgttacaataaattctattttcctttccccatggctcccaacacaatgtgttttaaatattttaaattttgccaatctgatagattagaaattacatctcattatagtttacatttctcttaatatgagtgaggtggagcaacttttcatatgtttaaaggccatttttgtattcctttctgtgaattgtttgtctttttctactttttaaaaatacttttcctctcaatttttaagacttctttaaatattgggaatattagcccttcatcccttatacatgttttaaataatttttcccagcttcagttggtttttgacttattgtactttatgctgtgcaaactttttaatgcttacatactcatgtttattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccaattggccaaccagatgtgccagcaactagattatttattacaaactctactttttcccctgtgatttgaaatacaacctttaccaccaaatgtctctatacacttggggctgttcctgcaattgtaattctattgcaccagtctctccattcatgagccagtaaggagtctgttaactaaataggctttttttttttggcggcggggaggggagcggatggagtcttgctctgttgcccaggctggagtgcagtggcaggatcccagctcactgcagcctctgcctcctgggttcaagcgattctcctgcctcagcctcctgagtagctggtattacaggagcctgccatcatgcatggctaattattgtattttgtttgtttgtttgtttgtttgtttttggtagagaccgggttttgccatgttggccaggctggtctcgatctcctggcctcagatgatccactcgccttggcctgccaaagtgctgggattacagagaagatattttaatgtctggtaggactagttgtgcacacatgcgtgcacgtgctcacaggcttgcacgtgctcacaggcgtgcacgtgctcacacacacacacacaagactttgtacatcattgaacattagtctgcctattcttggttatgtatttttgcacatgaacttgagtattaacttgtcgacttccagaaaacttattttgtattaggattatattaagtttttaaattaccttagggaaaactgacaacttactgtgttgagtcatctacccaagaacagggggtgtctttccatttgttcaaagctacttctatacctctcaggagcattgaaaagttttcttcatatgtgttttccacatttatttgttgctattaaaaggaggtttattacatcatcattattccctgttactgttttagatatgaaggctattgattcctgtgtgttaattttatatctcactaccttactaaaccttttatggtttggatccatttgatgattgattcactgggattttccaagtatactatcagatcatttgcaaataggtatagttttacaccttattttccaagtataatatctctaatcaatttctcttggctaattggatttcccaatgtcctcaatgcaatgtgagaaagaaatggagatagtaagcatcactgcctttttccagtcaaagtggaaatgcctctggtatttctccattaaccaaaatgatgtgaatgtgtgttttataaagaaagcacatatcaatttctattttgtgttgaatgggtattgaatttagtaagacagtctttagtaattacagagatagtcatgtatgtctcttagatatattaatatggggtattacattaatggattttctaatactgaaccaatcttgcattctgagaataaatcctactttggccatgaaatatcatacacataactcatattagtctgcatttctttttgttcttgctctgctgcctgcccaggctaaagtgcaagaacacgatctcagcttactgcagcctccagctgcagggttcaagcgattctcccacctcagcctccaagtagctaggactacaggaatgcactacaattattattattattattattgtgagacagggtcttgctgtgttgcccagtctggtcttgaactcccggcctcaagtgatcctcccacctcacctcccaaagtgctgggattactggtgtcagccactgtgcctggctatgctatgattataaagtttaagtaaccctgttactcttggttcaataattaggaagtttttcctcattttcaatgttctggaataatttgtggagtattgggatgttctggtctctaaaggtttgatagaattttctctggaaccatatgggcctgatgaaatttttaaagacagtgttttaatattaatagtgtatttcttcttttatggaaaattgtgtttaagctttctaactttaatgggagttgattttggccaactgtatttccctaggaaattattcacttaatctaagtttttaactgtatttgtgtagtggtctgaaagtagtctcataggaatttttaaattcctgttgttttcatggttttatacagctcattgataaaaatcaatgtctataaatacaagtgatcactgaagtgatctaacactgttcgcataatcacatccttagttccaagtatgtatattttatttgtcacaagttaatatcttaagtcttcttaacttgaacaatgaaaacaatttattccttctggtaactgacaacttatggtgtggcttattttccttaattctagcaattccaagaaaaaggaaaaaaatacaaaatgtcagaaaaaaaagtacatatcatcaattcaacaactggaaacagtttcaggattgaaagtttcatccagtaacagaagagcacagtcagtgctcatacaagaattcactgatgacatcttgggctcctgagctataaagtgctgttaaatccagaatgtgaaatacattatgtgaaaagtaatactccaaatgtaaatgtataagttgcccttttcaagaaggacttacaaatatattagatttaattttcttttagctaaacagaactttttaagatttagtattttttcttaacaaacagaagcttctaattccttttaagattaacaagtaagatgcaaaatactaaacaaagttactgaaacagaggtcttaaggacaaactgaacttttatagttcactgacttctgcagtaattaaaagtctgagactcccctgaagactgaattgggtatgtcatagatgtttaatcatagccatcttatctgagtgacattagttactctatagtgcaacataatctttcacaaatttctgttcattgcagtgtcattccattcccttgtagacctcagatattagtagtctttttttctgtgaagtacagtcttgatgagcttagaagtgtattttatatttttcgtgagttaaaaaaagttatcttttttcaagacagaagtacactttacagaaataatgaaatcccaggagtgatttggattactgtgggatggtgccagcactggctgtgggcagtacttagaactatgccctgttatgcatcttttaggagataggttctacagaactgtatgggtttttttcaaggttctaatgaaaggtgattcaattcaaagaaaatattagaagtcagtacagatgcatgggagaagaaatatagggcaataatattaatatcaatgtatcaaattatatctgtatttaaaagcatggattccataaattcaagtgaaatactttaatttcaaggctcatcattgtcataaatcataaagaatatcataaatacataactattaaaatgcaggcatttattgtgtaaatacaactacatatagacagtagtatctttgcatagttcattattaaaccaaaacacaagtttttatgtacaaaaacattccgtatagaagtgagaaaataaaaataaaaacccacatacggatctctataaatgtcaacattacacctatgtgtaatgttacattatgttgtggtcaagtctaacaagaagtggattgctgaagatcgtgaatgcttcactggttaatcatgaatttatagacactgatctttctctggagagtatttggccagtatgaaagttaatttatccttgtagtattctatgaaaataaactttcaggaacttgggtgttttagaaaccactgcttgggcactaaggagggaatgagttctttcaaaaacatttttgtttttgtattcagttctttaatcagacaagaagttatttttcatgtggatgtgaagtaggcaaataattttattttgctttctgagtgggaatacccagttgtctcaaaagtcagtccattccttctttatccgtaatgctatttttgtcatatataaagctatttttaatgggtgccctattctcgtctgttgttctggcttttttcttcttaaaccagtatctccctaatagctgtacaatgcatctggtacctgctagggcaagtgtccccaccatgtcttcttcagagttgtattggctgtttttagacatttatttttcatgtaatttttttttttgagacagagtctcactctgtcatccaggctggagtgcaatggcatgatctcagctcactgcagcctccacctcctgggtttaagtgattctcccaccttagcgccctgagtagctggaattgcaggtgcatgccaccatgtccagctaattttcgtatttttgtagagacgcggtttcatcatgttggccaggctggtttcaaactcctgacctcaagtgattcactcacgtcggcctcccagagtgctgggattgcaggtgtgaactaccatgcctggactgtttttcatgtaaattttaaaatcaatttttcaggttttttgaaaaactctcctggtttttttttattggaattacactgaattcatgcctttataatcgtgaagtctcttgtccataaatatggtatatctctctattcacacagccttttatatgtcctttaatattttatgatattctccatttaggtttggcccataattattagaattcattaccagggtgtttatagtttttgtttctattgagaatgggttcttttttctgttaaattttcaaagtgattattattgattttttcatgatagtttttaagccagcaactttactgatcattgttattagtttacatatatatgtatataaaaatacatacatatgccgagagagagagagagagaaagaggaagatggggtcttgttatattgtccaggctggccttgaactcctgggctcaaatgatccttctgcctcaaatgatccttctgcctcagcctcccaagtagctggaactacagatgcacaccaccatacccagcttagttttaatattttgattgtagaactcaactgatttttccattaagatgatgatagtgccgaaaaaagagtcatcctttttattattatacttcttacttctcagatccctgtattgttactttggctgggacaaatgttggctagaaagagtaacgatggacatctgtgtttacttcctgactttgagaaatgcttctaaattttttaaatgaaattatgtctgctataggtttttggtaaatattaatacctattatcaaattaagaaagttccattttggtctaagtacccacctctcctttttctttcaaacagtgtgtgtaagagcaatcaaaggtttggtgtaaactcacatatgaaatgaaagagccagtacattttggggaagttggattatttacacttccacttcaatgtatttaatgaagtttctcttttcaagttttgtacatcttcaggtccatttttgttgtttccttgctagaaatttttccttgttactcattatgagcatataattattcataattattcataaatgtttatgctaaaagcatgttatcttttgctttaatgcaaggtttgtatgtaagcggctactaggtcaatcttgcaaattacattgttaacatcttctatatacttagtatttttgccttgtttttctctttttttttttttttttttttttttagacggagtcttgctctgttgcccaggctggagtgcagtgacacgatctcggctcaccgcaagctccgcctcctgggttcacgccattctcctgcctcagcctcccaagtagctgggactacaggcgcccgccaccacacccgggtaattttttgtatttttagtagagacggggtttcaccctattagccagggtggtctcgatctcctgacctcatgatctgcccgcctcggcctcccaaagtgctgggattacaggcgtgagccaccgcgccgggcctgaattcttccttttaatcataagtaatgttacccttttgcccttattttgtctggtattacaattgctatacctggtcctactttcttttgcactgatttacattttccaagtgttttattttcaatatgtttgcagcattatgtttcagttgtttctctatgtttcaaattttttggtttgagattttcttttaatgggttaatttagcccatttatatttattatggtaactggtttatttgccacatttctatcattttgttttatttaccatgctttttcttttcattttttctcctttttctttttttgttggattaataaacttttcctcctctccacccatatttcccccaatagttctatttttattctttcaatgattgtcttttgtttatatgcacagacacaaattaatacttgtcaaccaagtctacatcaataccaccttcttcccaaataatatttttaaaaacttagtcacttccatccaaacttccctttcattgtggttttatttcagcattgcttttattcatctccctgctttattttttcaggccatatctatttagctttaccagcacattttgtaatgtccactgcttcttcttggaaacattcttttcttcttatttaatttccataagtacattttttggtgaagatctatagattgtacatttgttccctgtgtctgaaatgtccagtttcctttatagtcaagtgctggttaggctgagccagatttctatctaggctgacaataattttacacgagtattttaaaatatattactcattagtgcacttttgattctttagagatcatgtgattttcattctgaattcttttaagattttattgttaatgttggccatctgcagtttcaccacggtgtctggtatgtgttagtttatacttgagtatcagtgaacttcttcagttcttcagtttcagaaactcatgttctttttcaattttggaaaattattagccatagttcttcatatgtatgtcttcctcattctctagagggtagaggtttttcacttgtagtctgtggaccccatcaagagaccttttcactggggtggtagcgagctccctccttccccttgataaagtcacttttcttcagccttcacctataaggtgtctgactactcctacaggacaactggcttggtgctcggcacgttggcctggggtagagatgagggcaaagtgaggctgacatgtgctacttatactgaggtgttcgatgaggaatcagcctctgatcccaaacacctcatgtgcgtattcaggataaaattactaaagatgagtacaaaaacccaacagttcctaaatgatgcaaggtcactttcaacatattttcagttatctttctatctaatttctcaaattagaaaatagatttttttcattgaaattattgttctttctcctctgacctccaaaccccccaccgtgaccctttctggacagatcacttaggtcagctgacaactcctttcaacttttctcctgcccagttctctaatttgctgtaaatgtgcatgttttcgttgcttttttgcaaccttatagaagaaggtgagcctcatcgtttccaaggttgcatctgccacctatgtccttggtgccatcccctcccataatcaccttctgtgtctctgcggactctagcttcttctttggctccaagtaatccaggtgcctgcaaatgaaacaatgacaatttattgcatctagattcattcagatgtcatattcatagaatcctttctaagaacctaccaaagggaaatttctataagctaaaattcctcttttaaatacaaagctgtggaaattcaacacagtctctatgccaatttataaaaacccacaagatgctcaatgccagcttcaaaaagcctttcacattcttttccagaggagtaaatccggttgattttggtgttttgaaaactagaaagggactaaattttaagaataattgtacttgaagccatgaagtaagattttaaaaacatattgttaaatatggaagtgttcaccagttttcattttcaatgacattttaataactgtacttctataagatacctcagaaaggcaagtaccacatgttctcacttatagatggaaactaagtgatgtgtacacatggacgtagtgtgtggaatgatagccgtagcaggttgggaggatcagggggtgagggatgagaaatcacttaatgggtacagtgcatgccattcgggcaatggttaactgaaagcccagactttgcctctatgtaatatattcatgtaacaaaacgacacttgtaccccctaaatctatacatatttttaaactgtactgataaatatggagattttcttttatattaaattgtttttccaaatgtgacatttgaaaaaaaatggtgtctccaaaaacatgtattaggtaatactaggaaatttttaaagaaatataaaaatcatgttcagtttagtcttagtgctgagtacatgtattagatttcaagtttttgaaaattggaaatttttgtatggtatgtaaggtgagttacccattcttcagccattgataatcctctgaactgtttcctgaaaataaaagattaggttttcttatcatacttatattcatgcttcctggtctctcatcctatttgtaaaatttgggcttaataagagcctgaaaaagctttaaattgatgcactgttcatatttttcagtaagttttcttcttcttctttttttttttttgagatggagtctcactctgtcatccaggctggagtgcagtggcaggatctcagctcactgcagcctctgcctcctgggttcaagcaattctcctgcctcagcctcccaggtagctgggattacaggcatccaccaccatgcccagctcatttttgtattttaagtggagacagggtttcaccatattggccaggctggtctcaaactcctgacctcaattgatccacctgcctcagcctcccaaagtgttgggattacagacgtgagccactgagcctggccttctctttttttaaaaatgacattaatatgacatgagcaataactattaaggtcatacatgtttgactgttcatagtctataaattcaattaaaaatgaatatggggtaaactttggaaaattactgacttctatttatttttatttaaaaaggagcacaacttaaaactcgcctgctttgtagcagctcagtaccataggaaaaatactactcctgccttagcaatcaagtcaccttaattgtattttttataacaccaattatgatggttagtactgagtctcaacttgattggattgaaggattcaaagtattgatcctggttgtgtctgtgagggtgttggcaaaggagattaacatttgagtcagtgggctggggaaggcagacccacccttaaccccagtgggcacaatctaatcagctgccagcgaatataaagcaggcagaaaaatgtgaaaaggtgagactggcctagcctcccagcctacatctttctctatgctggacgcttcctgcccttgaacatcagactctaagttcttcagttttgagacttggactggctctccttgctcctcagcttgcagacagcctattgtgggaccttgtgatcatgtaagttaatgcttaataaactcccctttatatatatctatatctatatatctatatctgtatctatatagctatatatatagagttttgaacagtatatatatatatagagagagagagagagagttttgaactttgagagatctcacagttgattggtgtattagtcagggttccctagagggacagaactaataagatatggacttggaatatcttacattgatggacatctgtgtttacttcctgactttgagaaatgcttctaaattttttaaatgaaatgatgtctgctataggttatatatatatatatatatatatataatcttattctgtccctaataagatatgtatataagatatatataaaggtatatatatataagatatatatcttattagttctgtccctctagggaaccctgactaatacagatgttagtaccaggagtggttctaaaggaacagaatattaagggtggagttcttgatcacttttcgctcccacaagatatcacactggtccattacattgatgacattatgctgattggatccagtgagcaagaagtggcaaacacactggacttattggtgagatatttgtgtgccagaggatgggaaatacatccaactaaaattcagggaccttctacctcagtaaaatttttaggggtcctgtggtgtggggcctgtcaagatactccttctaaggtgaaggataagttgctgcatttggccccacctgcaaccaagaaaacggcacaatgcctagtgggcctatttggattttggaggcaacacattcctcatttgggtgtgttacttcggcccatttatcgagtgacccaaaaggctgccagtttttagtgaggtccagaacacgagaatgctctgccacaggtccaggctgctgtgaaagctgctctgccgcttgggccatatgactcagcagatccaatggtgcttgaggtgtcagtggcagatagggacgctgtttacagcctttggcaggcccttacaggtgaatcacagtggaggcctctaggattttggagcaaggccctgccatcttctgaagataactactgtccttttgagagacaactcttggcctgttactgggctttggtggaaactggaagtttgactgtgggtcatcaagtcaccatgtgacctgaactgcctatcgtaaactgggtgggtgccttttgacccatctagccataaagtgggtcgtgcacaacagcattccatcatcaaatggatgtggtatatatgcgatcgtgctcgagcaggtcctgaaggcacatgtaagttacatgaggaaatggctcaaatgcccatggtctccccttctgccaccctgccttctcttccccagcctgcaccaatggcctcatggggagttccctatgatcagttgagagaggaagagaagactagggcctggttcacagatggttctgtatgatatgcaggcaccacccaaaagtggacagctgcagcactacagcccctttctaggacatccctgaaggacagcagtgaaggggaatcttcccagtgggcagaactttgagtagtgcacctgattgtgcacttcgcatggaaggagaaatggccagatatgcaattatatactgattcatgggctgtagccaatggtttggctggatggtcagggacttggaagaagcatgattggaaaattggtgacaaagaaatttggggaagagatatgtggatggacctctctgagtggtcaaaaaatgtgaagatatttgtatcccatgtgagtgctcaccaactggtgacctcagcagagaaggattttaataatcaagtggataggatgacccgttctgaggacactactcagtctctttccccagtcacccctgtcattgtccaatagtcccatgaacaaagtggccatggtggcagggatggaggttacgcattggctcagcaacatggacttccgctcaccaaggctattctggctacagccactgctgagtacccagtttgccagtagcagagaccaacactgagcccttgatatggcaccatccttggggtgataagccagctacctggtggcagttggattatattggacctcttccatcatgggaagggcagaggtttgtcctcactggaatagacagtctggatatgggtttgcctatcctgcatgcaatgtttctgccaagactactatctgtagactcatggaatgccttatccaccatcatggtattccacacagcattgcctctgatcaaggcactccctttatggctaaagaagtgcagcagtgggctcatgctcatggaattcactggtcttaccatgttccccatcatcctgaagcagctagattgatagaacggtggaatgttcttttaaagtcacaattacagtgccaactaggtgacaatactttgcagggctggggcagagttctccagaaggccgtgtatgctctgaatcagcgtccaatatgtggtactgtttctcccatagccaggactcatgggtccaggaatcaaggggtggaagtggaagtggcaccactcgccatcaccccagtgatccactagcaaaatttttgcttcctgttcctgcgacattacgttctgctggcctagagatcttagttccagagggaggactgctgccaccaggagacacaacaatgattccattaaattgaaagttaagattgccacctggacactttgggctcctcctatgtttaagtcaacaggctaagaagggagttccaatgttggctggggtgattgacccagactatcaagatgaaatcatttggccgggcgcggtggctcatgcctgtaatcccagcactttgggaggccaaggtgggcagatcatgaggtcaggagattgagaccatcctggctaacacagtgaaagctgtctctaccaagattagccgggcatggtggtaggcacctatagtcctagctacttgggaggctgaggcaggagaatggcgtgaacccaggaggcagagcttgtagtgagccgagaccacaccactgcactgcagcctgggcaacagagtgagactccgtctcaaaaaaaaaagatgaaatcagtctactacaccacagaggtaaggaagaatatgcatggaatacaggagatccattagggcatctcttagtattaccatgccctgtgattaaggtcaatgggaaactacaacagcccaatccaggcagggctacaaacggcccagacctctcaggaatgaaggtttggctcactccaccaggaaaaaagccatgacctgctgaggtgcttgctgaaggcaaagggaatacagaatgggtagttgaagaaggtagtcatcaataccagctacgaacacgtgaccagcttcagaaacggggactgtaattatgagtattttctccttttttttgctgaaaacatacttgtgcatgtatacacttgtactaagaaaatatctttattttcttttcctttatcattttacataagatttattgacttcatagcagcatttaagtattgttaacttatgtaatagtatttgggttggggattggtgcgtttccagttgtaggaaggatagttgtattatgttgggtgtaattatgaccttattatctttatttgaagattatgtgtgatctcaggagatgtgtatgggttcaaggggtggacttgtgatggttaatactgagtgtcaactcgattggattaaaagatacaaagtattggtcctgggtgtgtctgtgagggtgttgccaaaggagattatcattggagttagtgggctggggaaggcagacccacccttaattgggtgggcaccatctaatcagtggccagcaaatataatgcaggcagaaaaatgtgaaaaggctcccagcctacatctttttgtcatgctggatgcttcctgccctcgaacattggactccaagttcttcagttttgagactcggactggctctctttgctccttaagctttcagacagcctattgtgggaccttgtgatcatgtaagttaatacttaataaactccccttcctactagttatgtcctactataactactagttatgtcctactagttatatcctactagttatgtccctctagggaaccctgactaatacaccaatcaactgtgagatctctcaaagtcaacttccaagtcttttgtatacatctttaattgaactaatgagaagagagtgaatcaaattctgaaagcaaagttagtgccttatgtccagtgtcttatgtcctaagaagaaaactgccatgatgggacctaaatatttaatatagaaatatacatatttatatataatatatatttaatattacacacacacataagcatttggatatatttctgtgacactgttcaaaactcttttacttttcattgaagtcataatatttatatatttacctattcagaaaagagggtaaactaaaatataacaaagacagaaaacaagttattttgtatctgagtactgttcaatgtgttaatggaaatgtatacttcagagcaatcttatctcagccttttggtaaaatgtgtctcaatctgggttgaactgaaatttctcatctccaagtctagaaataatgcaaagggtaagaagtttgctcttcttagcagcgtcccattataacatggttaaaaactagtaaatgatcaggttgaagtcattttgttgtcgtttaatgactgatcttggaaacacccactttcacaaggatcttcaaggtcacagatagtttgcctgaaattgaccaggcttcaaaggtgcttctgtgttcttccttccttccactcctccacgcaagaaaaatgtagacaattatccaaggtcaaaatagcaaactggggccaggcgtggtggctcacgcctgtaatcccagcactttgggaggccaaggcgggtggatcccgaggtcaggagttcgagaccagcctggccaagatggtgaaatcccgtctctactaaaaatacaaaaattagctggacacggtggcgggtgcctgtaaacctaggtacttgggaggctgaggcaggagaatcgcctgaagccaggaggttgtggttgcagtgagccaagaccacaccactgtattctctagcctgggtgacagagcaagactccgtctcaaaaaaaaaaaaaagacaaaaagcaaactgggcaggcagccagaccatgcacatggagctgtaccaaagtgttccccagcctaacttgaccaataaattccataaatgtctctaagcgttttctcatactcaaggtaagacttcaaaatgtggggcaggtcaaacttcacatgctcagaaaatgaaactttgtcttctataacaaatagtcatagattaaaaaaaacttgccaattcaagggagcaatttcatcagatgtaaaaagtctgttaaataaatgttcagtcaatttaagtgcagattcattatcagggtacttctctcttaagccacttccctttctctctgctccctgcccctctcctcccatgaaaccctagcctacaatgggtaggatttccgaattaggtatctttttctgtttgttctgcttcctactgccctttaagcgtttccttgaaatcagcatttcaaactttggggctgagcagctgaaaagtgtttcaaatgatcacattgtgccatctggtggaaatacagccttttccaggcagaggcaagtaagagaattcctctggctcttatatttttggttctctttctatatttggcttaaccacaaggaaagtctgataaattttacaaaaccaaaagccagctgaggccaacctccctcctttcggttctatcagtttagtattttttccaaaagaaatctttccatttgccctgtaatgtttttaaataataataaagaaaagaccaaacttatattctgtcttatgaacatgtggaaaatgcatgtgttgtccttaaatctatctttttttcttaaataaattggtgttttaactaaaaaacaagcctgccacagctggttgagaggccaagccaggaggacctcttgagccgggagttcgattttgcagtgtgccacgatcacaactgtgaagagccactgcactctagcctgggcaacataacgaaaataattttgtatagtaattcataaatggcattttcttctgaaatagtatgccagagtacttaactatgccatcggaaactgctgcatgggattaggactgcctaatgtttttatcggcttttagaggatactaatctcataggctttcattgatacaaagtttatatcttacttcacattatttctagatttatcaatgaataatgcacaatatgttaccatttgagaatgacttgaagacttacatatcttactagttatatttcccatgctaagttgagggattgctggagtggctatttttaatactttttttttttttttttgtgcttcttttcctcatctcagattagaatcccccactcggagtctaagcatggatgccccaaggggtgtgcatattcaagctcacgctgggaaaattgaggcgctttctcaaatggatattctttttcatagtagtgatggaatggtgagttcattcacagatcagcctcctactgtatgtcctgatgatattcctgagtaccatgtctgtaaagctatcagtattaaatttctagtagtttgtaggaaaacattgtgaaggtcatagagtagcaaatgtacaaggaaagcaaaagacaatttagcattgaaagaagggccaagaaagtctaaaattattctgtattagatccagacagctttctttaactggcatttatgctatcaagtgatttagtgacttgttattttcaagtcggaaaaaaaaaacactacagacgttcacagtttacagagaatgtccattttgccatttcctagggatggctgtcactaggagtcacccactaacaaccactgtcacctttcactgcccagagtgctgcgtttaagctgcatttccagtttaaatgaaaatgaaagatgaaaaataagagtgtttttttcaaagtcaactacaataaagataaaatctgggacttcaagtctagaaatacagttgtccccctttattgacaggggatttgttccaagacccctactggaagcctaaaaccacagagagtacagaaccctgtatacactatctgttttcctgtgcatacacacctctgctaaagtttaacttataaataaggctcagtgagagattaagaacaataactcacaataaaatgaagtgattatgacaatatgctagcatcaatgctcttgtgctttggagccattattaattaaaattaacggtgacttgaacacaagtaccacaataacttaacagtggatctcaccgtggagacggctcctcagtgactcacgggctgggagcgtagacagctggagatgctggacacagggatgattcatgtcctgggctggacggctcaagattccatcacgctagtcagaaaggggtgccatttaaaatgtataaattatttctggaattttccatttaatattatccagaccaaagttgacagcagataactaaaatcaaaactaaaaccaaagaaagtgaaacagcaggcagcaggggaggagctgctaaaacctcactgacacaagccaaagtcacaatgaggcttacagcacacagtgctcaatactgatattggaaccctgtttgttagaaaaaaaaaaaggaaaaagctcaatttcggtcaaccagaaaatcagacatgttagggatgttcctaaatggtctagaagaaaaccaaggatttggtttataagctcattccaattgtatgatgccatatttatagatttgtgcaaacaactgatctcatcttcttggcctaaccccagatattttcatatgtatgaatgtgctcaaaataagccactgctgcaagaattgtcttgtacatagctctgtcttaccaagagtgagtgcagtgagtgacgtgggttgtgttcactcatgccaccattgcctgacagaccctgtggaatccaatagggatggcaccacgtccaaaaggctgaagaagagacccagagccatggaacaggacatagggtttattgaggacttaacagacagggcggtccagtagcagcgagctggactggaaaactgctcccatttttaaaaagcatgcaggttatacagcattttcacttagcaacaacttccatttaacccaaaacaaagggcctcgatcccccatatggcctgtgttgcaagggatgggccaggcgctccgatgtccttcacagatgtggactgaatctcagggttggccactcccagactccttagctcagaaggctgaacacacattcttcttggatcatagagtcattctcagggattgcctgagttattgcagtcaggtgcatctccatacaccgggtgaatgtgctgggataaacatccatggacgctgttagtacaacaagaaggcacatgggtttccaagctcctccccagcccaggccctatcatcgcacctgcggcgatgcacagaccgccccccacccacccacctcccccccgccccccgccaacaggtgtaacgtggtgccgcgggcagaggattcacctggaagtcaggaagcctgagtcctagtgctagatcaaattccctcattacctgtttgaattcaggactcttatccggccctctctaggcctgtctcagcaaatagggaatataatatttgcttaattatgtcatagggttttgagacactactgtaggaatatgggtgccaacattttgaaactacattactgtgatattaataggaacgtgtagtaaaggtgtaggtggatatggtgccatcatcaagccagctgcgagaacagcaccagagtgtgtgggcaggacccatcagatgacagcctgctagtggaacacaggtcttcaggggaagccactgcaggtcataacctatgaagttgtgatgtcaggagcagagaaatgcagaaataaaaatcaagaatgaggcgttagataataacctaaagattctacttgaaaaacatattaacagctatttgacttctttgaccgtgactgcaccagaccatgcacggcacagagctgcctgcaatgctgtggggtcgtgtgatcaagcctcacctggcaggtgcacaccggcgaatgcgtgcagcagacagcaggttgttaatagattggaaggcaaggataagagccacataacataaaggaaggagctctccttggcaaggacagaattatgcctacccacattcagtttaattccttgtaacaagtgagtgccctggagtgggcaacgtttggctgctggatgtgacgatttttatttccttatcaaaaagatttccaagcctcaatctacggctctttgtttgcacttcagtttaactaaattatcatatgaccagaatatccagtagttttcatttcattttaattggcttagtctgcgtgtctactgcttttcagcatctaataggaggctgtgcagtttcaaataatatttaaaaattagggaaatggttgccagctaataggatgaatttaattgcctctcataggaaaacaaaatcaggaataaaatcaggataaacttcatcattcatgggtaaaaattattaagatgaatctattctaatggattgtactttatcctaatggggaggagaggatttacataaagtcaaagtgagtcacaagataaatgtgaatcgggagaattctaatatgtttgacaaataattctgaaaggcgttttgagaagcatagcatcacaaaactgaaaagcaacccagtttattgaaacaaaaacaaactgtaaaggtgaaacatgttttcacaatggggccacatttctcagctgcactcaaacaatgacaaaccggaaaagcgcctccctccaatgtggaaggaattgtgaagtcccagcctgcatgtaaaatagaactgggctttaaaagaatcggataattacgaaatgagttacataaagtcaggtgcctattttgttttctatgaggagaagaaactaattggaaatcttgtgagaatggggatttgctgttgaccagggtggcccttccttaactcttcgtctctcatcttctcccaaccagcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacagccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatctcgtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaaggaataaatcactcaaaattaaactttctgtatatagtcaataagcaataaaaacctcatttttcagagttcacagtttaagagtgtcttttttaatcctcacaaatctttgaggtagctattatttttccccaagttactggtgacaaaggctcaggtagaacaagtcacaaggtcacatggtaactactgaaattaaaccaaaatgtaaccctaaatttacatagctcttttcactttgaaaaagtttcatgtgctgtctccaaaacacccgtctatgtgataattgtacagcacttatttgacaaacaaagaaactgaagcccaaagaggttttgtctctaccaagatcaaagggctagtctgtggtacttgcctccacatgatagacacaagtctggacgtaacttcatagaaacaagacactcagagcttgtgaacatgtttagtgccaattggctgtgtaaggtgctatagaaatcaaataggacacactgaacctctgaagacaggttcgttttgtgtaggccacccactcactttgtaaaatgccctctatcacaaaaagtggtgcatttgtttttgttttacttattataagaagaatcttcaaataggtgtagggagaccaacagcactgcaactttctaatgatatgacatattaataactatcaatataagttcaaattcattttccatagtctcagaatcaagagaaagtacaaaagtgaactctattcctaatgcttagtaagatgttcatttaacagcatagcctgctcataacaactccctgatgtttaaatggccagaatgcataaacacttgaaattgcaaaataaaaatacagtgctttccaagcagttaagagcaaactcaactcagtgtaattcacatttcacaggcagttgggtgcttttacttataaattgatatttacctttttccatttggttgagtcctgagtaaactgctttcttactgtgacattcctattgtcatagtaaatggttcccggtattttgttccctgtttgtgcgaaatatgtcttcaagcccagctgataaaacacgggatcactagatcactaaacatttataaactagcttggttctcatattatgtgtccaaaaatttgtgtgtagatgataaagtgaggtaaataaaaatagtcaagtagaaagtgtggagaacagaaccttttgaataaaaggtttaaattctatttttttatccttagctatatggaataatgttgaaagaagttgttacagataaatgcattctccacaataaggaatttatccttcattagaatcaaagcttttagatgagctgtattctaaaatgcattacatatatctgtcttattaaacatataaattttcattgaaggcatacagtcatggttataaacgtacatcacagggtatatagactgatactcctatagactattgagtgttgctacattagggatctaaaaatagcactcatttatttcccagtttatgaactgacaagtagatacagtcaaaaagatgaagatcaaaatctactactattatgctttaataataaagatagtggtccaggtgcggtggctcacgcctgtaatcccagcactttggcaggccgaggcaggcagatcacgagctcagcagatcgagaccatcctggctaacacggtgaaaccccatctctattaaaaatacaaaaaattagctgggcgtggtggcgggtgcctgtagtcccagctactcaggaggctgaggcaggagatttgcttgaacccgggaggtggaggttgcaatgagctgagattgtgccactgcactccagcctgggcaacagagtgagactccatctcaaaaaaataaataaataaaataaaaaataatgataaagatagctggtttgcagcaaaatggacttcctaataacttcacagctgaataaaacacaaaccactctggtcacaggcagaactaaaggctcccaacttctataactgctacatgaggaggatggacagatgccttctctgaaagcagtcaaattcacattag

SEQ ID NO: 11777 - DNA, 140925 bp, Human
tttagactgggtcaagatcgtccaagtctggtggtggcttcagaaggccctttgaatgaggctcgtccaggcaataattaccatgttatctaattttgcccacttaacgtttccacttggatgtctaagagccatctcaaagccccacgtggccaaggctgaatctctaatcttcccccaacagacctgcttcactcacagcttccccttctcagctgacagcaaccccattaatctgcttgttcaagccaaaaaacctggaagtcatccttaactcctctctttctcccacatctcacaactcagcagtcagaaaatcctgtgggctctaccttcaaaatatatccaccacccatccaccactccgcagttgccctttaccatgctgggccacgccaccatcacctctcactgggccactgtaatagccttctaacagatctccccactgcaccctggctcacttgcaaaccagagtgatattttaaaactataatacaaatcatatcacccttctgctcagagtcgccccccatgtgtcaatgcataaaagtcaaagtccttacaatgtctccccattcattggcctccttgctattcctggagcacaccaggcatactcctacctcagggcctttgcacagactgcccgaagctctcctccccaagacgtccacaggggcaactccttcacttccttcaaacctttgctgaaagtttaacttcccaatgcaattcactctaaccactctgcttaaaatccctaccttctccccaaccccctgcttttcttgtagtggttcccattacattctaccagtctacctaatttttttttttttttttttgagacggagtctctctgtgtcgcccaggctggagtacaatggcgcgatctcagttcactgcaacctccgcctcccaggttcaagcgattctcctgcctcagcttcctgagtagctgggattacaggcactcacctccacgcccagctaacttttgtatttttagtacagatggggtttcaccatgttggtcaggctggtctcgaactcctgacctcgtgatccgccctcctcgcctcccaaagtgctgtgattacaggagtgagccaccgctcctggccagaaatctcttctttattatgtctactgtccgttatccaactccagaaggtaagaacctccactgatacataaggacttgtataccccacgtgcctgcaacagtgcttggcacctagtaggcataccaaaatatataaatgttgaacaaatgaagaaagttaaagtaaaactagaggtccaaaaatatcacaaaagccatctatggtcgccttttccctacctgattttgctgagtggccttacttttcagtcctctacacagctggaacattaatgaacacagagggggaagaagtgtgtttactctaggatcacctctcaatgggtcacttggcaagggcatctttgcttcttcgtcagctccttttgacacgggggtgaagggttttctgcaccacactttgaccacaagcatcaccaatttcactgaacccaacagaaatttggaccctctgggggctctctgcgtggcagggcccttttctttttctttgggcttaggctgcaatttgaaacaccactttcctgagccagcatcccccttgcagcgctgtcacagggaggcttaggcagccacgtggaagccacctaccccgacctttggcagaatttccaaacacaacacagtagctttaagttgattaatttggaactctgaccttggccccaaaaggtaagaatacataacaaggtattttattctcaaaatgtgtcaggataagaagcacttctgtaaatcgacctttttaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccaggtaagagcctgacttttctccagagatgggcatgaacttttctttttaaaacgtgtgtcacaaagaatccaggggtttctgactgtatgggacagagcttgcttcagagcgtgccaggtggttctatacacgacctcacaggttcacagggacacgtagccgtttgtaaacagaaatgaaattttagaaaatcatcctcggattaaaagtcttctaagagtgcctgcagctagcagtgaagtctcttgcgtatctgatatggaaacagtcatgctaaaagttattcagcggcaaatgatatgaaagcgattcagatcttcctgagagttaatgtggcatctaatttgcaaccggggagccaggcttgcaatgaaatgctctgtcgggttggggttgtctaattgcctgcctctctcagaagagaggggaatttatgagagttctatttccagtcaggtctaaagtagagatatcattgcacaatttctagactttgttttgctgccaaaattttagtctgaggctgaagaatccaacagccgtcctgcctgttttgtttgtaaattcacaaactagattgatggcgaaagacagatcaaatgccttatcaggaaggtagtagagtggagcccagcttccaggctaagcagtggaccaataaatgacggatcagttaattgaacaatttggccagactagacaggtgtttgggaatttgttttggtactggttactggtcaggagctagtaacgctaaggtagagtctgagatttttcttttctctaagactagccttggagagagctccgacaactttgagaattagaaattccctaacgggatgtacctaaaaatttcagaagcttttttcccctttaagaaaaaggctgttcctttgtatttgactattttacttcataggccagttaataactgagtagcagtattaattattgccattcactaagtattttctgtgccaagcactatactaattatttttgacacatcatctcatttataaagccacatccaaaaatgacccttacataataatttagagccatacaggtaaaattgctggtaatctttattcccttggttcatagtgattttgctaaagggcctttcctgccctttgccccggaatgttgtatttgtttgtttactttttaatgaagtttataacacacttctagaaaagggcctctatcataaatcctcaatgagttctcacaaactgaaccagtaccccaaagccttccttgtgtgccccttgagccttaacatatatgattttttcctttggggagatttttcattaatagaaacacatcagttgctcttttgcgtctggcttctttcgttcgacattatgtttgtgaaagtcaaccatgcagtttcgtggagttgaggctcattcattctcactgctgtagcattccactgcgggaccatgccacacttcctttatccattctactgtggattggccaggactgtttttgcaatggagccatgggaattggaagctgtcagtgctgagatagaggttgaagggagggatggcctcccccaggcttctgggtattgtccagattttccttgagcaatctcattgtcctgatcagcctgcttctttccccggggcctagtttgtgcaaatgctgagagaagtggccactattagcaagagggttcctcagaaaagaggatccaagtcaggaggcctcttgttctcttggaagcagaatctcttggcagaattctttctgcaatgagtgagcccaatctgtgtgcatgtggctggtatgatgtctttctggggaaaccgcagggaagccggtgtcctgtggtggagcccttgtcaggaaagtttctacaccaatggttctcaacaggggcaattttgccctccaggggacacttggcaatgtctggagacatttttggtttttggttgttaagaccagggagagagtgcttcccttccagcatctagtgggtagaggccagggaagctgcttcacatcctacaatgcacaggacagccctcacaacaatgaattgtctggcccaaaacattattagtgcagaggctgagaaaccatgatctatgccaagcttcaactgtcactcatcgagcaccaggaagtactccctcaaggacccttcctctttagcccctcctcccagcctacttcttttgagtatttattattaatgacatcttactaatggagtcactaatgtgctgcacacccagcatgtgccaggcactccacggacattttatctcatcctcaccatatggttgagtaagctggcagttaagtgccttgccggcggtcgcatagctggtcagggcagagcagggagaggtacctgcagcctcaatctgtctactgaggccgcagtgctctctgtcgagcccacacccagtgatttgacagccagaggtttctagaaaaacattctgctcagttcctctcacagagagggagatttagacagttgttcctgcccttcagcactaagggggactggatagcgtgagctgcttgaagcccacatggcacatcacacttatgcccagccccaatgcctgagacccaggttccccagtcggtgttgccatgagagccaacgctgctccaaagagcagctgctgctcctagaccctggcaagtcccaccttcccggtactgggcccactatcaacaggcaccttctccctcccctccaccccagcctcagcttgcaaatcctaggagcagctgaaagctacctattcagtcagtccctcatgagtgtcacaagcatacatgagcacctgccatacgtaacgcagtgcctgagtacaactcacacactctgttcacacgtttcctctcttaaaaatcactgaggaccccaaacagtgtttattatgtgagatatcaatatttccttcattagaaattaaaactgagaaatccttaaaatctgctaacactttttaaaatgataataaacccttgcatgttaacacatataatgtaattttatgaaaaataacttgtattttccaaataagttttaaatggagaagagtgacattgttttacaaagaaatgttgcaaatctctctaatatctggcttcccaagacagctggattatcttacctgtttctgtactcagtctgttgtgatgtattgctttgtttgaaatgtaggaagaaaatctggcctcccatagaggaaaagggaggacatcctaaggcgatctccctggggccttggcctgcaaaccactgcgcttgtgcagtgggcactgtacaacagggggctgcacagccgtccccaccttgcaggaatttacagtcaaatggggtgggagtggggtggggagggaatagggggccatgggactgggtggaggggggatgtgccatcaataaaagagcaaccgtctgtggagaatttaaatacaaatataaccaaaagctgatctgcctgtcattatcacaattataaagaatgtcagccgggcgccgtggctcacgcctgtaatcccagcactttgggaggccgaggtgggtggatcacctgaggttaggagttcaaaaccagcctggccaacatggtaaaatgccatctctactaaaaatacaaaacattagccaggcttggtcatgggcacctgtaatcccagctacttggtacgctgaggcaggagaattgcttgaacccgggaggcagaggttgcaatgagccgagatggcgccgtcgcactccatcctgggcaacaaagtgaaactccatcccaaaagaaagagtatcagcgataaaggcaaagctctttccagaaaaaaatggttttatggcctaagttctaaacaatctccgtggttactgttggattttatgtagtaagtatatgtaagcttcaaattcatcacatctttattatttatcctttcataaatattgtgttctacattgacattaatctggagaactcccggttatgcacttggccccaacatgcacagactcaggggcgtgttcttgttgcaagagtaagtgtgcgatggttcagatcctttgacgtccttatgtctccaacctcagtggcacttattacctgcttctgcatgtaaacagtagatttgaaacaaaaaatgatagcgtagtggttgtacaaacaaaaaaccagaacttgaattatttcaattctctcatcctaggtgacccctgtaagcttctcatatgtgtttaaaatttaaagcaacaaaacagattgtgaacaatgagttgtaacatcttgtttgataggtaaaaatttggactcatacgaaaaatatttttactgcatttgaatatcttaaagttaaaatgtatttgtctttttaaaaattgttcactgctttataactaaagaagaaatcgagaaagtagtgatgattgctgatttttacataaatatgactgaaaatacttttgtcttatagagcagagggtcattaaaatgatccgttctgtgtgtcaaatacatgaggtataccactgagtcacatatgtaaatgttatcagctagaacagaacatggcatgagatgaggaccatgagagaggaatgagtagagaagcagattttacttccaagtggagggaagaaggcttcttggaggaggcggcatttgagtagggtgttgaaggatggtatccggacagaagagaatgaggctttccttgtacaatagcagaggtacacagctgataaagtacatgtgcttttcaagcccaaatacctttcaaaaaagaccatctaggaagaaaaagaaaaaatatcccatagaacggtgttgatagcaacacttgttaaactgcaacaaactggaaacaatgtgaatgcccaagtgcaaaccactgaagttggggactccagctactgctaagtccaacttcgaacaggcatggttttgaatacctactactagaagtcacagaaacttttgggggcaataatgatgaagttcagaaacaaaagcctattgctggcccctaagcactcacagtttaacaccagggatcttagcacagaggatgggtttccaagagtcgttgagcctcctgagatggtgcccaaggctgtgtgtgtgtgcattttgagtggggagcaggtgtcataactttcagcaaattatcaaagggacctgtgacctctgaaaaagctcagtaacaactggtcttgcagctttgtaaaacaagtataagaaaattgtatatgcaataatgtagggaaaaaaaaacaggactaaataatctacatgttgaatcataattatgaaaacactgtagacacatgctgtatattgctagagattctaagtatatttaaagatatataaagggttttaaggtttggaggatttaagtacttaaatgtacaagaaaaataaaataaaaaggccctgatcagctacagttagattggtcatcccaagacgacccccgggaaagggattttccactgtccttccgacctgccaccagcacccaactttgcaggttcagccacactcaaaatcactaccccagcagggtctgtcagatttctgagaggcctccacagttacatggaatgtcacccatgactaatatttgagatagagtccggagatgaaactcattcttccaagagtgcgtactattctggaatcagcagagggccagcccccagcattccagggaaattctatctttcccatgcaagagaccctcccatccatggccatccttcctagccctacagctgagcaggtctgtggtcctgctgaaaggtccaccctggagagacgggggacagcagcctgtcctccactctgcttgcctctcacagagacccaggactggaacccatattctttcattctgagctggagagagaaactgcagggctgacggttgaaggcatggggtctgtaagctgacccgaaaacatgaatcgccaaatgagtgcgcagccaaaagccaagagaatctggtacctggctacccacgatggccctctccctgccctcctctccacatcagctgccacagtgctgcgggcatgctgggtcatcacagttggcacagcagggagagaggcagaaagaggctgggccccgagacagggcagaacagtccccatttcatcatgaggggaatgtaaccacccaggcctcagcctgggtgtccctgacagccacgggctccacgtagaacagaggtcacagcgattctcacagccaggaaggtactgtgcgctggcccccaggacagtgaccagtttcgagtggggcgctctcagctgggaaatggggtccaacccaccagggaaaagggctgactaggggccaataggaccctccagatccctgcccagcaggctggacttcagtcccaaggtgataactagaacaagggggccgagcctagtctgtccagcagcgggtggaggagccgcggtaagaaaggcagtcgggtcttacattcaggtacctacttggggcgagaagaccaaatccagtcactccagccctggaggagtcagggcgcccacccggctgccccacagaaggtgcaattcctaaacatggtcacaaagtagcgcagtgacatctcagctgcttcggagttccaggagagggtttctggctcaggagaatggagtttctgggtgactggaagatgaggctgttggctaacttccctttccttcccacttaggggtctatttccagaagcattcctcatttcattttttccccagtggggcttggctaggggtggggaggcatggggaaaaagtgaagagaagagaacgaaatgcatggaatgcaagcggaggcctctttgtctacagcgttttcacctccacttgtgcaggttcatattcagggcctggtgaagtcagttctggcacggctctccagtggactggcagtggcccttaaaaatagttctcaggaagatgtgtaggtggcgacgctgagtagtgtttatgtcccaacatgaagagcaggcctcattgtgtgtgtcctgtgattacaactgtgtgaaaatacatgtgtttgagaaaaaatgctggaagaagatgcatgaaaatgtttatacgtccgttgagtttgtatctgaacttttgtctcttcccctctttatgtaatgttatagtatgtatatggtatattgactttcatgatttaaataatcagaaaataaatttactacgaaatgatgaaataaaggagtttgactagatcagtgatcctggaactgtagtgggtaatgaagcacctaaaaggctgctttttttgtttgtttgtttttcctgagacggagtcttgctctgtcgcccaggctggagtgcagtggcacagtcttggctcgcagcaacctctgcctcccgggttcaagcagttctcctgcctcagcctcctgagtagccgcgattacagacacacaacaccacgcccagctattttttgtacttttagtagagatggggtttcaccatgttggccaggctggtctcgaactcttgacttcgtgatctgcccgcctcagcctcccaaagtgctgggattacaggcgtgagccaccgcccccggccagggcttattaaaataagattctggggccctaactacagagttgctgattcagtgagcctggggtagacttggatatttacgtttctcagcagttcccaaatgatgctgctggtgtggggaccacagagaaccactagagaaaaaacaaaagaaccaagacttgaaactaggttactgacttccaggctagggtgcttcctacagaaacaacacgaggctacagggcaaacctcacttcacttctaactttctagggttgaaggggtgagaatcaacatccactgctcctggatactgacttcttccccagtagctacaaccccaaaagtatttaaaaccccaagatatttgtgaaaatgtatttgtccaaaataaaatatctacatgctaaaaagaaagcagtccttgaaatgaacaaaaattcccaagctgagcattacttgtaattggtagaaaaataatcattgcaaaagctaattaaccatccaccctgagcggctccttggcaggcctgaaaatatgatcaggaaaattcttttcctatgagtgaggcattatcaaagcagggcagagcctatgggttatccgttgactaggactgacctttccgtgactgccaaaaactttccagtgacaaatgttccagcttccttgtcccaagagaaactaaagtggtaagaaaacaaactgctttatactgaaacataacaagatcaacagcagctgtgacagcatttattaaactgtccgctgtgtaccaggccccatggtcagtaggaaagtatatccctgagggtacaaaaatgaaaaagcgtacatccactcaccaaggacttcccactgtgccagggtctctagccccttatggggtgtgtgtgggggcagggaggttggagattgggagaggcgcataatttcaacacaatgcaattagtttgtaaataacactacatgcaaaatgttacaagagccctgaggcagcgcaggttagctgagaagcctttacagaggaggtgatatctgagttgaatcttgaagtttccttcaagaagtggaaggacattgtaagcagagggaaaaaaaacatgaaccagccttgcttgactcagaggctggaaaagggagagtgaagttgggaattcttgagattttggggtggccctggatggggtacataaaaagaagtggccagagggaaggacaggaagggccatcctcagaagttttgtcctcatcctggaggcagggcagaccactgatgaggggggttgtttttaaaaggctgcctttcccagatggattgatagacttatctcagcctggctaaaaccctggccactccctgatagagaacaaggttcccagcaggcaagggcaggggtggggcccagcagggaccagttttgcaagctcacctggccctacacccgcaaacactcagcttttcctccaagacaagcctcaaggcttggagcaagtctctttgaagttttcttatgaattgctatgcttaacactaaatcatgggaaagattaacacccatgaaactgaagcaggagcacataacaggagcttaatatgaatcttccatcttaaaaatatcttattctacatctgaaaagagaaccatttggaaattccacgtcatactcacttatagacttaacagcaatttcaactttaaaaattcattcccacctgcattatatgacttgattcttacagtagccctgtaaagaatattgggtaggaattcttattcccattttagagacgtaaacattcaccatccgcggaccatggggaacacagctgacatcaattgcaagtcagtttctgtggtttactgcagcaagggagagctcactccagacttgggcttgtgctggttgagtctaaggaaggggtggaaagcaaggggaattctggattggattctgtcaaaaaggagtccaattcaatgattcggcatcataataatttaatagttatcactaattattatttaatataatcaataaatgatctagcagatgggaagatgaaaacagggctgagctggctttgatacagcaacacaagtcattcctgttagtcagaagagggaaatgtttagtcatgttttttgattttggagtggcctcctccctgtcttgatgcaaacacagatgtggagggtctgtgctgcacatgtttctgttcggtgggcattgtctctgttcacttgtgaatattatggtctggctgacggcagagctggtttttgttgctgtgctgtgttttcgtgtagtctctcccaaagggacttggggaatgcgtttgaggtctcttaatacctatgccctagctgcacagctttgggtgatgccctttacctccttacctctgatctctcaggagtaatagtgtcccttccacactgacattctgggtgtgaatgggactgattagaatggtcatcgtggtgccaggagatctgcagtggtgaccttccctggtatcagctatttaaatattatcaggaaagagaaatgtggaagcaaagttctatccattttaagcatgtgaccttttaccctaactgaaccttaattgactcatttgcctctagcaattcaaagattcccagacacccggaggacaaagatgggattctgtaagaacagcccacgcagtcaatgacccttatgccatttcttgcccggaactgttttattcagggcctgacatgcagcagtgtttgattaagtgctgacaatgaaaataggtatttgatgctgtttggaagaaaactcttacatttcttgaattgaactaagatgtacagaacaacagaaaccattatttttaagaatatttaaatgtgccaagttctttgcctatttatgtcaatgaatccagaaaaacaccctgtgagataggtattatccccacttcacagatggggaaattgtggctcagagtgttgcaaactctccttagaccactcagctaataatttcctctctggtatagctgaaacatgggcttgcctgaagggcagaggcagaagaagcctccaagcctcccaaggtcctgtgattctcattgatgcctacttctagtggttctggtgtccctctcagagcccacatgggtatctgagccttcagagatatctcatttggtttggggggttgtttttggtttttctgagtctcgctctgttgcccaggctggagtgcagtggcgtgatctcagctcactgcaatccccgcttgcagggttcaagcgattctcctgcctcagcttcccaagtagctgggattacaggcatgcaccaccatgtccagctaatttttctgtttttagtttagtcggggtttctccatgttggccaggctggtcttgaactcctgcctcaagtgatctgcccacctcagcctcccaaagtgctgggattacaggcctgaaccactgtgcctggccgagatatcccattttggataggggagcctgggacatattctcaacttccgtgggtctggccactacttatcagaagtttctgctcaccttacacaactgtgagtgatggccaggagcagcctcagtggcccaaggggaaaaacctctggatgaagccctggacccctcacatctcagcctccatcactgcccctggctacccaaagtcaagcccagaaacacagatgtgagcacaaacccaggcagcccatagaaggcacagccctgtgatgtcaagcttaaaaattctgggctacttttaaggtcaccagggatatttcgaaagagctgaagctttttcctccatccaagaatcctctatcttccaggttgtttttatgagctgaagaggaccctccacggctcctcggtgacttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcgttagttcttacaggttttgggataggcggtggagtttggagcaatgttttgcgggcagggggtggatctcacaaagtacattctcaagggtggggagagaattgcaaagaaccttcttcagggtgggggagattacaaagtacattgatcagttagggtggggcagaaacaaatcacaatggtggagtgtcatcagttaaggctattttcacttcttttgtggatcttcagttgcttcaggccatctgggtgtatacgtgccagtcacaggggctacgatggctcagcttgggctcagaggcctgacagtctccttcctgcctgcgacacaggtctaggaattattccacagttgggcactcttggtgtattattgttcatgccctggcccccacctttgtgccgcatagagggactccccttcctgaggttaatgattgggaaggtgttaaagcaggaagaactgcaagaaggcactcgtgagtgagcctatccactcattcctggaagataaacaaacgaccagtgtggctctccatactcagagggtggtttctggatgtcagagatttcgccacacaccagctctgtgccaggccttgtgctaggaccccaacatggtcactcgatattcacacagtctagcagtctgccaggactgccaggacagaggaccacagactgggtggcctcaacaacagaaatgtattttctcacagttctggaagtgagaagtctgaggtcaaggggtcagcagggtgggtttcttctgaggcctctctccttgtcttctgatggctgcgtctcttctgtctgcacacagtcttctatgtttctgtgtccgatctcctctttttataaagaccccagtcatattggattaaggcccaccccagtgaccttatttcacccaaatcacctctttaaagactctggctccaaaagcagtcacattctgaggtactgagggttagaacttcaatgtatgaatttgagggaacacaaagttcagcccattacacccagcaaacactttgctaggccctgctgtgacccgggtcctgggcttggcactgggcatacagtggaaactgcaaatctctctttgttctatttgagcttcagcaactctccggaagccttccgcgttagaaaaaaggcttacaaatacacaggaaatttgaaagtgagtagtaagtccacaccaggcccagacagggggcctgtgctgaaaggtgcaggaagcagcagccctgctgagacacacaggagccggctggccggccgctagcagggtgggatggggagtgggggctcagggagcctgggctggggagaggcatccgccctcttcaacagaatgattgggactttctggcagcataagcaataaccggcaggagaccaagaaggcgccgtttagctggctcatgtgtgagtgagtgatgaaactcaccctctggcttggcgccttatggaactatcaactctgcatgggtgtgctcagtgtggaccccaaacctgctccctctggctttgagaggtatttctcccatacaggctggcttcagccagggggttgcctagactcgcccaggcctcagacgaggggaaagggccaaggccggctgccactttctcatcatgtgcctgcctcccttcccaaatagaagggtcaagcccaaattagaagggtgggatgatggctggtgcctgaggacagagctggggctaggaggacaaactcctgggctcctcttcatgtctgggctacaagatcctggcataaacaggggctcctggcacagcggaaataaaccatgggtccctgagggagactctgggtgagaaaagagacccagatttggagttgaaagacctgggcctgagtcccagctccatcacttcccagcacgtggccttgaacaaatcactcaaggcctgcagacctcggtcagtcattagtaaagagaagattactattatagagaccccactgggctgttttgagggtgaaatgagaccacgtaagtgaacgcactttgaaactatccattgctggtcacaaaactaacgtgtgtacgcatctatttactaaatagtcatataatactcacccgattcatatgctactcccagtgtttttctctactttttattacaaaagtgttcaactacagaaagaagtttaaaggatacaatgaatttccatattccctccagatagactcaataactgtttgcattttcgtatatttgctgtatgtgcatatttatatgtgtgtgacttgtaaaaccagttgagataagagggggaaaggaagagagaaaaagacacacacatacatatcccatatgaaagttgtggacatcatgatacttcaattctaaatatttatacgctagtatttctttctttttttgagacagagtctcactctgtcacccacgctggagtgcagtggtatgatcttggctcactgaaacctccacctcctgggttcaagcgattctcatgcctcagcctcctgagtagctggaatgaatgcctcttactaaggacattctcctacatagccccagtaccatcaccacacctcagaaaattaaaaataattttatactatccaatatccagaccttactccaattttcccagttgtcccaagatagttgttgatagcgtttttcagactgggatccactcaagatcctcctgttgccctgtttgctgagcttctgccatgtctccccagtgtctgaggttgtgagcatcttggttacttgctgccaattctcacactcatctgtgctgcccaccgtcccatggcctcttgcggacctctctcccatggcgctggctccttgcacccagctatctgcttgcacacctctctccctgctggaggataagcaccccaagggcagtggccagtcttagctactgttgtttccccaggacccacacaggcctggcatggagcaggcacgtggcaaatgactgttgcatgtttgaatcttcatcagagggctaagcaacacacacctttaaaaagtgagtgagttttggccaggcgaggtggcttatgcctgtaaccacagcactttgggaggccagaggcaggcagatcacttgaggttaggagttggagaccagcctggccaatatggtgaaaccccttctctactaaagatacaaaagttagccaggtgtggtggtacgtgcctgtagtcccagctacttgggaggctgaggcaggagaatcactcaaacctaggagggtggaggttgcagtgagccgagattgcgccactgcacccagcctggacaacagagctagactccatctcaaaaaaaaaaaaaaaaaaaaaaaaggaaatgagttttaagtaatttcatctgacaaattctgtacccctgccggagctcatggaaagcatcccagagacccaggtgacctagctcaggccctgccctacttccccatctacaagtggccactggggctctgaaatcgcttggactctcgactagtctgtgctcgacatctgtgacaggaccatcgactgagagggagagctgccctccagaccacaagtcttctctggaaaacacacacgtatatgagaagttggctgtgttcccattataggtcttacagaagtgattccaagtcttgtgagtttctgtggaaccagaaaaccacttccggaccagcaggagtgagaagaggcgcatgcatatcatgtttgcattgttttcttgcatgtgtcacttcaccacaatgctcaggacctcaatgagagttttaagttctcccagcttcaaattgtgctttccaggccagagcttctcaaaatttaatgtgcctttgaatcatctggagagcttgatacaatgaatgtttttttaaaagtagatttgggatgggctccaggatcctgaattcctaacagttggtctgggtgacgccagtgccactggtccctgaactacactttgagaagcgaagttctaaaggtcacaaaacaacttctcatttcttcagtgaactggtaattagcacctacagctaaatataaggcagtgttctagcattggaggaacaaggaaatgggaagaaatacaaagaagaataagacacaggcctttgactcaaatccaactggatatccctttatactacgtctagcattttgcttaagtgggacctaaaaagttactccaagctgcctcccctagggtcttctggctgtttctggtaatgtgtattcctgctgatgctcaagccctttgcaacaagttcctaacatggtatcaaatactgggcacactagcaaacttcagccataaattagggcccaaatgttgtcaccaaatggctgtgtgactttggataaatcactctcctctcacgtggactagggttgggagctcttcaagtcccttcctgtctgccaaaaggtttctaagcagtttccaagccgtttcttgcagttttcccatcaagccaggtgaaggcaagtgttatgtccccatcagggtcccccagccccctcttcttagctcaggactggggctttctggggctcacctacagtcttcctcctttccttcctaacttcacacgcatttatcaagcacatactctgcatcaaacctgtgctcaaggacagggaggcaaaggtcaataagatgcactccctccctggggaggagacctaaaacagaccgcaggtgccctgctgcgtggctggctcaggctctcagagtgtgaaggagagcacctcactcagcactggcagaggccggcaggcctaagtgggccttcaccatatgccaggcctggctaggagcttccctggaagattccaggtgacgcccagcaaccctcaaaggaaaatgctagtattgtccccattttaaaaatgggaaaacaggcttaaaaagtcagatgtctggcccaacatcacacagctaatatggattcagtgaaatatatgcaaaaatactcagcagagtggcaagtagtaactaaacggtaactaaaatacctttttcaaatgacagaacagagagtgggggccagtaatctgcactctcagacaaaactgacaagtgggagaaaggcttgtctcccctgaaggacaaaaaccaggcttgggactggccacacatgatgagaaaactgtgagaaaagaagcaggagagactttggaagagggcttggcaggccggaaagcgctaggtgcacacgacgggcagtgggggctcaaacacaggtgggagcccaggggaggagggagcgattagtcatgctggggaggctccaagggccctttgtccttcctagatggctactcagacgccagtctgcgagcaccccacgctcagctgctccatgcttcagccaccatgcaacccatctggataatggactgttatgaagcatgttggcagccatcgattaggactaaactctatgctcattgggttgtatttgcaaggatgctctgctaagatccacagcagaggtgcatctctctccttctcatttgatggcttggaattaaaatgccacccaacattctctgccaaagacatgaagatttatgggtcactgtcaatatcaacacatgctggccattatttgagtctccttgctgcttgggactgattgctatttactttgaaagataaatgtggctttgtaatccatgcaggttgctgggaggaatgggttttaaatgcatttgttcttttttttttttttaagacagagtctcactctgtcaaccacgctgtgcagtagcacgatcctggcttactgcaaactccgcctccaggttctcctgcctcagcctcccaagtagatgggattacaagcatgcgccgccgcaccctgctaatttctatatttttaatagagacagggtttcgccatgttggccaggctggtcttgaactcctgacttcaagagatcccccctcctcggactcccaaagtgttgggattacagacaggtgtgagccaccatgcccggccttgggttttaaatgcatttgtttcttcccttggagacctttctattccactccattctgctttgtctggtgatgttggtcccaccctgtacccaccatcagatattctaatgtcctccgaggctctggaacaaagaccagagggaccagcctgtcctctgtccagagtcatcagtatgacagtatggagagacccttagcaccttagtagaaaaattgcccctgtcttatggggtgacaccactcatatatgatctggggcaagagtcaagacccccaaggagcttacttaaggagcaataggttgtcccctttgcctcttctggtctttcgcgtttctgagcgtggtgtggaaactgagtcaggagctaaatcaattaggtcactggttctcaaacttgagtgtgcatcacaacccactgaagagctttttaaaacacagattgtggcccccactctagagctcctgattcaataggcctagggtgcggcccaggaatgtgcatttctaacgatgtcccaggtgatgctgattctgttgctggtcctgcatcccacctgaagaactgcctcagaacaagagtgggaagcattagagaccaatcatgggagagatgaggctgctggcagtgtttggcacttgggaaaaagaacagcaccgtctaaaggagaattttattaagtttcagtgaacaatgtgcaatttaaatctttttgtaggaaatcgtcagttaaaggtcaatttccataagtatgtggatctatgtattttggaaatgcattgaaatgttacatgggtctgggaccacacaagctacccactggtggtctgctatacctaggtactaggaaggtcaaggtactgagtaggtcacagtcttgccaccgggatgctttgctaactttattgagtgaaagtagtaagaaatgcctggtattgataagagcccaccgtgctagtttttaccaatggtccctaagcgattttccctgcagcagtcagggtttacaggtaaaactgggcccagggcaataaaggggtacagtctaaggactctgggagtttcctgatgaatactagaggtctttggaggcagacaactttttctttgcagcgggacttcacattataagccatgatgaggctgcaattgcgatttatcagtgctgccttccttccccaggcaacgtactaggaagaatcatggtttactgaaggcaggctaccctccccatcaaagcctagtggactgggcaagcaatcggttgggattcattacttggaggcatgtatccccagagcaatcaaaggccctgaccggcacaggattgggaggctgttgctgagacccaggcctcgagtgacaggtagagcagtggggtggaggaaagtcaacatatttggagatacgaaaaaggcaggtaagtaattgtattcgttgagactttgggtcacaagaataataatccaaaccaaattaacttgtggggaatttatttactcatgtaacatagatgtccaaattataagcttcagggacagctggatctatgaccttaataaagtcaccatgtttcttcattcgctccccacccccttctcccttcataacacttcagagtgccagattcctcagtccttggaactcaaacttccagagagaccacacttcatcacatacctatggcacatgttccagaaatgattctggccaggtgtccacccctgaatagatggccacaggcaggagaatgggatgtctgattggtctgatttgggaaacatcctatccaccacttggataggatcaactttacccaaacaggactgatcaggatccacatgggaggttcgctcctttggaggaggagatgccagcagaccgtggaggactggctgtgaggcacgaggatgagcgggaggcaagggcggctcctgcttccacagaggcgagcaggaggatgctcctgccctgctcacacagctgtggctctgcaccttgctccccgctagaaggtgggctatcgtagctaagctacctgggcagagcagacctcgtgagtgtggggaaaatcctgggcagcataacagactcatttgtagggcaaagggattttcagttagttctgtaacacactggagaaccaacacaatgctcaagcatcgttcctcccagaggaagcagatgggtgagataaataaaaccacactttcattggcatcctaggatgctcggggccctattttcaaggctgtgtatgttgaatacacatttcagtgatgctttagtctattccacagtgattctcaaattgtggcccccaggccaacagtatcaccatgccccgggaacttgtttgaaagacaaattctccatcccactcaagacctcctgaatcagaaactctgggtatggggcccggcagtctgggttttaacgcaccctctgggtgattctgaaacaggcaccaaagtttgagaacgtctgcctataaatgtatttgatccaatccatcaagttcaaagggaccacctactataaaaactaaggcttatgttcagggtttattgagcagtctgaatttagaagagtgtgaacgtgaaacagttttctatttctcccattccagccttcagccacgcactatcaagttatatgcttccatccctttatagcatcctgggcagattcctttaacttttggtcagttcgattattaagttattttactttattctaaagcctcaatctcacatctgatttgacattcttcccttctctcatgagctagactcaaagaagatggaatctgcagtggggaggggataggatagttctgctctttcactcctcttttctctggagcaccgtggggtagggtggagtgggatggggtgggagggcagggtgaggcctggtcctgggattgctgcccctcatttttcagagcccaacccccatgggactgggagctggtagtgagggtacagctgggggacacagaggtcctcatctcttgtgagtggtctgctcttgctctggttcactgtggtcccatctgctgctggtggccttggcctgtgaagatgtggatgtggttttctgagggccctatcggtgtgagcccagcccatttgtcactaaggacagctgtggccccttttggcttctccaaaggtccatgcccctcctactctgtcctcctgtacaaagtctcagaaatgacttcggtcttcttccccgcctctgaggattgatgggagctgaggtgtggggacccatcccctcaggtacactgcctcatagtatttcttctccccgcttggctgagcctcctctcttcagatggctaaagcaggcacaacccccacgttgccacacagtcccataaactcctatggatacaggtcagtctctctccaaaactccatcctcatatccccagcaccacatgggacctagaatagcaacgtctcagccagcatacagcctggaacaatatgaccatttctgcctcctgcaggcaccctcattccgcattctcggtaagtgattctaatcggtcccccaacttgaactctagagactaacaatgggaagaagagaactaaattattctcccagcaattcctactctccctctcccacttgtctgtctaacatgggctgggggaaggtggtgatgggaatagagactgcttctttgagagccctggagtttgaagaatttggccccagttgctggcaactctcattacagagtgtgggttccgtacattggcgcggtggcttatgcctgtaatcccagcactttgggaggccgaggcaggtggattgcttgaccccatgaggtcaagaccagcctgggcaatatggtgaaatcccaactactaaaagtaaaaaaaaatcagccaggcctggtatagtcctagctactagggaggctgaggtgggagaattgcttgagccacagagagcgaggctgcagtgagccatgatcatgcacagcaagaccctgtctcaaaaaaaaaaaagaaaagaaaagaaaaagaaaaaaaatggatagaatgtgggttccttagcacctgttgtttcagcagatgtcctggtgccacatttgctatttgcaatgcgtcttcacatacattatctcagttgaccccacagtgattctgtgaggtgtttaacctataaggaaacaggctcagagagattaagtgacaagcccaaggtcacacatgcagaggtgatggcaagatgggaacccagcccagtgactcctgagcacctgttctctccctgctgtttcatgcaggtgcctcagccacacttgtcttccagctctgggtgaacttggagcaaataaccagagaaatagcttgtctccaaggccacagagcagctggcaggggagagtttggggcaagggatttccttagggaaaacaccaattcgttctggtcatgcccagtcacatgggtcccaaccatcaccttcccaggccaaggtcttaggttcccctggaacccctttggctttactcccttcctgggctgggggaaagggtggggatataagctggtacttccaaagcagaaagctggggtttggggctgacagagccgaccttgagcttgagctccatggagtacccagcccaggtcaaatggggtcaggaagccatctgtgccttctggatggctctgtctgaatgattcacttctgcctatggtgggtggaagttcatggttttactcccacatggtgaccacagtgcatggcaattttctagtcaacaggtggggttggggcctctgctacacacaagaggcttctttcttcaagtttaagacttctgatgctcacaagaccctcccatgcccttaccacgtgcagcgctcacccccagggcctggggtttggtgagatgtgtcgcccacatgggctgggatcatattttccccagggaagatgaaagccctcaccctctcacaaagccaattgctaaattttcaagaattttgcaagctgatttttaaacatagccattattttaaaattacattatagaacttacaatgaaacaaatgtttaaaatgacagtaataaatactcaaaactcctctgttctcattttactattgtctctgtctgtaaggttatttccgtctgtcgtactgtgtggtggaaatactattcaatgatacaccaaagtgaatctcttcccaactccgttatcagtaacatcacagtgggagcttaacagcagccatgatggctgtatttatacatggacattggcaaacattatagattagggtttgatgtattgttttgttgactgtgtaaagcaaggttcagcaaacttttctctgtaaagggccagacagtaaatatttttccttttgtaggccataggtgtctgttaaaactactcaactctgctattgcagcacaaaagcagccacagacaatagacacacaaatggacctggctgtgttccaataaacctaattcacaaaaacacatggtgcaccagatttgtcaggccatggattgctagcccctcatctagacttaagagagccatagaaaaaaaatgttagtaatgaagattaaatttagaactgtcccaattgtaactagcacaaaacattaaggaaatattcttccagtgctcaaaaacaatgatttgattgagcaaagaattcatgtcattgttgaatgattgagtttcaatgtgtccttatttcatttttgtcttcttcattaatgtaaataaacctgtcagccaacctacacttgtcatttgccaccataggttgactagtgagacaagggtccaacaaacatcagcaaaagtattctgtgaaaatcaattgctatttggagtttacaataaagaatactgtatatttcattattatttataaattgtataataccttgatagcaatgaaatgcacaatatatgcatgtatgcgtgtatatatatatgaatatattttcttccagagagccagttgctgagtatccaccaatgcaccactgcctgaggggtgtctacataaaaagagacctaacagcccagagcagcacttgttaaggacccaaggcatggtccagaccccaaggaagggaagggggtcagggatggatagacaatctggaaagttctccaaggtggtctgagaaggcttcatgggggacagagagccgtaaagcatggtaggactcaatgacaaatgaagaatggctgtacttcagacaggcacacagcatgagcgcaggaggcgaggctgaagtcagggacaccgagacaagagggtgagcatagggaagcagaagggaatgaagtggggtcaaatatatgtaatggcatggaaacatgctatgagatcaagccaaaagaaaagaaaaagtagaatgcaaaattttacatttgcattaaggaaaaaacacgttagaagaaaatgcacttaaataaattgctctgtgtgatagtatgatagctgattatgtatttatcctcaatgctttctgtaccttcctgttgttctgaagttgtattactttgatattcatggggaaaaataagcttttccagtatgaagggcaaaaagcactgagccaaacctgaagccatagctaaggacagggcacatctcccctgatgcagcccagaggcccctggagggaggtgctggggggtgaatagagactaggggtgtcactccctcctaggaggactgcaggagcacatgggtagccaatgctaaggcctcctgcccccatgggcctaagtagccctgtccacactggggatctgcccgctacctcatagcctcaggtagatgtctggtctctctttgcaaatgtcccccgcaacccatcacattcataaaggcaacaaattggggaaaacgagaggtcctctgtctttttagggcttcaccactgctgttttcccaactaaagaaatatgtacatatgtttaagtatactttaccatgcgtagaatgggaaaaacagaagttattctagagaacatctcgctcaactcgtttattttactaataagaaaatagaaactatggaggtcaagtggcatacccagggaaacagagctaagtgagaactaggctccagcagagatgatgcccagggccgggcacctcctttgtcagcatgcaggtatcatcagacaaggccaaaacagcactgggcgatgtgggctgagcagcccttggcttcgaaaacatgatttttttattattttttgagacggagtttcactcttgttgcccagaatggagtgcaaaggtgcgatcttggctcaccacaacctccacctcccgggttcaagcatttctcctgtctcagcctcctgagtagctgggattacaggcaggcaccaccacgcctggctaatttttgtatttttagcagagacagggtttctccactttggtcatgctggtctcaaactcccgacctcaggtgatctgcccgcttcagcctcccaaagtgctgggattacaggcgtgagccaccgcgcccggcagacatgacgtattctaagcactcctcaaatttacctgtggacagcaagaaggcctacaaggcaccccgtttacgatatgccacttggctccttcagggcagagctgcagcagcagtccttgtttctctgtgccccacatcccctcagcatgtaagaccacttctgccccacccattgctgaatgggaccttcagatgctatcttctccataaagctttctatgactcaggccgcatcattttgtggtcaactactttcactattattgtgtttattctccctaaaccagccaagcaatcccatttggtaatcgaaagagcaagtagcactggcttggtcatttccttcacataaacctgactgaactggatatatggtaaggatttccatcttgtacataaacacttgtccacctccgtgattcacacaattccttttccactctatcccgggcccatgtctccatcctgcccctgatgctggctctgcaggcattttctacatggctgtctgtgtacatgccgtgtggttagtcttaaatcaagggctcctagagtgcataggacataccagtttatactttttctcatcaggaatatgtgtagctggaggattaagaaatacattttcatgagctagacaataacaaaaattaaatggcaaaagtccttgctgtccttagtagctagggagctttaaaaataaatacataagcacctgtttccgtttttttactcctacagaagcagggaaattgctggagaaaaaaaaaaaatgtaagtccatatattctgtactgtgtcccttggaagaataaaattttaaatgaggtcatcaggaagtgcttcctaaatgtgaagttcacagactgaactttgaagtttagcaatggacttcccctgagcaaggtcggcttatgctattgttagaccagcagctgagcctcccccaccacgtccttctacctcttgcaattaaagcacagcccaggcaggtttttcttaaacaggatttttctttatgttggtgcatatgctgctgttataatagcagggacattgtcctcattcccagctctttcctccaagtcaaaacatttagaatgacaccacccaaagaataagtcttacttgaggctttgcaacctctaacccttcccacctctaaccttttcccatctttatccccgttatcttgggtgctttcagttttcagagaccagctttccaacagggctaaataacactctatggtttctttccccatcagaaaccaaagaactccctgtttctcagcccttgccagcagaatctggtcacccctctgcccctcaaaattacacatcttatacaactagctcctgtccctgcaccattcctgtcccttgtccttgatcctggtttcccagtggaacaggaaaaaggttttacagagggttttttgccaccatctctttgttcctcaggagatgattaagttgtgcgttaagtggggaaaaagtacattaggtcaaccccaaaatctgccatcgataacatcagagtatgtccatggctttattagttttctagtgaatatttaagagaaaaaggtgctaggtcatagaacattgagaaggctatacatctccccttggctataggtgcaatacattccaagagggagagatggtagtcatgcctcctatttttttaggtgaggtatgtattttgtagttctgctgggacaaaaacagctttcagtcattgaaaaccaaaggcccagtggacatcaggaggagatggcctccctcactgcaagacgacctctgggtcaaagcctagtgaaactttggcttttcccagcaagcaggaagtgacatagacagtgtctttttagagacctcactttggagaatgctcagtgaggggcaaacatttgctggtgacattgtagttctgtcctttgctaagcttgagtgaaaatcttttggagaatcgacttttttctttcttttttttttttgatgtcccttagagagctcacaataaataaataaatcaaaacaaagctaaaagttcataaaaaagtctcaggcatggtccagattttcaggaaaccagcagtttctggaggaagtcccacccgctcctgaaaacagaaaaaataaacgagagagagtccaccagcaaacaggtgtttagtcttctctggagtcatattaagcaatttttacatttatggaaaagcaaacactccccccacatagggtgtggcccacactgggattgaaaatcagcctcgtgctctgcaccgtgttctggtggcttctgcagctgtcacaggaaggaatccacacccgtccccaaggacgcctgcacgggaacagatgcccgctcccttaccccttgggggaaggacagaggtatctgagggattcagccctgggcactcctctcagcttcctccttcacaggcggggccctgggaggccctgagtggggccactgcgttgctatgagatcagaacggtagccagttggtgggtgcagcaggctcacacctagcaagaacctacctctccctttttcctaagaagggaaaacaactctcaaggctcaccctggaggcccaaagggaaggctgtatgggtcccgtactgcagcttccaagcccacggtggttacgtctgagcaccctgtagggctctgctctgaaagtcttttcagctcccaatgagcattgttcaagccgatgaacatccccaaaacccttccactctcagggcctcggccccacccaccacctggcatctgtctttaaggatgtttataacagagttctgaaataaagttttggctttttcctggagttctaactctgcaggagaagcagtgaggtaggactttgaggaattcaggaagtggagaacagctcatggtgagaggaaaggctggggccgacttgggatgtggatgtgcaaaaggaaaggtgaaggctggatgggaggcagggtgggcacagttaaggtgggccctgggccaggatggcctcccaaccagagagtagccttcaacatctcagcctcgtactgcgtgccagacactctaccaagccctccacttaggtaataatcacgtcttccaccctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacacaggtccatttcctactcgccatgatgttttccagggagagtttagagaagctctggagctgggaaaagagggcagctgttagagaacagccagcgagaatgggaagtcaggagacccagagctcaggaacagacttccttggcaggtggcgtagtcccatggcctctttagctctcagttttctcatctgcaagaggacaatgggccagattggtgcttctctgagagaaagtaccagtggttttgaccaagggactgacccgaacatggcatgtaagaggggtttgtttggggttggtccacaggatggttacagaggaaggaagaaagccaccaaggccaatttgaagatgtgcagaaacccagaagtgaggtgaggacggcagttctcaagtgcagagcttgaagtggtcactgctgggagggagacgtcataacaagacccaggaaacacttcaaaggaaaaactaacagcatttaaagattggctgcaatagtaacaataaaaaaagctaacatttactgaaggctataccagttatcccaccaagtgctcaactaccaatcctcacagcagccagctgcaggaattatcattgctcccactttatagataaggaaactgaagtttatagaggcagagaaacttgcccaaagtcacaaagctggcaactcccagagccaggatttgaacacagtctcagtacagagcctatggtttctttgtttttgagacaaagtctcactctgtcaccaaggctggagtgcagtggctcgatcttggctcactgcaacaattgcttggctccctggttcaagcgattctcctgcctcagcctcccgattagctgggattactggtgtgcaccaccatgccaggctaatttttgatttttttttttttttagtagatatggagtttcaccacattggccaggctggtctcgaactcctgacctcaagtgatctgcctgccttggcctcccagaatgctgggattacaggggtgagccactgggccccgccacctatgttcttaatccccgtgcaactctgcctcctatctatgtgccgaagaaaggaacaacactcccctccagacctctgcctttcacacccattggccttggatgcccttgtctccccccggttccgattcccttcaaattccagctcctttaaactttcacaccttactctgtccacccctccacacctgcctcgtgctgtccccccgcccccacatcccactccacccccacagttcaaacctgctcatggaagtcctggaatgtgttttctccctcatcctcagtcccacccatcacacagcctgcactggatcatccaagttacatgccaaatgtctgtacccctctgtgtccaagtgaggcccaccttcctctttgcttctgtcatctattttcctgtttcttgcatgcattgcactgtgttcattatgtctattgttgactgcttgttcatatttccaccttccctataggatcgtgagtgctttgaaggcagagagaggctgggccttagtacagtctgtttgcagcacatggcatatagtggatgctggagaaatgttgatgactgaattgacatgattgattgattggatcaaatgaatgaacacaagaataaatgaacatcgggatccaggaaaggggtccttctggcaccaaccctattctgtccccctaaacagtattacatttagtgtttatgataaaggctttcagcacctttttgaagagttggtaccactggtccactttctgccctgcccttaatccatccaattggtttagatactcacacatacattctttctttctctctccttcccttactggaccccagaccaaagccaaagaaataaatgtcccctctcctgctctgtttccacttagataaattaatcctcagcatgagaggaaccaaagccagcaccttagaagtcaggctcctgtcagctcggtttgctcacctgcacacagcccttgacttcctcctcctgtgtgggaggagcacagccctgactcagaggccactccaggcaatcctctcctcccaggcaatcctataaggaacccactggctgagctctggcctctcggcagagggggcaggcctgaagaaccctttccaagaccagctgagctctgctggtccgctgggccctgcctgcagagttattggcggagttattcttggtgctcattagcactgcacaggctgtggattattcctttattgctaagtggcccccagaacactgcagactcatccctccttttgaagtccttgtaaaagactccaagaagtcgattccaatctcttctctcccagcgtggactgcccctggagcagcactgggggtgtgtggctgttagagtggcagccaagggccagctccccagtgaaaggtgatattgtgcttctaccgcacacctgcacgttgggatggtgtttgccttccggcctgactgctctgttctcatcttccatggacatggaggtgggaggggaacttatgtgtcattcactccagggtcctgatggccacttgcgtagagcaaagaatgttggtagggcctgcagtctaggttctagcttcagtgagctctggggcctcgggaaaagggcttgatccctcagaacatctgcaggagtctgtgacccagaccacaccaagctttcagaaactgctctgctcttttactctcccactcctctccaccctctcaagctgtgctatatccacaatgcaccagcccaggctgactcaacttcccgcccactgctcccctttaagctacagcacccaccattttgccccaaactcgtctatcctacctgagctcctgcagccagactgggtcacccatgcccctcctctaaccaggaaagaaaggaaagaatccatcaggtcttttctgtgtcctgagattgcgcaggtattcacccgctccactcccatctccttgacctctttcttgccctgtttctcggcgacctaggcattgggtcctggtcagttttccacttttccatcactcccttaggacccctcaacctctctgctcatcaaaaaagtccaataaaggcattcatctctttgaatacttaattttacagtacctcttgcataactttcaagtttgaggtcaatacaaataaaatcatttaaaatgtctgatattaaacacttctgacccgaaaagcaaaaagccttttaacagatagttacattgatacaagagtccacaatgacaggtttcaaagatgaaagtaatggatcagtaaatagaacagtagagaaaacacagatgaaaggcaaataaccccacctgaaaaatccaaagctttcattttttttgaaaaaaaaattgtcaaaagcactgtattattttttaaaatcatgataaaaggagcatgcacctgtcaccctcccaaccccctctatacttgcccctttctatctttaagtgctgtggtctttgtggtgactttattggctcaagtttcctaggctggtactctcagagcctggtttcctaggagcagtactcataacgcaggtgcgatggacacctgtaggtgggtagtgccgcctgtgtgaaccaactcggctccaaagagcctaactccctatctgcatggttaatccaatcaaagcccaacctgctttcccacacaacagagttcaacagagcttttcattaaagcaacacatcatagcaaatacttaactagtacaaataaagcattttatttaaagcaaggtttaaagacatataaacattaagcatcagagctccattctttagttgctattcatcacagcttatgccagtccttgaattctgtctaacttgggtagtagccaattttctaactcaccttcaacttcttgggatgagtccttcccgggctccttgtttttctagaaatttcagtggcttgaccacacatcaaaacacacagggtggccaggcatggtggctcacacctgtaatcccagcactttgggaagccaaggcgggcagatcatctgaggtcaggggttcaaaactagcttgggcaacatggtgaaactcggtctgtactaaaaatacaaaagttagctgggtgtggtggtgtgcacctgtagtcccagctactcaggagactgaggcagaaaaatcgcttgaacctgggaggtggaggttgcagtgagccaagactgtgccactgtactccagcctgggcaacagagtgagactctgtctcaaaaatggggagcgaggggggagcccaccacacaacaaaacatatagggcttctcatctaaagtccgaataaaagaataatactatggctggtttgcactggaggaaagaaaagccctatcactgctaccttacttttctgatgttttgggttcctatgtcttatcccctcaggaaccaggggaaaaagaagattctgtgtcaagtgcaccctacatctgtccatgtcaccccccttcttccaatcagaacaactcatttcccccacttgactgctcccctaatctttgcaccttggagcaggatgtgtttattgattgatggatatttacttataattggtacctcttatgaaagccaacagtttttacatctggcttttaacacagactgtgctcttcaatagtcttagtgtaggctgaaggtttttcaaattcacatttttagaaaagagttccattaaattccacatgaacaacagaaaaaaatttaaatgggacattacagtgatcaattatagattgtaggacatgactgacatgtagggctgggctgggaggaagagacaaagaccaaatgctcaaccaagggcagaggtggggtgtagattacgggtcagaaccgtaacataacggatggagtcccaagtgaatccaggaagttggaggaagcaggtaagtacttgggttaggcattcacaggcctaggaagtcagctggggcaggaaggctcagacaaggcaaggggaccaggaagcttggacccgtcctgggaagatagagtccaagagggcagtcatcaccggtcccacactaaaagcatcaaagctctctaatcttctgtcttctctactctctctggtgtgttgtcaaggaaggaataggtacgtgggaaactagggagacaatcatagccctcgatgtctaccgtttctaattaatacagggcagaggaattagatcttttggtagagatctaaaattcctctgaagttctatcaagccccatctcctgatgattcagtgctagttctaaaataggaaaacttacttccaaaaccaacagatgtttgggctgtcatcattatgcctgtactaaactcacttgtgatttcactgtgaagtcctgtctgtgtaatttattaggaatcatttatgtaagattatgtagaaaatgttactagtcgtgagatatctatccatctcaatgatttgacttttacagcaatgcgatggaacgtgctgagggaccatttggtcaactttccacctaatggtggtgtgattagaactcctagcgggtgactcatagagagtgattagaagtaaaaaggttctggaaattcccccacactctttaaggcagcctttgtcaggtgtcttagtttcgtgaaaggtagactgatgttttccatctggtatacaaaacattttctaagtagttatagaaccttgaacaagccacttagctctctgggcctgagttttctcatcttataaaattaaatccatcaatagatcacatgatctctatggcttctttattctaaggatgtatggtaattttaaacacttggttagccatcttgaccaaactagcatcacaggtaagaaacaagctgcgaagaccaaaattcttctctggtttatacactctgggtcagaggcaaccactttctatgttgtttgggctacttttccctaaacacataatggctttgtctgcatcaaaggtcatcttctattttcctgcccattcatatgaccccataagaccttccagcatctcagtcagctgagcattttacctcctgcaaagcacatggtttccttcttctctttgcaggtcatatgaaatgctcacacagtacttactgtaatcacttcgtaaagttgattttcacatatcttcatccagaaaattatcccaactgttatatataactttattctaattgaataattccagttttcaagacacttttcagacacccattgtcttgtctgaatcctcatgacaacctcatttttttatagattatacagcattcctacttatatataatagttataactttttattcctaataaactttcgcatgacgtttcatcagattctgatagtttcttttgtttttcattcattgcattcccatccaaatgtttactgaccctgggaaataaatccagtagaccaatgaagcatgaatccaactcacagagggtggttagaactaaaagctgaaatggacttccgtgatcacctgacccactcatccctgaccgtaggctcttgttcacagcggccaaaacgtgcatgtctctcaggggcttcctgcttgtggagcagaacctttgcttgcgggctccttgtgtctgtgagctcctcagaaccgctcttgagctcacagtgcctgatttgcacgtattggtttccgctccgttgcttattctggtcccctcatagaagcaatgttatcctttcttcaaacccgtcctttcccagagagctttgcagccacttttaccgggtttaatgagtcagctgcagagtttatgatccggtactaggccttctgggaagcagctttcctgggcttacgtcaggctgttaaagaccctcctggccttcctgccgacatttgctcggctactttttcctcctaattaatgcctctatcttatcagagtggcccattctcaaatgcagtaaatgagtccttgatgttctatgttttattttggaaacttcccactctgctcatatctgaattggtatttgctcactgttgcgcagtggtttgcctaccaggtatcccttacatcaaatcctgtccgccgcttagaaaaaccacagctaaaagttgtttggcaactcttggtgttcacagggttttcccactgagggtcagggactgcacagcggttgagagcttggactccggggtcagctggaactgcttctaacacaaggaccgctcttaacaaagaactgaggcttcctaaacttcagtttctgggtctgtaaaataataggacccacttcctataaatgttgagaagattaatgggaatgatgcatgtaaaatgctcggtacatgataaaagcccagtgattactcattatcccactcaatgcttggggaaaggcaaagcagctaatattaccccagattatagataagaatactgggttcaaaagagatcacttggcttacccttgtctatactgcacctgcatgaatcatggacctgaacccaggtcacggccacctcccagacccttgctctctctgcttccccagcagcgcctctcagagtgaacacctatgtccatgacagtgattcccaaagtgttgtccccaaaccagcagcatcagcatcacctgggaacttgttagacatgttagggtctcaccccagacctaatgaatcagaaactctgagaatgagggcccacaatctgggttttagcaagatctccagaagattctgatgcacacccgtttgagaaccaaagctccatggaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaacttataacagaaaggcccaccccagaccagttcagatctaaagacagcctggactgacaaccacagaactacagagctgccacccagactccatggaactctgctaggctggtaatatttttaattcattaagggtttatgtgtttaacaacccaggtccagtaaattggctcctttcctccctatgaaccttggacactctggctggtcaagcctccacctcatgcccacttgtttgcacagctactaacgtttatgaagtatttgcttaatgtacctaagctccactgcccagagctatcccacttgatctgaaaacgtcatgatgaggtatggtaagcattaaacattagttcaccatagttctatttttttctaataacttaaacggcttcagggaacattttgtgtgtgtgtgtgtgtgtgtgtgtgtgtgtgtgtgtgtgtacgccttaagagactggatctcactctgttgcccaggctggagtgcagtggcatgatcgtagtttactctaacattgaactcctggcccaagtaatcctcctgcctcagcctcccaaagcactgggatcacaggcatgaaccaccatacccaccctaaggaatatagttttttgagcatgttggagtactcagaattctcagctcagctcttggcccacttgggtctcaaccatttagagtactgattaccaaaggaagagcacaaaggaagaaaatcagcttttctcctcttcctcagtgtgggagaggggatttggcttgggctcaaagccatagtgatgctttctgctccaccccctttcaattaaagatcaccagcttcccaaaaacaggccaccctcattttccaacctggctcaggcagggaagctgagaagcttggggctgcccattcacccagtcaccaggcagatagacaggtaagagaactgggaccttcaggcctgccctcgggaggactggccaccaggctttacagcccagagcagagaaacactgtggccgttgcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaattttttttttttttttttgagacaaggtctccctttatcacccaaactggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaagactgtaaatgagagatttgttcagagaagagggtgtttcctatgtacaaaaccaaagaccagcttttattttttattaggtattatagtcacaaaggtatgaaagggtatatagtaataagtctaagaaatttttatgaagtttttgaagtaaaaagcatttttataaaattttaaataaaaattttaataaaattactcaattgttaaatgtaacttaaaattactttttcataaaattactcattttataaaacacatttttcctactttgaaaagtagtacatgcttaatacagaattggaaaagacaaaaatacagaaagaattgcatttaactccttttttttttttttttggtagagacgaaatctcgctctgtcacccaggctggagttctgtggcgagatctcggctcaccgcaacctccgcctcccgggtgcacaccattctgctgcctcagcctccccagtagctgggactacaggtgccagccaccacacacagctaatttttatatttttagtagacatgggatttcactctattagcagccaggatggtcttgatctcctgacctcgtgatccgcccaagtcaaaacttcagattttgccaaacaccttgaaagtatgagtagatagaggaagactcgtccttttgtctgcctccttttcatcttcctaatacctaacacctctctaatctttctagaaatgggtaagaaaagcttccataaagaaaggtggagagaattgaagcatggtagtatttttgcaggagaaattataaggtttgaaatttatggaggcctcaggacatacccaatgacctaaggtctaggccagagatggtaagtaggattttttttttcttttctcttttttttttttttttttttgagatgcggtctcactctgtcacccaggctggaatacagtggtgtcatctcggttcactgcaacctctacctcccagattcaagcgattctcctacctcagcctcccgagtaactgggattacaggcactcgccaccatgcctagctaattttttttgtatttttagtagagatgggggggggggtggtctcaccatgttggccaagctggtctcgaactcttgacctcaaatgatccaccagccttggcctcccaaagtgctggggttacaggtgtgagccatcacacccagctgataagtagctttaaacacaagtgaggattctattccatcaggaatggctgctttatgcagaagaactctaagattacatcaggctaagggtgacagaatgctgtaatccattagccttatctgtcatggtcatggcagcagcaagaggcagtctgagtgccatacactgcagtaatctaggggtgagctgaatagtgaatggagatttgcctaaaagaaacttctggagtcagtgctccaaaactctgaatcaaccaaatgaatgaattgagccaaatagaaatgcatgactattcaatatttattatgtagagaggcttagaaagggcaggcacctggagttcctccaccctcctcacccaatcacaactgcccttactgccctaccagtccagccacgtgccctttcccacccctctcaatgacccttgggctccccagtgaagctccctgagggcaggggacatagctctttggggccataaaggcattagctcacccttctcagccccttacacatttactgggtacttagatcaggccaagtgtggtggctcatgcctgtaatcccagcactttgggaggccaaggtgggtggatcacctgaggtcaggagttcaagaccagcctgatcaacatcgtgaaaccccatctctacgaaaaatacaaaaaattagccaggcatggtggcacgtgcctgtaatcccagctactcgggaggctgaagcaggacaatcacttgaacctgggaggcagaggttgcaatgagcaaagattgcaccattgcactccaccctgggcaacagagtgacatttggtctcaaaaaaaaaaaaaaaaaaaaaagaaatcttagcaggattacatctgtaaccccggcactttgggaggccgagggaggtgaatcacatgaggccaggtgttcaagaccagcctgaccaacatggtgaaaccctgtctctaccaaaacatacaaaagttagccaagtgtggtagcatgcgcctgtaatcccaactactcaggaagctgaggcatgcgaatcacttgatcctgggagatggaggttgcagtgagccaagatcctgtcactgcactccagcctgggcaagagagtgagactcttgtctcaaaaaaaaaaaaaaaaaatcttgccccttccctcaaggggctcacagcctgtgggagagggaaaatagatataattatatttaaagaattataaaacaaattgtataaatttaaaattataattaaatcattgtaataatttagatcagaaaaaataaaggcaagtaagtgccaggcatggggctaagcattgtactcacccactgtattccatgttgtcttcacaacggccttatgaggtttgctagtattgcccccattttaccaagaaactgaggcttagagcattcaagctagccaagggctaagccatgactcaaacccaggtgtgtctgactacggctgttactaagaggggaagggaatcatctgaacttgggtttcactcagaaaggggcatggttttggtaactttgaaaacactaccaccctaccctctagcactggcagaggggagctggacgcctggacagctggggagggggaggacggcagccagaagcaacagcctctgcagtcccagcagctgggacctcatgcctcaaccaaggatcagcactgggtattggctcagagtagtgaaggctgctgggggcctgtgtttcctgcatttcctatgtttatgctgccagggtgggttttatgtgaccagagagaagcagggaaaattgctgagaagtcagagatctgccagggaatcagtgatgagccccaggaaatgctttttgtctaaaaatatgccatttccgaaaggaaaacagtcattagagggtgtgagaagccctcgtggtgaggaaagcaaaactgtaagactcaatgggaggccagtggaacaacagagaagcccattacccacccacttcctgtgcgattaacaagacgtttggaggatgaaaggcaagcagacaaaatgacaacccacagacacaactccaggggaaatgtctggggacagcataggaagacgcagcagggaggtaggaggagaaaaaactgctccagttaatatctttctggcatcggctggttcagctatagatttggctaaaattacctgtgtacttactagacgccaggcagttagggggctttgcttaaatcactctcctgcattcttcacacagcacttgatgaaggaggaaagtgagtcttggaggttaagtgacttgtccaaggttacacagctgggaagggagaaagacatggctccatcccaggttccctgatcccaaatctccccctcattgcaatgtaccaagctgcctccaataagatcaagagtcttgacgatccccaagctagtccactcagtccagttttcctgccagactatagctgttttgcattccttatcttgtgttgaagcaaaccgggtaaggaaactccccaccttttttattaatgactcattttcagccaaaacacattgcagccacatcaggtacatgtgcccactcagcaaagacgtactgtgagaaagtaacatctaagttacttggtccaaagcccttctacatcaatcatcaagcaaccaaccctcctttgctgaaatctccaggggactaggccctttggtgggggaagaggggacggtttcttcaggggcatctcacccctgggaagtgcatcctctctgctgggggcagtaaaaaggctttacatgggccactgtggctcatgcctgtaatcccaacactttgggggcccaagcagggtgattcacttgagcccagaagtttgagaccagccgggcaatataaagagaccccatctccacaaaaaaatacaaaatttagctgggcttgatggtcccacctgtggtcccacttacttacttgggaggctgaggcaagaggatcagaaggtcaaggctgcagtgagccatgattgcaccactgcactcaaacctaggcaacagagctagaccctgtctcaggaaaaaaaaaaaaaaaaaagaggcttttcacgaatttcacattccaccctccaccatctttgatgtaggtaatttatcagcattttgtagaggaggaaacaaggtctcccctacgttgagcccaaatcagtttgaccttggggaacacagtgagcatccctgcgtggaggtacgcaggatccctgagggtgacaaccttcgaggtcgttccctggcctctctgcccagggtgagcatcctcagagacctcagctctcctctcagcatgcaattctcctccactcatggccctcccagctgcccctggcttctcaaagctactcctgcatggaggcaagtacaactagccaatgagcctcctgacctgccccatcccagagagcaactgctgctaggtcctcgtggattctgggcctctgtccagtgaccaaaggagaggacacatctccagctaccatccctccacctattttctaaggaaaccaatgagttctcaaatgccacctgtggtggccccttctcagccctcaccctgagaggccttccccaagtcagaatttcccacaggggaagttactgtgggcttctctctccttcccccacctcatgtggtcaggaagtccagctggctttttctcctgtctgtctctcaaatgtgtcccctggctcccctccattgccactgccctcttcagtgtctggcctgtgctcccacaacaacaggcttgaagctggctgccctctcccctccatcttccacaccataatccaggtgatccttctaagaggcaaaggtaatcatgtttcttccctgctcaagatctgtcaaaagattctgtggcctccatagaaaaggcagacagcccggccacccaggcccttcaccatctgcctcttgaccatctccagtgtcctgcagtgtcctgaatataccttttccctgcctctgcccaacacactcccgttctttcaacacccaactcaactattaccttctctccatcagatcttccctgaaccaccccccagaaacaaaggtgactgtcccctctggttccccacagccaccccaccacttacccctgtgctcaggcactcctggagcactgcattgcaaccattggctcacacatctgtctctaccagcaaaccactaaaccgtgaataagtggcttcctgagccaggccttgtgcaatgaatggatttgcaacaaagggagccactgagagattacatgagccaagtcatggcaattagtccccatggaagcagcagctcagggcagggtccagacttgggcagacttaactatgcaggacattccattaacaataagcaccactctgagcatttcctatgtgccaggaactacgtgaagctctagattctgtcattagaaaggactgagttaattaatggaaagcaggtagcacagtgcctgacacagtataagcactgaacacacgttagcaagaaaagtgacagatcatttacgggatggttcttacaccaggcagcgtgccaagcacagtccatacattgtctcactcttcatgacaaccttaggaagagagcagtcctgtttgtccccattttacagaaaaagatactgagtcttggctaggctaagcgatctgctcaaagtcttcagctcggaagtagtggatttggtcttccatccccagtccatctgctctggcacccaggttctcagagtctctggtacagcagggtgccaaagtccagttgagaagaaagcaggccaggtttttcaggcacagcctgatgaaatatccaggggaaacacatgggactagcaggcttctttttctgtcccatttagtctaatatcacatttaacacaccatcctctaagggacagaagtcacaggaagccatgcagtctggttcctcctgatttctcctgtgtgccacatagttatgcttccttctgggaaggtgtgagttggagtcagtcccctcctgcatgcagctggggaaactgaagccaacaccattttagttactcacatggagctaagacaatcatacaaaactcaggcatggggtcagcccaccagcagtgtggacctcaccctgccggctgcgttccaaatgacagtggcatggtgccacagaaaaaacatgaggtgtgcagctggacccccagaagccctgactctgccaggtgctagctctgggacatcttgggcaagccatttggcccgagtctttttccccacctatgaaacaagccagagagctcattcctcacaaggctgtggtcagaatgtgcctctgtacttgagaagctgtaaaatgttcctcagttgctgcccttagtagggagctcagaggaaagctagttttgcctgtgcgtttctgtcggattgccctgtacccagggcacgtcctgctctctgacaacaatcagggtcattctaactcaaatcaaacaacctggtctcagaactggtcttgcaccaccatggtgttaagctgccttcccacttcatccatgtttgctaagccgggtgggatctttcccctacaaactcctataggcggccacatttttcttttaaagatattttcccttcgactatagtccacaggcatcagaggatgaagctagcaggttgtctgtatgtagactttcttccagggaggaaagcagctttgctatctcctacctttttaaacaaaatctgccttgattttgtctgccaagatatgtctttggatggggtaaagcacttctgagggaagctacgtgagccacgttgtagctggagagagaattgaaagaggaagccgagctgagaccaccacagttccggggctggagcccagctttgcagaatgcctgtatagcagtttgaccccaacagatgaggctgttagggacagaaatgaaaagcactgagagaggggaagtgtgggtggagcttatggacattctatgagccaaagcaattttgaagtctaatcatttggagggaaaatatttgtcatgtcattttaaagggtacaaaacaacacagaggaaaatgaaagggttagaaaataattggagcgcttctccctttacccttgtagaagacagctctccggttttcagctccactcattctgtcctccattggaagctcccccagtgtcttagagatggatgatgtaaaagttagaaaatgcctgtgtttcctgcttgccttaatttaagaaactgcttgactgaaaagtgactgaatttcatttataggataaaatacttgatctccagggaagccaggcctcaatagatggatttttaccatgtcacttccccctagacctgtgggaactgacctgagtcttggggaaaatttgagccacatggcagtccgcaggtgcccacaagtccctctatgatctgagtacctgtcttcccagtctcatctcacctccctcctctccagccagggggacgtgcaccctatacccaccccatgcacacctgtcccaggctctggctttcagctcctaccccagaaatgcccacctccccccatagctcagtgtacccaagcttggcccatcctaaagccatctctgataactccaccacaacctgtcttggtccaagctggaagtgatgagtgaactctcagaataaataatagtagctcacatttcttgagctaagagccagacacttcacaaactcactctcacatttctttttttgttagtttgtttgtttgggagacagtcacgctccatcacccaggctggaatgcagtggcataatctcggctcactgtaacctccacctcctgggttcaagctattctctggcctcagcctcccaagtacctgggactacaggcgcacaccaccatacctggataatttttgtatttttagtagagatagggtttcaacatgttggccaggctggtctcgagctcctgacctcaagtgatccaccgatcttggcctcccgaaagtgctaggattataagcatgagccactgcgcccagccagctcactctcaacttaatcctggaacaaccatataatataggtattactatgatttatccccatttcatagaggaggtaattaggacttagggaggttatgcaagttacccaaggtcatatagttgataagtatcagagccaagagttgaactcataccacctttcccaagagcaccttgagctactagaactactgcacgcttgttttgtaacatttacagaactatagttcagtgggcaaaggccatgcatgattcttcacacctcccacaatactgagccaccagcaatcaatgcatgaataaatgaatgaatgagaaaatacccacagactagagagttaaggcaacttttacaaacattaaaaggatgccatgtcaacaaaaacacattaagcaccaaccgtgtggtccacattctgacgggctctaggcctcggagttgaagccagggtccactggactttcagatgttcaatgaattcccactttccaacctagaagacagtcttctatcgaggactgcttttcagtctcctagctgctgctttgttcattattgctcagcaaacagtgtgatttatgcatgagacacacaccttaagatgcaatgtagttcttccaactgtcataactactaaattgaattgaatggcaatctactggtagctcaacctctgcaggaaaaaataatcagcctgaaaataatcaatgcaatagcactgtagtgacactgtcgaaaactgtacaaacagtaggaaaggtaatgttgtgactgtcatttattaatgcagagttctagtgttcctaagataaagatcattgaaatgtgaagcgcatttgtccaaacagaatttctaataaatacctttgattgttcctttgtctctatcctttactaaagtcaggcaattagcagtgtttgcaatattacaggcaaatgaaattgggtctctgcctggtccgcctacagaggacttctatagcaataaaaataatcaactggattcttcgttttctgctgggtccatgtgatttccttaataatgtcaatgcagattgtaatttgtaggaaaaaaatactgcttgcatcaggcatgaaatttaagaccacagaaatgccatcttttcttacagaattgttttgttacaagggtatgtggcttggacgattagaagagacctcaggtgtggtgcccaattcatctttcatagaccaatattttgtttcccaaatgtgccttgtacatttctccaataccttcactctctagctgttggtgagggaaaggacaaaaattagagtcataaaatcaccattaaccccccagcttgaccactcactagctagtcatttaggctccgtgggcctcagtttgcttctctgtaaaatgaggcagaaaactatgaaagtgcctccaatctaagttccccaggctcctaagacaaggcctggcccatagaaggcacacagtacatgttgcttgagcaaataagtcagtttcttgtatggtatctggcatgtgatcagcataattaatggttgcttaaaaattaacagtctgttccccaccagtaacattcatcttcttcctcttggcctggtgaaatcttacgcattcttcaaagctaacatcacattctgctttgtctgagaaaccttcccaagaccacaccaactagaagtgatctatctccctaaactcctaagacatgtgttgtccataagcttcattcattcattcattcattttatgtatttatttattttcgaaatggagtctcgctttgtcacccaagctggagagcagcggcgcaatctcggctcactgcaacctctgtttcctgggttcaagcgattctcctgccttggcgtctcaagtagatgggattacaggtgcctgccaccacacctgactaatttttgtatttttagtagagatgaggtttcactatgttggccaggttgatcccaaacccctgacctcaagtgatccgcccccaccttggcctcccaaagtgctgggattacaggtgtgagccactgtgcccggcctataagtttcatttaaaacaagcttgtccaaccttcagcccaggactgccttggtccagaagctttgaatgcagcccaacacaaattcataaactttcttgaaacgttatgagattttttcatgattttctttttgtagcttatcagctaccgttagttttagtgtattttatgtgtggcccaagacaattcttcttccaatgtggcccagggaagccaaaagattggactgtcctgatttagaacttgggactcatggccttgtactgtaggttcccctctcaaaggatttcttagctgttcagttatgtcacaagcttctcggaggcaggtccagagacttcggttcctggtgatttaaacagcccctagtcaagagcatggcacacaacagatgttccataagcatccacagattgactgggggaaatgtccaattcccatggagatggtcagatgccctggagaggccacagtgattacaagccctacagccctccatgggatacactgggccaaagacactggtacagaagacttgtcttctgtagaaagtttgctccatttcgctaaatatcttcccatttgtaaggaaactgatatcctcatgacttgtggtgggagggaaattgtacaacctcttcaggggacagagtgacaatgactctcaaagtttaaatgcacatacaattttaaaagattaaaaaaaccataaatgtcctttgacacagtaattgcacttataaatgtttatctcacagactgacctacacatgtatgagaaaagtcattgagaagattcacttttgggttatctgtagtagcaaaagactggaaacaaatgtctatcaacaggtaactggataaataaatcaggatatatccatgtacaagaacactatgcagccttttaaaagactgaagttggccaggcacgacagctcacacctgtactcccagcactttgagactgaggcaggcagatcacctgaggtcaggagttcaagaccagcttggccaacatggcgaaaccccatctcttctaaaaaaatataaaaattagccaggcctggcacctgtaaccccagctactcgagaggctgaggcagggagaattgcttgaacctgggaggcagaggttacggtgagccgagatcgggccactgcactccagcctggccagcagagcgagactccatctctaaataaatagatagaataaagtagaaatgtatgtacttgtgtagaatattctccaagatataagtgaaaagacaaggtgccaaccagtatgcatggcttcatccagcttatgtaaaaagggagatgtacacatgtgcacttgtatgtgcctatcctgtctccagaacaatagcaacggctgacttggggcagcagggaaagagcctggggtcagaagcaggaggagacttgtcactatattcggtattctcattcatatggactaaattttttagcaagtgcatgcattatctttcttttaaattttaactttatttttaatcagatgatgaagtcacatgcacaaaatcatgaaaggtacaaaatggtacatggtaaaacgtcttcctcccagccctgtccccagccacccagtttccagcctagagacacctaataggaaccctttcctctgccctttttagagacagtccatgcattgcagagattttcttttaaaataatcacaatgaagtgaactgggagaaagcttccattgacctcaccaccctctccagctcatgctctgttctccagagccaagctttcacacagggttgtctacgtgtatggagtggtgaaaaagagttccttgggctttggagtcagacaaacctgagtcttcaatagttgacctaacctctctaggtcttatggcttcatccataaaatggacaattcatacctggctcttaggttgttataagggtaagaaacagtccatgaaaagcatatgggtcacttagccacagccactctaaatttctgggcaccagcaccctccatggctgggaccaatcctcactgagcagtgttcctggacacagccagagaccccaagacccctggatgtccccctaatcccctgagaagtacatcctgtatttctgaggtaacattttacggtaaacttctacagcaagcaaaaaaccttaaggagctcatgatcaagaccagtcctccctgggtttgggggcttttgaaagggcccaggtttagacatcaggaaacctgtatttgaggcctgactctgccattaactgagcctcctggagtgattcgcttctcatcccaagccttgcacagactgggtggtgattcctgaggcccagaacctggccagccttatagcgtcagtcagggatgtgttagtggagcccttcactcagcgaaagcatagctggctgagtctctagacagagagtgtgttgttcaggctaaactatctccctaccatggacataaaatgacatgggtatagaacacactaaattcttcaaggtaacaaatttaaattcttcaaaaagggagtggctatttaaaatatctctagttcatttttagcattactgaaattcaatgtaaatcacagtggccatatagagttgacatataaccctccctctgtcaaacaccaggttactaaagtcacagggattaagaaatgacccttggtaacaaaagttaccaatgtagaccagttatgtggcaggtggggagagctattctaaggttccttctaactccaaggggctcagatcggatatttggcaagtaagcaattggcacactgaccctgcagtttacaaagtgattcctacgatcctgagggtagaagaagattttgctcctggcagaggttttgcaggatgtgggtggggttggagaggaggctgctgtgagggtagaagggggtaacctctgtcccttcaccatgtttatcttgccatatcaccatccagcattcacagtccattgcccaaaataaaccacagatacaaagtagaaagatacttcatctattttctaagtaaatctaggaagttaaagatcacagctgtctccaagaccatgcccgttgagtaaaaatatctcttggcaagttgtcctacatcaattttttttaatgagacctcttttttcctacctagtattgataatttaatagctctgcaaaaagtgcttctgaagcaagaaaacttagtattttctaatttattctctgggagatttgactgctaatcaaatatcttaattccctccatacttaaagggggcattttaaagtgactttcccagccgttccaaattacttcttgaggtttattgtttgcttttaaatttatgtccaacatgggctctcttcttggggactgagctgtttcagaaaatgatggaaatttggggtgaatctaccaacagtgttcagtctttccaaaaagacagttcattaaaagctgaaaggtttgaccctctggctctatctttttggcctaacatcctaacacaggtgtggacagggtcaagcatgcaggcctgtctctgatacctggttatagcaaggctgtccttggcatttcacctccacctcttctgcatcatacattgtttattttcacctcattattccattcctactccatttggtgataatccactgtgtgctaggcacccttctgggcaccagcatatagaaaaatgccttagcattcgtccctgccctcaaaagggccttgggatcaagaagaagtggacacgagcacatctgactaaacacaacatcatggagggtgtatccaggatatgagcaaaatgctcagagacaactctttttatttacgtcacaaatgcttctacagcacctactatgggccaggcatcatgctaataagggctttaccaatattaattcatttaatcctcacagcaacccactgagatgaatactattcttatcctttggtactgtggggaaactgaggcacagagcagggaaataacttgcccaaggttacacagccagtcagctccaggtggggctcatggggcatgggccctggagcccacacactctgactccagggcccacactcctaccgtcgggccacactgcctcacaacacactttctcgccaaattcagagacacataactaaaaccacttacaaatggagtatgccaactgagaatgctacagaacacattgaggaagtgacatttacactaaaatctgaatgatgaacaggagttaactagactaacaggggaggaagtgggttgcaagccgtggttctgggtggggaaggagtgcaatgtgttccaggaactcaccaaggccaccagaaaaggagggtggaaaagaaggaagaaaacagctcaagaagaggctaaaacatgagcagcaaccatagcattcagcaccctcactacaggccaagggtcattccgtagttgggttccgcaagaatgataggaacctaacagctttggcaggggtaatagcatcagttatgcatcatccactgatcacttgggctgacatgtagaatgcattggaagaggacggcggggttaagcagggagaccccgggggaggcagcagcaaggagagagttgatactcccttggatgggctggaggtggataaaaatggattcaagcgagttttaggagacagtatcaacatgttatgctgcatgtttgcttatgatgggtgaggagagggaggagtcaatggtggctctgaagattctaggtattcacagggtcgggaagcacttgtttgtcacaggtttgttgggtgccggaggggaagaaagtcccgtgcaacagccacatgcaatgttcatcactcccctggctctcaggctgcttcagggctccagaccctcgcacgtgctgatctcgggctaagggctgtttccttccttcgactgaagacctttcatactgtaagattcagcttgaaagtctctccctccatacacatcacacgctgacactggaccaggcacttatttggatctcacaacatctctgcaaagaagatattgctatgcctgttttacagactactgagaatcagagaagttccaaagctgccctgtcatttgtggcataagcgagagagcccactgacatcccagcgctgccttcccagccacactgagggagaggtgggcttggcccttgaggccccttcttctcaaaggcattgaggttactttccatgtagattacggttgagaacaatgagaacttctggagcacattctgtgggctgtgtgaggacgtcggcaagggaacagactaagatggctagaaaatgcccctctttcatctctagaattcatctagtgaagcacttcccaagcctcaggtatccagggtctccctgttcttcctagaagtaggttccagtgaacagaaagcccacagcataactaagaaaaagctgtgtgtctctaccatgctggtgaatccatgctgctccttgacctgccactccttgacatggacggctctattctaacagtgccactctctcatgtcactgtccctctgcctggttcctcctcctctcttatctgcctggagagtcccactccttggatgagtctcacccagagcatccctcccccatctcctcaggctgggtgtagggtgaccagctgtcctagtatgactgggcctaacggatgttctggtttgtgggactttgggtggtatatcagctcaatcccatgcaaaccaggatggttggtcaccctagttaggcatgtggattgcccctgcttatggcaagcccagcaagtatccaagctgtcttgcactcattggttctctcctctgctctttccccaaaagtagttatgaccctctgagatgaagccctgtgccttgttcatcactgtattctcaacatctaggcctggtacagaccaggttgtgtggtcaatgtttgtgcaatgaacgtacgagcccagactcagcatatttaggagatggctcctaccacccagcaattagagaggggaggcaacgcaggcggaggacatctaccaatgcagcacatgagcaagacacagggcctgagaataactgaaccctggcccacagatgccaaagaactggttttgcttgtttgtttcatttgccagtcagaagcgtgggggataatttagtggaatcccttcacagataggttttaacttgaaataattcaactataggtgcttggcaaacaatcaaatagtgaacaggcccaagagagaaggaaataatttagatggcagatggcagttggctccactagaagtgccacctggtgagcacgggcccacagtgggtgtgaggcgggacaacgggggcacacttccctcctgcgtgtgtacctcacactgtgctaggatgattatggttctggcatacaaagtcacttatttttcatgcaacctggtccctaaacttaagaaaatgcctttatctggtaatcaactgggaaaaacattggctgaaccccatactttcaagtacttatgagattttcaaaggtggttcttacacactaacttaagagtccccagatggtgagtcccagctgcgccacttcataactaaatgatcttaagtagctaatgacttaaccttgtagagcttccattctcatgggcaaatgaaggataacatctctccctcatgggctcacagtgaggattaaacgaagggaaggtatgcacaacagttagcagactgcttggtacaaagtaagcgctcaataaaccaaagctattatttttagtggtggtaatagcactgcttttctttggcatttaaagctgtgtagctaatctgggcattccaccaggttgctgaagcaatagacggccccttaataaatagcttccagacagcatgtcatttaaaactgaatgcatttttgcttctcagttgttggacatattatttactacctgatggtcttgctctggcccaaacaagctaattattgcaattccagagtacatgccatcatccagaaatagctttctgtagagtggggactgaaattaacaggcaattagcaagtttaaaaggatttcctttccccatccccacccctggcacctctaacacattaaagctcatcacagcagttattttaaggaaattcagcagaggtacttgcagggcccgaggtcatcttgtgttggccctggatagatcatgaaatcctgttgccaaggagcatggtgggaatgtggcaggaaggctaaagtcaggaaagccacctcagccactaagtagccatatggcctggggcaagccactactcaactctgagcttcagtttcttcatcagtaaggaagtggccaggcacggtagctcacacctgtaatccagaacttggggaggccaaggccagtggatccctcgaggtcaggaggtcaaggccagtctggccaacatggaaaacccccatttctactaaaactacaaaaattagccgggcatggtagcaaacacctgtaatcccagctactcaggaggctgaggcaggaggatggcttgaatccaagaggcggaggtggcatgagccaagatcatgccactactcccaagcctgggcaatggagactccatctcaataaataaagttaagaagttagactgctcaattcctgagactccttccaacccagcaatctgacgtccacactggggctgaccactgaactacatggaggcacatgcctcagtttccttatctacgccattcatctaacagctatgtatcaatccctgttaggcactaggcactgtgctaggtgtttggaagagtcattctcaggcctatcctatctcagcaacctgtaggaatgtcctcacctccagagttagcccccttggaaggaaaatatttagtcccacattcatttctttcctatatgaacctggaatcactgggggcagcctctctgaactgccccattttctgaaaagtgtccgaagtacagcccaggcatggggcattcagcacaaagggcccaagtcttgagagggagtagtttaggagtgaagaaatcccagcctcccactatccagtcttaaggtaaaaagaattgtacagatgagcacctttcttccccttggtatttccctttggcatgacccaaagaccactcccataaagggccataccctagtgttttctgacaatctagggatgaattccctattacatctcaggatgggagaaaaacaggatttgggagttctggtttaatcactaaatgaacttaatcttgacttctggttttgtcatctgcaaaaggcaagtggtcctgatggctacttaataaagctgtctgtgagccaaatgagagtgtgcatctgcaagtgcattgtaaactgcaaaaataattgtggttctctctgggccgccttctacttcacaacaatactgagctgaccttacagataagctgaacagatggttgcctccatggtagtatttgaatagcaccagaaagtttcacctctccaaagcatctttctgctggcctgaaattcaaccattagggattcattttgttgcggtgggggggggggcggcttacaagcttcccagggttcaggagcactctattaaatagctgttgtaatcacccagcaggttcttcctattcgctgcatagacaaaaccagttcaccaagaccacgctattgtagtagagtttaacacaaagccagctacgcagaagacagttattactccaatcagtctccctgaatgctcagcggttagggtttttcaaggatagtttgatgtacaggggattagggaatgggtgctgcagattggttggggatgaaatcatagggttatggaaaacggtccttgtgcactcagttggcctctgggtgggggccccaagactggctgagtcatgagcctcaagtccggatgtagtcagtctaaaaaacaactcaaaagatccatcttaggctctacaatagtgatgttatctacagaagcaattaggcaagtcacaaatcttgtgacctctggccacatgacccctgagcagtaagggatgatagaaaatttgcctatatcttagcagaattcaggcccctttcataatcctgaccttctggcctttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtggggaaaagaaaaaaacagtactcattgggccttaggcatattctaggttctttgcaatacttaattttgtttttaatctcaaaccagtctgagacaggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacctccataaggacagccagagcttctgccaggaaagaaagaacgttgatgctattcgttttccaaaagagcgtatctcctccggctaatctgaacatatttcttacagggctcttgaatgcccctttgtagctgagtgggtgaaacggcatcaccaacatttggccctgctgctccactgagagccggcgccgttcgcgggataattatcctgtagtcttctcacctccggagagaatgcaaggcgccctccttccaaatctggcccgtcacgccagcaccacttatttttagaagctgttttcccctcatagtttcacaacctctaatctgccactctccagtgaatataaattaaaacacaacaatgaaatatggagaaatgttttctcccgtcatctccagctctctgaacccggggctgggagtgggtggagcgcctgatttgtctcccaggcgacacggaaagggaggcagtgagacgtgctacctggtcgcttccggctctgatgaaccactgccaaccagttattagggaggagggcagcacttgcaaaaatttcaggtctctgagagcccagagcctgagaagtgtggaggatactaattacacccaggtggaagcctggccacagctcacctcctaaggaaagagcgagcccattaaatagccaggaaggaatggagttcacaggggattagatttctagattatagcctcagagtcattctcaaatttatctcctaaaatctggaggtcaaggaacaaaagcacccttgaagaacaggtaaagggagcctggtctgaattcttagctcctgacagccaggccgcaagaggacagacatcccgtgcacacacgcccgccccatcgccaaagaaagctctagagctagacacttagactggcctttcatgaaatgacagcacctgccaaacacaatagggaaatagttagtccagccaggcagtgccatagagtggtcagagcatgggaatttcaagcagacagcagcaggctttaatcctcactctactctccccagatgtgtcaccaaggcaagtcactcagcttctctgaggctcagtttcctggcctgtagagtgggaataattataatactatcttggttgtcaggtttaaaagaccaaatgaatgtcactgcctggcagactacttaaaacaataagaggtgctaaagttactttaaaccaaccttctccaccctctccttccccacctcagtttcataccccagagaccaaattcctgatggattcctaaatgatatctctgccaaatactggtgccaggtgctgggcaaggcacagttttgcaaccagctgtcaggcagcaacaacttcacagtcgtacttttattcagtgtgtggtaaaacttctgggacaagagtcaaagtcgtagggctttagtgggaaactgccattgcctgaccagaggtacaaagcactggcccttccctcatccctggcctgacctaagagggctggggtaccacaggactgttgaccccactgagagctcagggtgccagaaacactgcctgccacgtgattcctattggtccttccagagatgctaacaggcctggaggctggaggtctctctgcccacactttcacacatgacctggagcagggggtcccagctctgtagctgcatttctgacccagttggataccttgacatggtcccagcaagcaacagagcacccattgtacagccttccccagccccagagagggactgtccctgccaagaacagaggtgccacccagaatctgacagcaggggaggctccccaagcattctacccagaagaacaagcaccctccccagatggcctgtggcccaccctgccctcagttcctagcagatcctcaacttggcctgctttgatgtttgtgaatggcaggtaggaaaggtcaggcaagtggaagaaacctaaaaccatgctctctatggccatggaagcttcctaggtattattacatagctgtagtatattaatattactgtcattaattgatattattgtaatgttactataatatacatagccataatataaacacattataaagctgtaatagcttatctttattctactatgtggcaagtctgtactaagcattctcctactctaaacccccacaaaagtattagctatgaactatcattgaatttcgttttacaaacaaggacaatccaaagaggccaagttacctgcccaaggccacacagtccacaagagcccaagttcccactcaggcccattctcttagctctgtgccacccagctctgcaaatgtagccacccaaagccaatcaagccagtggtagagttctaaaaccaaatctagggctctgtcccaccaatctccacctggtgcctggaattcctctatttttgttttttgttctgttttgttttaaagtttcactcacccccctccttaaacccaaatatccctgggacaggatggaaatccataaacaggtgcctgagtaagacatcattcacagagccttttcctcctgacagctggccaagaacaggagagggggccctgggcaaatctgcaggattacatcagagcttattttcccccgtatgcccctaattttctacatgctcttccattcctgatggattcctaaatgatatctctgctaaatcctggcgccaggtgctcttccattctcccagtgatccagaactttcttgctgtcatgaagaaaactgatttaataagtaaactcatacttaggaagcttcccatccaccctggccccccatggtatctcacatcatcatcagaccaaaagaacccataccctcatcagtgatgactcagcaaaatcaacttcacatgattaggaagctcacataactagcaaggcgaggaggttctctctgccggccacctcctcccgccagcactccaccacagcctgcctactgtctgcccgtttggactagcagctggtgctgtgggatctttaactccactgaaattatgtcacaaaattggggcatcgtagggaacctaggaaaacagacaagaaataaagactccatatgtgcctggcccacacccgagtttggctcactatgcacacattagatcctgccattcacaatttaaaatatatatatatttttttgtgtatatatacatatatacacacctagaaaaaaagtatgtattttgtatatatacaaaatttattacgtataaataaaatttatacaaaatttattacgtataaataaaatttatacaaaatttattacgtataaataaaatttatacaaaatttattacgtataaataaaatttatacaaaattttgtatatatttgtatatgtgaaatattttttaaatgttaatatatctataatatttatatatttgaatatataagtttatatatatttatatggctcactataaaagaaattgaaacctccttaagcatgaacaactcccacgggtgttttcttcatgagacgcacaggaagatggcaatgggtactgaaaggaatgaattgcttgtgggggaactttatttactagaacaaccccaggtaggaggagaggttttaagaaatgagagtaggggttctggaggaggtcaccttgcctcctagtacagaggtaagactccactgaggctggagaataatgctcatgaggagattggcaggccccagatccctgcagctactgggacagaggcttcagttccttgccatgggggcctctccctaaagctgctcacaacatggcagttggcttctcccacagcaagagagagaatccccagagagagcaagaggctccacaatggaaggcctagtctttcacaatctaatcccagcagtgacatacccatcacttctgctctgttattggtcagaccaaccctggtgcaatgtgggagaggaccacacagggtacaaatcctgggaggcaggggcccttgggccatttgaagggtggttactccagcaggtacagagtatggtgagcccacatgaggaggtgcccagattgcagccatagatccttgggcaggtcatccaacctcatttacgctgtttgcacttacagaaaatgagaataatagactcgtcagggcttggcaatgcctatgaaagtgcattgaacaaagggaagtatgctgcagatataagacaacatggttttgattgtaattactagtaccagtagcacatagttgtgaggactcctattctgttgagctaacagccctgacccacctgtatcaatcagtgccaatgtatatttcacattgccaatacccagcgtcagataatgaagttttgcaaaatacagcttgggtgggatctctttaatgacctgttaaaactgatttatagttagctttttacctgaatgcacataaggaatctggagttcttgctagttcttgcttggaaatgatctgtttcttcatctgaatgtcctcccttcatctgatttccttagcaaccctggtttttctgttttgattgacaatacaaaattaaatattagtccagtccctcactgggctatcacaggttccaaaacacccagccctcatgtcattgatccaacatcaaccgttccaccggtccttccctcccctgcccccttaccctgccctaagggctctcaagacagacctgtttaactctgggcatttagaacacagaagactttctcaccagggaatctctctttctaaaatccccacagagctggtcaagcaagaagagcactggactacgcatcaagacctggggtgctgatcccgactctcatccttgactgcagtgtgggctgggcaggtcacttcactgctctgagcgatttagttctggttttgaaagactgggtgattctacccattattcactgagcacctctgggccttctattatggcctcctccctttcctgccctgcagctccctgccaaaaacaaagcctatgcaaccttcgtagatactcttcatagaatctgtttctctccctgtgggctctttccttctgagcactggcaggacttaaccatatgttctaggcattgggtgtgaaaccagcaaggcttggtgctggaaatttagcctcatcttcccaaccaccatagctaactcttgtcaagtacttgctctgtgtgccaggcactgttctacctcattaaaacttcacagcaacgctgaagtggctattatcatcttcattttatagatgaggaaattgaggctcagagagagtaagtaacttattcaaagtcacccagcccacatgaggcagagccaggattcatgcccaagcagtccagaacccaagcacgctgtcttgggactggattttctttccccatgaagaatgtaaatttcttaatcacaggccctgtttattttacacacagtcagcatctacaagtctttgttaactgattacaggtttctgtaattctaggcatgttaagcgtagggtcaagcataaactctgtccctacctttccagaacatatgctctgatatattatagcagacaaatgcaaaatttccaagactcgtgggatttagaagggatttttctcaactcttcttttccagataagaaaagggaagcttgaggagattaagttacttctgaccacatagctccctgctgcagaaccaggacagaaacccaagccttctcatccctatcacgagttggatctagggcagtggttctcagtggttctcaactgggatggtttcgctccctcaccccatgggacatttggcaatatctgggggcatctttgcttggcacagctggagaagaggatgttactggtatctagtgagaagccaggggtgctgttaaacatcctacaatgcaccagacagccttcacagtagaatcatgtggcccaaaatgtcaatagttctgaagttgagagatccattctgtgggatttaccacttcctctaaggctctttgtttctgtatctttacaagcagtcatctacagttggacaccttgtcttattcatccttggctccagtgctcagagaagtgcctggcacgtaataaaagctcattgaacaagggagggaaggagagagggagaaaaggaagggaaagaatgacagaaaaagatatcaggctttcctggcaggcaaagaaagtccaacactataaatcaagacctctgttcataaaacagaagatgtctgactgtttgaaatcaattcttgtatatcattccagagagaagactaactccgaataccttaattatgcgttagcacaatttagacgaatactcacaaaattaagcagagaacccaagccctgctacagaagtcttccccctcaaaaaaaaaaaaaaaattaagatggagtctccctctgtcacccaggctggagtgcagtggttcaatctctccagggattacaggtctgcgccactgcacccggctcatttttgtatttttagtagagatagggtttcactatgttggccaggctggtctccaacccctgacctcaggttatccacccgcctcagcctcccaaagtgctgggattacaggcataagccaccgcgcccggcccttttaaagtaaatcttgattgatggacatgatgaagtccgtgaggtacaaatgcactgccttttacaaaagtaactggttccttggaggtgtccattgggaagatggcagtagttagagctgccactgaggaagacataataggcagctctcattccaaggcagctgagccacgaagaaggctggcctgagtggtcagtgtgcagtaaatccaaatctttaaatgcagttcatgcttcacccccgaccgaatgacaaatggctcccccgtcagagcaagctggcaggtgatgcaccactcctcccctcccctgccacccgtggtgggacaatctgtcagcagccactaattctcaggaatggatggggaagtgggggaagtcaggctgtgtttattgggcaaggagaaggggtctctgagcccaaagaccttcttgggaaatgcagctcctgccctccacagcaaataatgctcaatgaccagtcagggagagcttgtctgggctctcttcaagctatggggagcatctagaaaatgccttgaaaccgtcagatggaaacatcctctcatcttcctccctcctggaagcaatgtgctccgccgctcttccaaacccttcctgtctctactggtacacctctccaaagccctctggatacctcccatgatatgcctttcccaggctccaggtcagcacaatgctctccccactctattccccaaatgcatacctgtctccatcgcagacaccttcacatgcctggctggcaggagctcagccctgcccatctgcctgtctttgttgtgcgaccaccttcagggtcctcccttgggctcagcagtgagctgacttgccatggagccaatggagcttaggtgtcaagatccttcacttgcacaagcccctttcaacctcctctcccccaacacacaattatgtattcatgatgtattttttttcttaaagaggacctccaaattatatctaagattcaggctctgtagaacctggctctttccggccaaaatatgatctttacagagctcaacatgccttgcacacactaggtgtttaataagagctgaaggatcaaagagaatggatcctgaccatgattacaattaattaagaaagtgattaacaggaaagggaagattggtgtttctctcaggcgagctttcctaattcttcctctaccatcaaactgaaaaaagccaatagtctcccctatctcaaatccaggatcctcggaagggtttgttaagtcacagccagctggaccccacctcgcaaggatgtggttcaataggtctagagcgggacttacaatctgcatttctaacaaattcctggtgatgttgccgctgctggtccgaggccctcactctgagaatcactttgagcccctgcgttatcaataggggccatattgcccccaagagggtgaaattgtatcttgaggtgggtgatgaaaaaagtttttattataaagcagatatatatatatacacacacacatatatatacagtacacaaacagggtgcagtatatccctggtgctaaaacttcacgggtagacaattagggggtaaaaatgtctagaaagactctttaggggggcaatcatgataaaacattgagaaacactgacctggcccaagtgcctacttggtgcttactccccagcagctgagccagaagccctcacctgcagagacctgcagcccacaccatctgatactgtggaagaagcattagactgggagtcacaaaacccaggttcaaatcctagctctgcagtaacttcaggccttcccagccacacccacttcagcttctgtactgaaagagacaaagttacaaccaaaactgccagggaaagaatgctgtgcgtgcttggaagagatacatgagggggttgtttatacaaataggagtgagcaatactccacagggcattgttgagtagcaaaagcaacacattaaaccatctcccaaggaggctgggcctgtcaacggccttgcttcgctgagcatggaaaagcacgtgtcaggcagagcaggattactcggcacaagagaggccaggctggggtgggaagaatggagagacagtgcctgccagtgacaggctggggcagggcgagaacaccagggaacatgcacatcgatcctgatttgagcaagtgttctcagaggcagctctataaattccttcaccacccctaagaattttgtactttgtcgcctgcctctaaacaatgcctttggggacagcagattctttgggggtagagccaaaagaggctgagtctactttaatgttatgctggctcaaaaacagactcacacatagtgggaaccaccagactcctgggttacaagtcttgtgtctctgttaactatgtgtccaatctcccaggccctaaactaggattctttaggaatgagtatgtaacaggaaagggaagatctgtgtttccctgaagcagctttcataattcttctaccatcaacctgaaaagaaccaatagtctcctctatctctaaaccagattcccatttcttccttagaaactatgtccagtcagccaccgaaccctataagttgatcccagtggatcaactcttccgctccggtttctctgagcacctaggaactggtccctgtgtctctcctggggggatccatttcttatccaggccccagctctgcctgtccagcccaggagccacccgaaatgctaaatctgtcttcttgctaaacaagttggattgtcataactgtatagccctggtctaagtgaggttggataacagaagtggtctaggaaaactgtgtcctggggaggaggtaaagtgataaataggatgtggtcacggtgtcctaggcagtagcccctcacaatgccagtggatgtcaggatcacgaatcagggaggtctgattcggtagaagacatgagttggggaggtctgatttggtacaagagatccagaacttgtgtccagctggagtaaggagagtaaggtatagcagagacaggacaaagtaaattggacctcagagacagggcacggggcagagtctgattccaactgaaacgtaaggatccccacatccctcaacagtccctcagatggtgaggtttaggacacagtaaggaggggtggaaagagcatgggtttgggtatgtcttccctcatgaaaaccgtggagccagaagcagtagtgttacagtgatgtcatcccctgaggctcagtttcctcgtaggtaaggtgggaatggaaatgactgctgcataggctgtgagatgattttgtgagatgtaagcgcccaacagatggtggtgatgacgatgttggaatcaggtgactctagcctcttcactgtcacgcttgctctcgtctgaacgtgcttccatgtctccatattgctcttgtgtccacaagcaaaagcaataatccattgccatttaaccagcacaaaactgaatgaggctgtcaccttccttttctgaaacacatgcttcagacagcgcagtctacagtcacttgagggctgggagaagatgctgtacaatatttactcctgttgaaaattataatcaataagtccctgactgttttcatatgtgctgctactaagctaccactccctgaccttgagcagatagatttgggatccacgtgtagccctgttaaattttgtcttttcagatttagtctctccctctctctttctccccccaccacccccctctccctccaccacccacattctcatcctttatgacactatgagatacgatatctcttctagctactcgacatctgaaatgaggagaactcattcgtcatattatccaaatcagtgacaaaactcttgactaagacaaagccacgtcaaaacacaggaacccctacccccttggaagacacaccaggccattcattgatacttttggggtgcattgctcccattagtgacacaaccttaccattctcgcagccaatccatatttctcccatctttcctcatgggcatcactgagaaaccttagcaaatctgcttcccagacccttctgttctcctttcactccctcatttgatcagcctctgggtcctgctgactccaccttaaaatgcctcctgtgcaccctttcctctgcgtctctacaaccgcacgcctcacagggatttgtcatctcctcccagaacattgcagtgatttcctaacaggccccctcgcctatatacctagactctttctgggagggatttaaggtggctcagcctatgtatattcacatgtctccacctactcccaatgtgatcattacctagaggcctctcatacttttttttttttttttttaatgcctgaagtttttttgtttattcctttttgttttccagctctacccaccagtatttttttgttgatgacagatcttctcctaaaatgacaaagaatttagaaacattttccatgtatttttaacatctgcgtcagtgaacaaagaaatcatagttgatgatggggtggggagggagaaaagggaaacttaattagctttagtttttataagaacttccatcagcgctgaatgaactggaatatgacatctgattgggcctaatcacaaggaagagtacattaacttgccgtgaatatatttaccagtttttacaataccatttttaaatctctacagaagccaattttcttacaagaaaattaccctaccaagattttttttagaacaagcaaacccaaatttctttcttaccctaacccagttcatccagctctgacactgtggcctgaggacagacactgatgctatcttggagcctctgcctctccacccttcaggaatgttctgcaccctgaaggaggtaggaaaacttgaggatgcaaagaaaaaccagacatctgttatgtctcttgatgttagggagtgggagtgaaattccagctcacccactctcctggggaggctagaatttaatgggatgcttgagatgcgtgggccgagggtgaggctgcagccaaagatgcttgaggctggacctgaaggtgatttagtgaccagagggcaatgccagggagagagagccttgcacggagttagtgacactacagttcccagagtggggcaggaagaagcaggcacaccatgacatcttctcattttctttccttctctgccgttccccagatgccccctcaccaattcatcagccctttctttccttccacacaagctgctcagcactttggctctgctctggaaacatttccattcctgtgctgctacagaacccaccctccccaccagattggatgcacctggacagcaggattgtgacttagctgccatcccgagttttacctggcacacgcaggtgctaggtagtattccttcaaaacaaggaaaaggtggtgtcgcatccctacttagctcctaccgttgggttggtttgcaaattttgcattgaattccatgtaattttctcttttttttttttttgtttgtttttatgaaaacgtatcatttagcctgccttaactcttgctttgaggtcacaaatgtcaaagtggttaactccaagtcacctccaagaacattattcctattgggttaaggctccacccttttgagctctaattatctccttaatgtgtgagaactgggggaatatgttcccaaattagaaataagttctctaaaactaaggcttccaatgctgaagagaatgtacaaaatgagaaaggcatactcagtccttcacttacacagtcaaagagcaatttttagggcactcccatgtgccagacagcccaacaggctttagggaggcacaaggatgaagaggacatggttatcagcacccccaagcaactctcagcctgtagagctttcctaatcattcaacaggtatttgaggtgctgaaacattgtttaaaaaaaaaaaaaaaaagcccaggtgcaaacacttctatcagatgtgccatgcatcattgacaatagtatacacatattatttataatatgtataggtgctttataaatattaactcattttatctccataataactgagctatggacaataaatgattattatggacaatctcttaaccctcacaattcagacagtgttgctaatcccatgtcaaaaagggggaaactgaggtgcagaaaagttaactttcccagagtcacacagcctcttaagtggtagaaccaagattttatttgtcttcctggtgtaagagaacttggtgggttccttaaaccctgttcaggatctgtcactggatttgcctgttgtgcattcagaggctggagaaggagtggagggggcagagtccaaggtaggacactaagagtcagggagaggtgatttgtgaaaggctttaggggcagcgccagcctctggataacagggaccctggtggtaccaaggaatcattggcaggactctgggagatgaggacttggtctgcatggggcagcacctcgcatctgatactggcgcatatcagcaccctactggacacattcaaacaggcagcaccctgtgagtgtctcagcaccagcacatcaaccttccaattcaccaactcactccagggaatgtgaagggcagggttccactgggccgcaccacccagcccggggtggccccaaaggcagaggggatgtgagtgctgtctctgtgagcctaagtaggccctgcacctgccagagacagggcacagagcaagtgtctgagggcaagtcacctggacacagcagtggcagaaaccaaggagtaggcatgccaggcaggtctccagcagcctctgagtttccaggcacagggcccacaccagggtggactttttatatgtacatacacacccacacacccacacccccacccaaacacacacactgcaccagtcccgtttcctcagatggacatttttcagaagaaagccaatgacactagcaagtccatgacccatttcaagatatgacaggacatcattttccaagtggagaaaacaaaaattctcagaaagccctgtataccacagaaatccatacaccagtttcaagtctcatccaacagaccagccagagtgcagggccacagggcaccctggctggagtgaacaagctccctccaaaccccctcaagattctaggcccaccagcataaaagtcctcttgatggtggggtcattccaaccccatctggggttgtaacctctcagagcagaggaaaataaacaggctgttgtcaggcagcccagggcagaagtgatgacacctgctcattctgaatttatctttattatacattatggccacctgtggaccattcagaaaagatgctttttgagtctcaagcaagtgactctttaagccgaatcacaaagaaattcccattttggccagttctgtttctggacgtcaacacccccctctctgtatgaataaggggtcttccagatggccaggaacagcactcaacaggccaaaacaaagcagagggtggcttgagaactacactgctacattcagcctgaggcccagcatcgacctggccttctcccacttccaacaactcattttgtagctttttggttaagaacaaatttggatttcttctttttctcctcccagtaatctcaaatgtatcagaagaaaggaaatttctaccattattgtcagaaacaagacaagtaaaaggccatcctcaaatactagtgttctcttcaccagacagcagcacacgtggagagtagcagatctctaagcacgacccagtgtgtaactccaaatggccccattatcctatctcgaggagagctgcgcatgctgtaccctgttttacatggcctgccatgcttctggtagcaaagcagtaatctcctggttatgtagcactggggatgccaataacagccagataaagaatagaactcatgaggccagttattttcagtcaaaccaagctacaaaaaccacagtcatgcagaagctggaggaaccaccaaggcaaagagaatggaaattcccttatgctagacagcacaggtccccagttttctgggacatctgaaacttgatgtgacagcactgggagaggccaacagtccacgaataggccaggacctaaggggaaaggctaccactctacagccggccatcagggtgctgggctacagcagggctggcaggagcagacggaggccacatgccaactccagcctctgctacatatggtcccagcccccctactcaccagccatgtggcctcaggcaagtgggataatccccgtgtctcagtttcctcatctttaaaaagtgggataataaaagattcatgtactttatagggttgttgtgaggatcaaatgatttaatatacaaaaaaatgttgacaacagggctcaacacaaagtgtgctcaacagctgctgttggtattggtggtggtggtgaatggtctgccagcttggtagggatgtctatgaagtgggacaaacatttcatgagtatgaagatagactgttcagatgatactcatctaatgccattggcagctcctctctttattgtaccaagatctgtttccttcacgtttcacccaacgtcaaccagcccttcccttctttggactaagtctcccttcaacacatcctcaaatgacacagtttccagtcccctcactcttagtcaccctccttggaacaagctcaagttgctaaacaactatctctaaagccagttcccacccgagccaacattccaaggccaaaaaccatcacctctatcatgagttgagtatcctgctttcattaggggactgcactgacgtggctgcaggttgctggtcagccctagggagccagtaccatacagccccgcgagctccctcctcacaagaggcggctgttgcctccttgtgccagagctcctgggctttggatagaggaattccactgcttgggtctcatccttactcaccaacttggaggaacttccttagagtggatggcagccgcccctccccactctgtctctgtggtgtgtgccccacctaggctgtgtttgggtgcctgtagtacctcttcctgttcttgtctcaaacacacacctgtggggctcctttcccagcaccgtgcttcacaacggggctctccttagcccaggaggggagaggctgtgcagaaaggagacttctatgacacccttggggcaagggtgttgttttgctccttccatagatctctgaagccacagctatgcaggagaacagaaatagaagccagccacacccagtcttctttggcatgggcacgttgaacgggctcagttctcctgccacgactgaaagggcaccctcccacagaaggcacatgaccactgttccaagacagtccagatcaggagagaggcctttgaccagggcaaagcaggtgctgatgagaaggcacagcaaaggtggcccaagccactctgcctattccctatccctcccctgttaactccactcacaattccaaacccagagccctagcttctgagatatccaggtaggcgacaagattttctttctccacatgatacagactgctgagaggctcccctaacaaagcaccagtattctccctgaagacacaggctcaaattatgctctattcaaagctggctgtgttcccaactcctaagccctgctggctccctctgccccccaccctgacgtgggggaagatgctacaggtgtgggggtgtgttagtccattctcacactgctaataaagacatatttgagaaatacccgagactaggtaatttatagaggaaacaagcttaactgactcacagttcagcatggcttgggaggcctcaggaaacttacaatcattgcagaggaggaagcaaacacatccttccgcaaatggtggcaacaaggagaaatgcccagcgaaggggtaggggaagctccttataaaaccatcagatctcgtgagaactcactgtcacaagaacaagctgggggaaaccacgcccatgattcaatgatcttcacctggtccctcccaggacatgtggggattatgggaactacaattcaatatgagatttaggtggggacacaggcaaatcataggagtggggaaaccaggagaacagggaaataaaattggttttcacaatagctaaactttccctatcctcttgagagtatttctaagcaaaagagaaatatacttttctttttgctttctctaaaaaaagaaggaaagaaggaaggaagaaaaaaatggagggagaggaggagggaaggaaggaaggaaggaagcaaagaagaaaggaaggtcaaactgacttgatttagctcattattaaacatgcaaataagaaaattcctgttcttggaatgtgatcagtcatctgcataaggtcttgcgacatatctacgattgaattatttctttgaatcaaggattcccccggccacacacaaatcagtacttgccttactttggaaaacgaaaagagctcactaaagtggtccctcttataataaggtgagagtggcctctaggacaaatttcagcttgtacaattctggaatacagaaagggtagctggctagcgacctttttccatactccaccaggcactgtgtaggggctaagggaaagcttcccctttgccctctgaaagctcactgaaaactcacagaagacagattagtagaagaaaaggcatacgaatttattttaacatgtctagcactggaggatccatagagaacaattacccattaacccttcttcataggggaaggggagatgggggaaatgtggcaatttgagggatggtaaatgatttttagggggagacgagtggacttggggaacttacaatggccatggacaaagtctgttgggacttcagagcagacaagggctggtaaatgattctctttgaaatactgaatgagcaccaaaacagaagacgatggtttgtgacaaaatactgtccaggtgtgttgacagacttcagtctttcttcctgtgatatgggttcagttgatgaaaactcagggaggagactagaggtaattgctttcttccttggtatttccagactttaggcagataagggatgaagagaacaacttcatccagagctttgggagagatgaagaattgagagatggggtagggccaagggtggggggtagggagtgaagatcagagagaccctgaggctcttcttatttcagcatgtcaaagcaccatattttggggtaacagttgctgagccccaacaactgccaccccatagtcaaattaagccgatcatccccaaagcaatattagtccagtccagttcctctcatgacaaatgacctgaacacaggattcagcgagtcttactcgctgtggtcattttggaggtagggagatcattaacccacatactttgataaaatacgaaacgcctttcctagctggttcttttcctctcctataggccgacccccctccatccctttattagtattgaactgaacaaattagttaatatgggaacatttggatgtatcaactttgctctgaaacaaaaatgtattcatccccaaactctatgctgggggctgagggagagtccttacgactgacatagtccccaacaaggttctcattagtcccagtttttttttgacaccttttcctccgcattcacatccttctgccctctccagcactgtgcaggaagaaccaaccaacctgaccttggtgaaagggctgtgggtttttcaacccttcattcctgctactttttttttttaattttttagtattcttctgtgcatcctttcttctctcctaggcttctcacccagcctctctgttgagtactacttgtagacagagctccctcattcacaacatcccaatgtatttgtcctgtatcaaagcaaaccttatacagtagctcttttaagaactgctaaaggaatgaaggaacaaaactgagccaaataaagcaaaatgaagaggatatgtatgcaggcaattgtgggaacatatcaccagaatcctctcttgttattgtacccaaatccacacattctcctcagtgttgtctgggaaatacatcaatccactgtgaatggtttagatagaatagaatccatcaatttcaccagcttcattcctcctcagatgatgagccactttctccactccacctccagggctggccccagtcttcctaaatgttcattaactcctattaggtattccgaaactctcaggttttctgagccagcatagaatggttggaaaagcaattgctgtagaatcaagaagactgaaattggaatactggagcaactacctactagccacaggcaggttactctctctgagtctcaggttccccatttgcaaaatgaagcaaagctatctactccaaggattgctgtgaagattaaaagaccacgtgctaacctaataggtgttcagtaaataaatatatttttctatttttccctgcaaaattcatttcccaaacacaatctttgttcttttttttaacatataatagccatactatggcttaccaactccccagtaagccaggactctctgtatacgcagtgttttgccacatcatttacatggatgaaattgtttcctatactcccaaatttaccctgcttggtggccaagaatcacttctgtccctattactagtgatatcatgtctgcatttggaaacagacaagtgttatacaaaattacataatctgataggaatgctgtcaatggatatctattattatatttaccagtcaaaattttagttcttataactggtatcaccaattaaaaaattttataagaaaggggtttttgtaccattggatctattgaatcattaaaaaaaaagagtttagaaaaagaagaagctatttatatactatttcattccataagactttatccagttccactgttaataaaatgtacatgcgcagaattgtattgttttctccattactaaacatgtatttgctgagtaccttctgaatgccaacatggtgctaggtactgggcatagggtggaagacacaatagacaaggacacagctccctggtatgggaaacagatactttatgtcttcagttgtaaggtccactgttgttcctatttaatatctttgaatgtggaatatatcttacaatgctgtgggctagggcatggttgtgacattgataaaaagggctcttaactgccatcgcttcagttgacttgcttgcctttttgagtggcagtgcatggcttgagcttaatttccattcagaaggtttttgaaaagactaactcattatttgcacataaaaaggcacagagacagaggtgaggcataaatttgatattcatcattagagtaaccatcatcctatgttttcttacaaagtaacaaaaagtgttttatgaaatgtaatcacaatatatgaagctgtgctttactggtgcacatgcaagaggattgcccatcaggctctaagcaaagcaactaagagtaggagaaactgccaaaccctaaagtaggggaaagaaatctccaaacaacaagaggcactgtgaccaattcacataagactatcactaagacatcaggttttaacttgtaacttgcttttttccttgttagtggtatgttaaacaatggtatatcatgctatttgtgtatactggattcaatgaaatactataataaacaagtaagcaaaacataagatcataacacgtcctgaaaggacctctcagcaagagtgacacattgccaagtaatgcacattgttccacatggagttggtgaggataacagcacttccttccagaaatactttagtatacaaagtgctgtcacgtgatgacgtctcatttcagcatctcaacaaccgcacctggaaggccttattattttgtatatttacggatgaagagactggatctcaaatagcttaagagacttccctaacataactcagctaatgcctggaagacccaaaactagaatccagggctcctgactctacatcctatgtttttcttctcggctacatgaaatggtacaaaatacgaattaaatgattatccatggtcttgtgtaattctggcatgtttccagctaagacttctcagctgttcattcaactcaaaggcatccttcagtcctcttccccattcttctctgtctcggggatctgcctggggagagagtgtggtgaaagcagagtaactgaatcctcactaaccccaaggccctaacgcaaggagatgcaggcaataaatcattccattgcatttaccattgcattgcatttaccattgcattgcatttacccatacgtggggctctccagggatggcatcagatgctgcaggaacatgaatgataaataccacatcccaagggttagggcccaggcaagttctcaggggagagctatacatatgactggtaaaacccactatgtccagaagacaagggcaccctgctggtttgcatgagcaaagctaaattggcgctgacaactggcaataggtattgagagtctttttaaaagttgatgtcacttaatctagtaatcccatttccaggaattcattcaaagagaattaatctgggatatagagaaaggtctatgaataagattgcatcacagtgtggtttacatttggaaaaaactgtggttgtaacttaagttacaacagtagagggttgttcaaatattataattctggtacaaccacacgttaggattctctcttgccaattattgatgtcgtgggggagtgttcaagacaaaacattgagttataaaatcaggattctaaattatatatatacacacacatacacacaattaaactcaaacatacacatggagacacacacagcattttaaaacctagaaggaaatcacaaccataatacaatagttatctctgattatgggaatacaggtaattttggtgattttctctatgttttcttttttttctttttcttttttttttttgagacggagtctcaatctgttgccccaggctggagtgcaatggcatgatctcagctcactgcaacctccttctcccaggttcaagcgattctcctgcctcagcctccccagtagctgagactacaggcatgagccaccaagcctgactaatttttgtatttttagtagagatggggttttaccatgtttgccaggctggtctcgaactcctgacgtcaggtcatccacctgcctcggcctaccaaagtgttgttgggattacaggcatgagccactgcacctggctgtttttctctaagttttctacaatgttttattttgctttttaagacagaaagtccacgcaaaccagtcaggaatagatgtgaaaaatggggatggggcctttgaaccaggagcaatatgagaaggtgagaaggatggcctgggccggctgggtctgcgagactacctggaaaagccacgggaatcacagcccacagggtgacatctccagatccagcagtcttttaggaaggcagatggagtctcagacctgtcccacccatcttaaagtggcctggtcacagggtcagagcttcagcagacagaggcgccctgggataagttgccaaatatgggttgagcaacagtggcactggaacgaggtaggaggcggggaaaggggatggaaggtaaaatcctgcccctgtcctcaaggtacttacagtcaatgtgaggaaggctgacagccataaaatgatgacctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggatgtttcatcccaaaggacgctcgacctttctcaggcatcctgccactgaagaagtcaattactcacggcccacagtccctaggttccgctcagcacagtctggaatcaagggttcatttaatggaagcttaacagattcagatttctctaatattccacatccccttctgccaagaagctgctttgaaagatgacactcccttgatgtgaatttgcagcctgccccattaacaaggcttcagtcagaaaacatttttaaatcaaccctgttccagacacttgctcccaaggacaaactagaagaaactctgcaccagctcaaaccttccaagcactttgatgatcagaaatgaagggaaatattagaacaaatcttattaatccaaatattctcaacaatcttcaaagcaaaccgttgctctgggctgcagaaagcagagctcatgcagagccggccctttctgtcctaactcctgttagccaagccagccccctaaaaacagacctcagaacagcagagggaaacattcagaatcaaaggtgatgggaggaaaaaggaagaggaaacaggtaaatgaaagaaggaggatgaggattggaaagctgactacttaaacttttagcacgtccctcaaataaaaggataaggtgttgtatgccacactgcctcaaagcaactccctcagttcacagttgtgcagctgagaattctggagaaaccccacggcagctggcatctatgtcctggctccactcacaaggggctgagaaccccaggactcctcaccatgcacatttctcttgggtgtggtgggaggagcatttccgtttccaaacctcggggccatttgctcttagatacacaaacatctccccagcctttgccaagttcacccagccagaaggccataatgcagaattagtagcatttcaatcatttccgtgacgagctggtgacaggctggaatatgatgagtgaagcaatcagatgttgttacaggaaagaggcatgagaagagaatgacaacagagtggtacagtaataagcatcatcgtaaaagcccccactggcatcaagtttatcatcgccagcataactaaaggagccagaacacctgtttgtaatggggattccagctcctccactttctagctgtgtggctgagcacgcttctcgccctttctaagtcttggctgagcatctgtggaaggtggatagcaatcgctacttcataagattgtttagtgattaaagtcaaacaatgtctataaggcatttgcaaagcattagcagtaccagtagtaccagtagtagtagaagtagtagtagtatttggtattataaggagtattttatattatttcaaataggattatgcactatttcattatacccttatctcatatagaagacatttttaatgctatttgattgaaagtagaccagagactcagaaaggttaaacctctttcctagtaagtataaaaagttaatgcaggccaggtgcagtggctcacgtctggaatcccaacactttgggaggccaaggcgggaggatcacctgaggtcaggagtttgagaccagcctggcaaacatggcaaaaccccatctccagtaaaaatacaaaaattagccaggcatggtggtgcacacctgtaatcccagctacttcggaggctgaggcaggagaacagcctgaacccaggaggcagaggttgtggtgagccaagatggtgccacagcactccagcctggacgacagagtgacactccatctcaaaaaaagttaatgcagaaataaggctgcatatcggtttcctattgcttctgttaacaaattactacaaatttaattagttaaattgacactatcttacagttctggagtcaaaagtcctaaaattaaggtgtcaacagaactgtgtttcttctggagactctgaggacagaatccgtttcctcacctttttcagcttctagaggccacctacgttccttggcttgtggctccttcctatatctttaaagccagcagcatagcatcttccagtttctctctctgattctaagcctcttgcctctttcttataagaacccttgtgattacattgggcccattcaaagaaacaaggataatctccccctctcaagatccttaccttaatcacatctgcaaagtcccttttccatataaggtaacatattctaggttctggggattcagatgtggacaaatttggaggtggtcattattcagcctaccataaactggatcctgttctgcagaacatagctatttggagcaagaatgggagttttgtttgctttgctttaaactctttcatttctttactcagcaaataccatagagcagctactatgtgcagggcacattcataactcataacctcctcctctctggatataaccacatcagaatcgagcttcattagtgtgatataaaagaggtctttgcatatacacacacatatatatatatatatatatctcaaaatatcaccaaaacccatactttaaaaaacaaaaagggcctttggagatcatcagccaatccccttattctataaaggggcagaggagtaatacaactatcccagtgtcaaatagggagtttgtgagacataatgagggcctgaattagatctggaggaaaaaaagtaaatggaggtatttttgagaaaaatcagtgagctgaacggcaatagggtaggagaaatgtaggggtcaagggtgcctaaagttcatggcttggggatgtcactcacagagctggggacagatagaggaaagacacttttgagggaaaatatgtattcagtgtgttctagaactcggatctcttcttagtgtcactgtgaaattttccattacttcatctcacttcctgttctctcataagcgcgaacacggggctgtaatcatcgtctgaccaccacatgttagtgcactgtgtttcttgctgacacctggctaggctttgaggatgagtttccatcccaacatctaccaacatacaaggagcccaaggcaatgggattttctgcgcatctttgcttgaaccttaaaggtgctgccccattgtcttctggtaggcctcgtttctgggaagacgtctattgaattcttatctttgtcactgagtatgcagtttgactttttacctctagcttcttttttttttttttttttttttttggtcactggttttcagcaatttgattattctgtggcttggtgtagtttccctcatattttttgtgttttgagatcattgatcatcttggatctatgtatttagtgctttcatcaaatgtagatatttttccaccattattatttctttaagcatttcttctgtcccctttcttgtctcctttggaattttcaattacatatatatgaggcctcttaaaattgcccgacagctccctgatgttctgttaatttattttcagcctttattctctgtgtttcaaatggatggtttctgttgctgtgaattcaagtccactaatcttttcttctgcaatgtgtaatctgttattcatcccacctaatgtatttcatatctcagacattgatttttgaatctctagaagttcagtttagacttcttatatctcccatatttcttcttagcatgcttacattttcttctaccatcttgaataaatgaaatatagttataagaactgttttaatgttcttgtggactaattttaccatctataacaattctaggttggttttgattgattgatttttctcttcattatgggttgtattttcctgcttctttgcatgcctggtaatttttgactagataccggacattgtgaattttacctaattggtgctgggtattcctacattattttaaatgttcttcagctttgtcctggggtgcagttaaattacttggaaatagtttgacccttttgagacttgctttaaaactttgttagatgggaccagaacagcctttagtctagggcaaatttgccccttgaatccaaacactgtttatgttgttaatgatgacaaaatatccatgtcccacactattccttactaagtctcccttcaacaattgtgtttgagtagaactgttaactgcctcacctcactctcctgtgtattcacaaggcaaagatccccaaggttttgaccaatacccaatgttgttttggtgccagcttgcacagcaccagggctcttgcctctcagagagaattgtgccccctctctccactatgtggcacagcacattgagctcaacaacgttctatcagactgatgttgccataacactgcatatcttcacccaggaggggcgacagccctaagtctcttatgtggcaaaataaaatccaactttcagtgctaaaaaggccctgcttttctggagcgaaccccttcagaggtctcacaagcatttaaaagagaatttctagaccacaagtttcagtgtggagagctgcaggcttagagaattgcagggatgtttgaagccctgcccacagttccaggaaacaccctttgtatatgagctcctttcccacacaaatgtgagaaggaggctatgaccctggaaattgaacacagggcaacagaaaccctgccgaaactattcttgcattgacattagacacaaaaacacccatataagcttgatttgctgtcacagtcaaataaaacaataacatgtaagcatttcaaagagattccactgacattctcacttgtgattctgacaacaagcgtgtaagtaagaaaggcaggcgtcacagctcctaagtgacagacgaggaaatcagccttgcggaggttaaatgatctcaacaaggtcagacagctagttggtgcaaagtggggccctgaacccagatcttctgactcttggtcaagagctctattcattccgctgtgtctgctctcttactatatcagaaaagggaacagccaccaacttcctgtgttgaccctagaccaggacttcttgatgacagcacacttaacatttggggctggataattctttgttgtgagaggctgtcctgtgcattgaagggtgttgagcagtatccctggcctctacccactaatgccagtagaactccccttgccccctgttttgacaaccaaaactatctccaggtgttgccatgtttccaaatgccccaaggtgggggaaggtaacagcagagcaaacttacccctcagttgaaaaccactgccctaaatgatgcctgagaatgctgtccacgtgtttgagaaagcagtggtgattaagttagttctgtgaaaggagaaacaaaatcaaaagaggaacttgtgctgataccagtgagtctgggaccacgaaacttggccgtgagagacagaattgtgcagcaccagggagttatctaaaaagttctcttctgggccaccctctgaacttaaccttctgtgttctcgctccactccttcaggctcagtcagctctgcaaaacccaatccactttccaaggaaacatttctggaaggcaacacggaattagttaatgtgatgagaggcagaacagagcagttaagatgcaggctctgcacataccacaacgtggatgaatctcacttaatgttgggtgagaagagccaggcccaaaagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatggtggtggtggttacggtggttgtaaacataatagacactcacaacactcacagagctatacacttaggattcgtcacctaaaaaaaaaaagaaagaaaaagaaaagaaaagaatgttgactctagaaccaaattgtctaagtttcatccctgaggatgactctggttaccttagagcattttgtgaaaagttaataaactacacagggtatacaggaagtgcacaataagtatttgcatcattataattaacagaactacacttcagccaagcgcagtggctcacgcctgtaatcccagaacttcaggaggccgaggcaggcagatcacgaggtcaggagatcgagaccatcctggctaatatggtgaaaccctttctctactaaaaatacaaaaaaaaattagccgagcgtggtggcaggtgcctgtagtcccagctactcgggaggccaaagcaggagaatggcgtgaacccgggaggcggagcttgcagtgagccgagattgtgccactgcactccagcctgggtgacacagagagactctgtctcaaaaaaaaaaaaaaagaaaaaaaagaactacacttctagccagtcaggcaaagccaaggattaagagagttactctgaatttctctgctgccccctctgcctcacctcccatgcattgaacacagagtgtatatgtaagtcctcccaccccaaccatcaagacaggcacatctgccatttttctctgtcttcttcagttccttccaggttctctctgccttgcttaggagctgcccctgtttgcagagctcttcatcaatagactgaatatttacagaatagcgcagttttgattaaacagttcatttcactggagactggggtggtgtattgtgtctcctccggagttattcttggcatcagcagcccttgctcttagcatccgtttctttacattttaaggtggagcataagaagaactgcagtgaaacagatcagatggggggcaggtgggatttctctttacctttccccggctatttcttggtggatttatcccgttatcttcgctgctatttgctccttgctatcttttattcttctcttttgaaactggccgagtcagaaggaaataaacaaatgcaagggtgtgtagaaagagcattagatggtaggtccagaaacttggactctacatccagcatctagtgatgtgattgattgatatctgttttagcttttcggcacctcaggttttgggctgttttttttttttttttttttttaatctgttaattgaagtgattggtctagatttgtggtctttgaatgtgtgtcagccatggaaaccttcctacaaacagaatctcaagcagcaaatgttaaaacctaaaagcaattttgtttgggttgaaacaaggtgggcgggcagtcaggaacccacccttttaacttctgtgtcctctgccatctcctgtagcagcccccaaagtagttccacaagatccttggccttgggatgctagagcacaacgtctaaaccattcgatgtgcctatttagaaactcatttcctgctcttaaagcgctcagccctctcccctacacataaagccttgcctccatgaaagcagggaggactagccttcgaaaccccagcacacagaggtgagtgtgagcacagctcaacagtatacaagcccgctggaaagctgccccagacagaatttcctcagttgcatcctatggactatcagtcccagaaacgcttggccaaaaaaggaaatacggagggcgggggcagcttgcttcaaagtaattgaggttgagagccgctgtataccatctgccccttctagagattaaattcacagtagcttcttctctcgggccagcaggaagcctgattaatgccgcttaatacgacacttcccatatttatttggccacaaaactcctttttccccataactcctattaatatcacaggaaacagtttgagatcagaaaagccttcacaaaggcaatttttaaagactgagttataaggctcaaaataaatgaggaattctagaaaaggaagggaggagggagaaggacactggtttggggtctggagggctttaagatgagggcgaaacaaggaccacccatgattccaaagaatgtccggaacttgcttgctgtctgttggtgcctttctttcagctcattcctagagggcggacagaggcaggagttgctgtgttgctggccagtggctcctgaccataggaaggggactgtgggtgtgagaagtaaagcagagcaggcccctgcctctgttctccccttccgcctggtattggctcaccgtgacaaatctttccctaggaagggcagaaaatgaattatcctgttaaatcaattcagcagataacccacctctgtgcaggccttgtgctgggaccacacagatgcataagacacgtacagcttagagcctagtcatgaaatgggaaataaacagccccatcctcacggtctgaacaggggattggggagcacagagaagggccccaccccgaccagctgtcaagagaactatccatacattctaattcctccaaggttgagggctaaggtgtaggaagaggagagaggttccaagcagaaggaattgcagaagcaaaggcacagaggcatccgggacctgcgagcagctatggctggagccgcgtgtcgcaggatggagagcgtgtgaacagaggggactggaagcggatcctcccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagttaagcaggttatataagaagtccaggcatggatgacgatgatcataatcatgatggggaggatgacaaagatgactaggaacgctctgtcatctctctctctctctctctctctctctttccttcctggttgtgtgagtttgcagggagacgggaggttgtgaagaacaataaccagaagagagtttgcgtcttcatcagaaagcacctggggcaggtagagttggtgctagcttctccatccatccctgacaccccagccccattcatcattcagcagaagacaggctgggctggcccaacttggtcctgtacccccaccaccccagaaccccactggtccatagtgaggatcccttctctttgactctcctccttctctgtgactcgcctaagcctgatcctacaccttctctcccagccactgcctcagcttcctccacccccagcttgggacgagccacctccctggctgggtagcatgggacaagccatctccctgcagaggcagagaaccagtgacactacacgcaaaccaaggccatgctgcaaacagaacaccaaggcaccctcgtcttaggatgcattatattcggggtagatgttgaattctagtaacacattccctggggtgttttcaaatccagacacactggagccttgttccagcctcactgtgggcgaaggccccgggctcacctccagcctcaggctggctctggctgctgcccctgttccatcctggcaagcggaactgaacaggcccgactccacagcccccggtgctgccagctgcaagctctgctgactccaacctcaggcccctgcgtgcctgcttctaaatccacacgttcctgctccttcctgcccctgctgccctctcagaatgccacttctttctgccaagacctcaggcattgctatggcccagccccatctttattgatgtcggggctctgtccccttgcagagcccatcccattgccacccacatctgggacagcaaaagacttctcagtttcctccagagttcagtttcttccaaaaagctcggcacatcttagctgccagtgtgaactgtgagctcccagagatgcccgtggcactttccaacattcgtcacttttgacacatctaaaatatcctagctcccagagctgcgtgagcaccagcccagatggaccggctgctggggaagcatcagtctctccagggcctctgtgaagccctggggcagtagggggatgtctgacaaagcttcctaactgaggagccccacttcctctcgctctgggcacccctgccaaataagcgggcacctctatgttccagcagccctcgctgcccagcttctgagctgcaagccagcttccttccacagaattctctgcaccttggcttccggtggctccaagcactttgccatctgccgagtcagttctgccagagatgaagcagctgatgtggggagttctctgtgggggccacctttcctctctcaggtcacctttactctcagaaggaaactgaccccctgacctattaaatagctgaaatcaagggccactaggggcccaagtcggtgaaggtgcaactgaaggcaagaaggtcagcatctagctagacagacacgtaagccaagaagacagacgaggtgagtggaccctttgactccacagtcagacagcaagagagctactcccagagttctctggggcacgaaggggctgcaggggtaggtgaacagcatccagagaaatagttatcatggaaagtgcaagcaggaaacaagctgggatttttttttttatttaaaattatttttcaggccaggcacagaggctcacgcctataatcccaacactttgggagcccgaggcaggaggatcacttgaggccaggagtttgagaccagcctgagcaacacagtgaggccctgtgtctatgataaataaataaataaataaattagctagtggagcagggctggtggcatgtgcctgcgatcccagctacttgagaagctgaggagggaggatcgcttgagcccaagaggtcaaggctgcagtgagctacgatcactacactccagcccaggcaacagagccagaacttgtctctaaaaatacaaagaaataaaagaaaagaaattcttttaaggaagtaaatactaacatggctcagaaattaaaagaatgtaaaatagaatagatttgcaaaatctcacccccatcccacgatgtccatatccattccctcctccccctttcccaccatgggtaaccacttatattcatctcatctgtatcgttccaacataaccttacgcagctgaaagccaacatggagttatttacttatgcccccacccttccacaaaagtatcacactttagatactgttctgcaccttactttggcaactcagcagtacattctagaaatcttttcaaatcagtacagagtgtttctttagtcaagctgcaaagtattccattgagggatatgtccccgttcagttatctagacactagatggacacttgggatgtttccagtattttacaattacagacaatcctgcaatgaatgaccttgcattaatttcatttcgtaagtgtgcagatatagccacagggtagagtcccatgcaggaaatgctgagtaaagagaaaatgcatttgtaactttcatagctgttgccaaatccctctccattggagttgcaccattttgcattcctgccagtgtctccatcaaggtgtgtggtcacactttttaatgtttaccaatctgatggttgagacttgtgtctcagtatatatttactttgtatttttcatcttaggagtgaggttgaggatcttttcatatgtcaaagggccattcatattcctttttctgtgaaacggctcctcatgtccttggttggcccattttttgttctgtgggttgctgtccttggtctccttgatttctaggcattctatagatatcggggatattcgccctttgtgttatgagttgcaattattttttctcactttattgttcattttttgcctctgcttatggtctttttttaatttagttggtcatacagaagttttttgtttgctttaatgtagtctaatttaacaatcttttacagcttctgaattttgaatcacagagggagattcttattcaaaaggttatcaaggaattagcccatattttttttctggtcattttatgattcctgttatttcatttaaaaattggatccatttggagtttttcctgatgtatgatgagaggtatggaccaaacttataacttttcatctttttccagatctcccaatactattttttaaagtccatctttaccccagcactttgagaaattagatttccactgcccagaacaacctggccaatttgagaagtcacttctatcaaatactgaatgcaaacatatgcatttgagtgttctgggtttctattctgcttctttatccaagctcctgtatacacagcttgaattactgaatctttacggtacgtgttagtatgaaataggacaaatcttcccccatagtcctttttagttcagagctcccctggccatttactggcaagctgagctctgtcactggggctctccttgctcactgtcatgttttattctcttctctcctacaaggaggccaatatatgcctgcaggcatccaaccagggaaagaggcaagcacagcccactccccaaacaaggcagaggcaggggtgcaaggccttctgggagagtcccagtaggccatgtctatgtacccctttgaggccggtgttctggggaaaggccaaataggagacctatgtcttcctggaggtttggactttgccctgaagattctcagcactgatcttctggtccatccaatctgtttaaatgagggtgatcccagataacctcaacataaagagttatcctgtctgatattctgtctcctcatgatctgttactgatcaggtgcagaagaacccttcaaggaggaagatgttacaatagcaatatcaatgcctacttctactaccaccaatgccaccagggccacctttattcattgagaacctgctatataccaggcattgtgggaggtactttacacgtttatctcattcacttacaaccccatgaggaaaccatctgtaaacgtgcccagaattgtggctcattagcggcagagccaagctttggatcccagcctggttccaaaactcatactcttcaccactgggcaacttcttctcagaatgatctgccaccctgggatgatgcaaattcccaggcctcccagacctactgaatcagctgctctgggaatggcacccaggagtctgcatctccagcacatgaatacatgagaaccactgctcacaaatgtaaaaagttaggtaatatatcagggaggctgtgaggatgagtgtttccttagcagtggtgtaagggcagaaccctggctggagtgttttgcagtcagactgatttcctcattagcagagagtgttaaccggtagcctagtttggctcctcgaggtgcctgattcagacagagcatcccacagctggagcaccctagctggtggaggcagggactcagccaagtaggctccagagctgccacctaagcccagtagatttctcttgcccagaacaacctggccaaatggaagatgggaggctgaaatcctcactccaaggaggggcctccttttcttggcacaaaggcaccgcaccaagctacacagctaaggcagtgtgctacctaaagcaggtgcacagaattcacagagaggtaccaaataggctggcaaagaccttggtggataagtacccacaaatatctggaaggaactatgttgggttgagacatgagaaggaagagatcttaggcaagtttggaaagggaaacaacacattgaatgccaacccctggactagacatttcatcaacttcgttcatcctcactaccacccacacaagacggtcttcctatttccaacttagaagaaggaagttgaggctcctactggttaagcaagcttcccaaggccatacagctaataagtgttaaacaatcaaacacagaactgactggctccaaagccagtgcccgccccactggccactccactaccctgcctctgccattgctccctatggcaacctggaaactgtggggtacctgcccgtggtctgaagtgggcaggcagcagtcagctgggcctccagatatgggtggtgaagggaggatacaggtccaaaagaatatcttaggggaaatagtgcacatgcccagaaaacttttatagtctcagaacttagatgtgcggagaaatcgaattctggtcctggtttgcttttttagccagttgtgggccttggcagtcactgaacccctccttatttcttcatgaggaaattaacatgcctaggataggaaccgctgtgctgcagaccccagggtcaggcaagtctcaaagaagatgagagtcaccaagggcctcaggaaagctgaagggcacagggtgcatgctgcagccatgacctcaacctctgtgagtctagaggtgaccatattggccacacataagctcaccttccccctacatttcataatccttccctcccatcagggccagcctttgattaaaattcccaagattatctgaggagctggcggtaccacccaccaatggagttcatctggctgcctttacaccagccaccttatggctgggtgggcactttcctattcttcggccaacacaacactttccaaactgtgtgacagttgtttatttacttgcctctaccataagaccatgagctttttgaaagcatggtctgtcttattcactgttaggtatcacagtgtattcacaatccctgacacatagtaggtgcttaataaatgtgtggttgaatgaataaatgaattaatgaatgaatgaatgaatgaatgggatcagggtgggccttcagtctctaaaagcatacccaagagccagccctctcagccgcaggtccgcacatggggaagccctagggaggttcaaggactagatcaggcccattttctcatcaggcagcccccaaacctctgccccaaagagcacatccaacatgctttcagcccacactccccacccacggtttactgcctgtaatcccagctactcgggaggccgaggcaggagaatcgcttgaactcgagaggcagaggttgcagtgagccgagaccaccccattgcactccagcctgagtgacaagagcaaaactctgtctcaaaaaaaaaaaaaaaaagaataaccttgggctgtttggccaagttaatgcttaatgctttcctcatgctgcaagcgtttatctttgcccagattccagctccagggaggggaacattcctgcagaacagccaggcgttcccaggtcacctctgctctcactctcacttttctttttgcatgattaaatccggcctaaaaacacgtctcaggggcacatatctgtcactcataataatcctataaggtaggtactactgttagtcttattatatagttgagacacagagaggttaaataactagcccaaggtcacacagttaataagtagcagagctgggatttaagccaggcaatctggctccagagctcggtgcctttttttttctttgacagggtttggctctgtcacctgagctggagtgcagtggcacaatcactgctcactgcagtctcgacctcgctcaggtgatcctcccacctcaacctcccaagtagctgggactacaggcacgcaccaccatacccagctagagcccaagctcctaaccgcttctgctgtgcagtaacaagccacgctcagggcatgggcccaacttgagtttcttccatccacgggtccagactggaaaggaagcagcgatcttctcttcttttctcactgagtataaggcacccaattcatcttctggcagctgacctggaggacggagtggccctgattttccttttacaggtacaatcactgccaatactaaagcagtgcctgtccctacctgccagggcacccaggatccttgtctccagcagtaacttcatgaggtaggtggctctgggctgagacaggacttgcatattcctagatcccttgactgtgatgtcgaaggtcctctgcccccacccctccttctattccttgtaagcttcacttggcaattgtgtagtttatgtctggtacaggaatgaaggataaggtcaaatgaagctcaaagccaggagctagatagtcatgatatatcaaataaagttttggaacaagaacacaatgggattaatttgccaatcaaaacagcgcttggcaacttgactgtaagccaagatctctcatggcaagagcagctgaagggcctgtgattgtccagctcctggggagcctccctggcctaaccgtggtcagatgccagcatcacagcccccttagctgggtaaggattctcctagtgctacctctgggagagaaagaaaaaaatctagtctgagaatgacaccagcagacagcagctctgccaggtgtttgaagggtgaaggtcatgggactctgtttttactaccctggtcaccccaattgtttcggggtattttccatagacaagaggatgccccagtcagctgtcttccgtgattcaagacccagtctactgtcttctgtgattcaagacctgtttcctcttgtgccgatcagaggccttatttggaggcatcggcctttatgtggcatggaatgtaagccctctgagctttaacagagataggaagagtcctagaacatggcagggaagagggtcggaacctctgtcctccagcacagtagaaggatgctggcttgaatgtcaggagagcccagagtttctacctggatgcatggtttggggcatgtcaggtggcctttctgggtcccagtttcttcaactgtgacataaggaaggtagactagatcatcactaccaataaaaggtccctggtccttggggagcagtggttggagtgggagaagggcatcgcccagctattttccaacacatcgtaaaagatatcgcacaggacaactgaatgttgacttggtttgcttacctgtggaattctatccacttggtgtggtaaaacggattctcgccagagaactggaagtgtagatgggtggtgttacctatatccttgattgataagagaaggaaaatgaatttttcctcaataagtacaggttgtttgaaatgcaggctgggtgcagcgacgctgcatggtctccaggcgccttgtgtttctaaccctcttgctggacaacttggcctccacagggtagtccccagggaacccttggccatctccggcctgaaggaatcagggaagaccttccggacatgccaagtctccctgagaccctgctccatgagggctggctccctccccgacctggtcttttggttcaaagtcagtcctggagttatgtctgccaattgaccccaacctccagaaaactcagaaacagcctgtcctctcaggcctgcaaaccaggagcagccaggcccagccctgacttatgcaagtaactaccacagaaggcctgctgtgcagcctatgcctctcaacctggatcaagggcaatgtggagaaaccacattattgcttgactgtagtgcagtattccaacaatcattttaaatgtgcactcgtgtaaccatgatcaccatcaagatgtaggatatttccatctctctttagagattcccttttgccctttgctagttaatccccaccccattccctggacccaggaaatcactgatctgctctcaatcacaatagctttgcttttccagaacgtcctgtaaatggaatcacacagtttgtacccttttaaatctagcttctttcacttagctttatgcattttagatgtatccatgttctggcatgtgtcagcaattgttcctttttcctgctgagtagtattccattggatggatatgcgacaatttgtttatccatttaccagttgatagatatttgggttgtttcagatttggggttattatgaataaagctgccatgaacatttgaatatttatgtggacatatgtttccatttctcttgagtaaacgcttgaagtttactgggtcctatagtaagtgtacatttgcctttaaagaacttgtcaaacggttttccaaagaaagtattttttgttctcaccagcaatctatgaggagttctacccggttttgtcagtctttttaattttagccattctaaagggagagaagtgatattccgttgtgttttaaatttgcatttctcccacgactaatgatgttaagcacattttcttgtacacatgtgccctttgtgtatcttcttttaaggatatctgttcagttctctcaccctaccttgaacctacacagggtggaatgtgcctatgacctcggaaggactttagggaagcaagccccactttccccagagaggattccagtacaaacggaaagctcttctgaatggcatactctttcataaccagatttcttaaaagaaaaaaatcattctgattctagcctgaagtgcagtagaattcaagagaatttaagagaaaagtttagaaggaaaaaatttttggcaagaaaaaagactctacttacttttttccctgggatccacaaaagaagaagttgtggcctcaggctacagtagtatggagccaaaatggactcaaaaaaaaaaaaaaaaaaaaaaccccagaataaatcagacatgaaaataactttccttccatcccgtatctcattttcttatttgacaaaaaaatagtaaagagcaactacaacaacaaagaagaggtgaaacaagaatgcaaaaaatgatgggaagatggcaacctccaaaatgtaataaattaatttcagcagctttaaacctaaagctatttgtaaagaatagctagaaaagaaacccactcaagacaaacttaggaatttcttctgagttcaaaacaatatcttaatgacctgaaaaattaccacggctttacaaagcacctcattcactccttaggagtgaattataccttgggtaattgaggttcgacattatagtgaagtgatgctagggtgtcacaagaggtgaaggacaatacaaagtttagtaactattgtgcacattcagaaattgagacacagaattactttcaagaaaaaaggaaatgggagggtcaggtgtccaggtcagggcaaaattcaagatggtgggagtgggagaaacattcctcaccatggccttgggcagaatctgcttatctccagacaaagctcagcaacagctaggagctgaatctgtaaggtccagcagtgactaaattcccacacaaatgtttccatctttccatcgtgcaagaaattctgaagccaacattgcccagctacagatcattggcctgaccacagaagccagggacagagctgcggttacatttattacataggattgttccatcctgagcagagtacatggcctggagagttttcagggcaattatgaaatttcggtcttccagaggacccttgccaggtctaggaatattttcagcagtggatgtttacaaagcaaaagcccccccacacacacattagcaaattaaataatgcatgttgtatgaaaaaccttgtgaggggcatagcaatacccgaggcttctttcttatgcacttgtgtgcccagtaccagccaatacatggaaagggctcaacaaacactgaactgagcaacagcttctagcccaggcatcatgggcgggaggcagatcctgactccaatcaggcctcctatggtagaatccctggttctctcccatggaaggtgccccacctcaattgcctgcagtcacccatctgctgatgtccttacccaaaagaaaatgaaataatttcttcttgtatgaaatatcaggaaccctcaaacctaggagttaactaggaatagaaaaatcacttgctgtaagaaataatattagaaatgtaatggctggacccagcttctccttctaactaattttaaggattgttttgctgctctaggaacttactgtcatacagaggacaaccccaagcctccctagtccatcaaccccttttcctggatacaggggctgaatcccttgatggatttgatcacttacctcaatttaatattcctcctcctaaaaccacagtatcatccccagattcttatcactggtgtgactacctcttctgaagacatgagaaaagctccagtttcagaaggtatgcttggagaatgtgctgcttctagcttatccaatatggaaccaatttcttcactcatagctaaagcatatcctttcctcacagcttatcatagagtggccaggtttaaatgagtcaatacaaataagactgctggaaaagtgcctggcacagagaaagcattcaatatatatcagcttttaaaaatgctgaagatcaatttgaatatatatgtatatataaagagatataaataggatcacacgtaaggaactgattctacttttaggaaactacactaagaaaatactaatagattccgataaatatttatacataaagaacatcatcagagaattgtttgtaatagggcaaataaaaccttgaaacagcatacattttcaacaatagtggagtaagtaaataaattacggcactttttccaagtatgttttgaagaatttttgatgctatgagaaaatgataatgataagtgaagaaggatttaaaaccatttatgtaacatgatctcaattatacacactgtaaataagaatctatggaacaaatatctccataagaaaacattatgaagatatactccaaatgttatttgtgtttttttctaaataataatattctttattttttcagcacttttcaaattatactgaaatatattttcagcatacatacaatgagcatcccttaattctacaaaaagcaaaataaaatatgaaacagttaaaagtctattgcaacactataatttgaaggggaaaaaaaaggctaaggacctacagtaggccactgggcagacaaaggagatcattctgagcctgagtcctcagtatttggtgacccagtagagaggcaagagagggcataagctctaagctttccaccttgggcatagagatgaatgacggtgttatgaaccacaataggaaacgtaggaagaaaggaagaagaatgggttgggaggaaggaaaatacatttagtttggccttgctgagtctgtagtgcccaaagagtacccaggcaaagatgcccagtcgagagctggtgatgtgcaaagctaaaacttgtaggaagaaactgcagtaaaggtatgagggtgggcacagcagtgagtccttgaagccacgggcttcccttaggatgcccaagtgtcctaagtgttctaggaataagcgacagactctgatctcatggaggctcagacccctgggcttcagggctctattccttccacccctaaatgtgacctgaagtggcccctgcctccctcagtcctagaggctgctgctcaattacagtgaagaatctcttatagactcacggtgacttaaacgctatttggtgctgtggctgctatttcactgaagattacagggctctcagagttaaccacataaaacttgctgctatatatttgtaacctcctttttcaataacacatagggaaaccatcttgggtttcaggaccaaaaaagtgtgagtgcctggccaccaggaatgctataactgatcccgcttccctctttgatgtggccaaaaagaagctcagaaaaaaatctgtggcccatcttcagcagccttataagatcacatagtgtacatttttgggtgttaatattgacattcctatctttattgttttactgcccttattttctctttgtcccaagttcttcaactatgaatttttgccaactacttcaagttaaaaatgttcttccatgtcatgcccacccagtgattctgtttgtttctacctcttgaagttacacaaaataagtctagtctaccttctccacaacagcccttcaactctcatgtcatcctcccaatcttatttttataggcaccagagccccactttctttaacaattgctcgtggatatgagctcttaaagagtctttcctccatctagacttgactgatgctttatcttctctcgacctcttccctaaagcccctacgcagggcattcctccgctgcaacacagcaaccacttttaatagttgcttttcaagcttgcatcccccaccccaccatggggctggggactcctgaaaggagccacatgctgtctttgcctccaactagtacctagccagggggcctggggcataatacatgcttaataagtgtttgttgaggaagtgaataaatgaatgagcacatacctgtatacagtatacagcttcctcgctcatacacatgttaaagagagctaaagcctccgggaagggagaaaagagagggccctgttcagtccagttgtttgtggggctttccatctgacaactgttttccatggtctctcctgaacagcctcgaagcctcagccacctgggctggagcgtatctcacagctaaatccagagtaaatatacacaagacagaattggtcctatgaggacaactggggtgaatttccacagaaagaaaggatttcactgatcagaaatgtaagatgctagatgctccaattggtacttattctaacaacgctctcttctctaggttctaattacatgtcaggcattgttctgagctctttacaaatatcttatttaatcctcctaacaacctcataagataggcactatttttatccccattttattttcatatgaccctcttaacatttgaggcagctatcctaaaatgaagaaaggtgtagtgtttcagtctctgaataaaagaaaatgagctacattaggtccaatgtataaatggctgaagattgagtgccagcctttgatccaagatctggatctggcaggacacctcaccgctcactaacatttattgagcacccaccattgtgcccagggctaccctccatgagttcgctgacaggtggaggaagcacacacctggataaataaatcaccccgctgcagggcaagtgtattaggatcagggaggcagtacggtgctgagagcaagaaggagtaattatctctgactagatgagaaggcttcctggaggctgtgaagtctcagttccattttaatgaatggagcagcagagacagagcaggaggtgaggtgcaaaggtaccggcatccaaaagggcatttgggaactgttggtagcaggagaacgaaaagagaggaggaggtgggggatgagggatcatcactcaggtggtggccttggctgcaataccatgaagctgaaagtcactaacaggtattgtcatttctgttttagactctttgagcagctgtgtgcaggaggacagagagaccaagcagagagagaccagttaggaggctgctgtaataaaccaagcaagacacagtgtgcacgggaactaaggcacaggattctagggatatttaggaaacctgaagctttggactgatcgagaagctggcatagcagtgcaaggtgacaccccggcttctgacttagacaggagggcagccagtgaaatcagcaggctaggttggaagcaggcttccaggagtgagggcaagctgagactctctataagctcagaaaagccaaagagagcggcagaaattttcttcattatctcagaaaagttattcaaattcttgctcacacctccttttaataaaatatgatgcatttcattctgtcttcatagtgaaaaatcattgccctttgctgagaattaataaccttttgagttaataccctttgggtaggaaaattggtttcattaacacctccccttgcactttgtaggttcatcatctcttggtcctgctgtcccctgaaaccaaaagcccaagacatattatttgagaagcctgaatgattttattctcagaaagaatgatcagggtccttattaattgggctgaattgagttcactgaccaaaaaggtcagagcggccttgtgtctgctcctcagccgcaggggagcccaccttctaccagaaggaagggatgagagcttcctctcccagctcttggcctgatccctaatcttggcagaaaagatgcgcccatcttgacatgccacgccatggaaacgcgccaccttgccaggctctaccaggcctcttggcagaggtgtccgtctctggtgcagcaccacagacaggacagctgtcgggctgcctggcagagttggatggccactcacccacccctccaaagtggctcatggtcatagtgaggctcccccagaagagaggctggaaggcccttcggtcaaacaacagaaggtgatatgttaaaaacaatcttcctctccttttccacctcccacggccttggaaagcctccgaatggacattcctctactcttttctgttgcaaactctttagcagcagcctggcatctggagcatgaagcccagactcttcagcatcccagggccctccatgctctggcctgcctggccttgtctcctgcctctttatgtatgcaaggttgcatgcctgtgagcctcgactcatgttgctccctcagccacccctgacccccgcaacaaaacacacacacacactcaatcatcctgcaaggccagggtcaacatcacattccctgaaaagccctccctgaatgccacaccctccctcaagcggcatccactactccctctgtgattcccccaaccctgccccacactcacccctgtaccttgtccctgcaaggcttacctgatataatctgtctgcacgtgaggacaagttgagcctcaggagctaatacatagtgtcacccagctaagatgctctattcactgtctctctaggtagggatgtagggatgaaattggagacagcgacacctgggttcaaatcctgtctctatcagtttttggcagtgtgatttggggtgaggtgcttatccaccgagcctccaaaactgccttgcctatattccttatgacctagagggtgactctagtgcttgattggctggtcactgggataacaggctagaggatctggtgatctcaacctcctaggccaccctccatcacttggccattccactggaaacagtctttggggctccccacagttgtggctcattctgatctccagcatctcccagtaacctctttggcttgtgcttgtagaagcagcctttgagaagacggagggcttcagatgaagcagatgccaggctaagcaccgtccccaatcttatattgcagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtaggaaatgctgacatgccgtttttctctccgatttcacattttctttttttctttctagcgtgttcatgttcataaaaagatagggagctggtgataacaactccatgcataatgtttatgaagcacgttctaattttccaagtgcttccccacgcattagctcattgattatctcgattccatgagtaagcagcgtgagaaaatataattatctccatgtttcagatagaatgtggctcaaagaggtcacacagcccattggggcccacaagggattgcagtccgtgcaggaagaagcctccttcctgaatctgcatgttacacacagggggacataggaagccagaagaatggactcccaatgaaatgttgtatcagcaaggtttaagttcagcagcaaataacagagactcaaattagcagtggttcaaagaaaacagaaatttgttttcatttcgcaaaatattccaaagatatatgtaacccaaaaaccggctagacagctttggtcagtgaagtcctccaggccccagctccttccagttcactgctctgccatcttggggtgtgaccctcatcctcatagtccaagatggcagctagaggactagccatcacatctttattccaggaagcacaatgtagtaaaagatgtacacaaaggagtcaaaagcaaggtttttacaagagctttattgagatataatttacaaagcgtacaacttatccatttcaagtttacacaattcaatggcttttggtataaaagagtgttttttaggtgtcccagagcctctgtgaaattctcccagttacatccattgaccatatctaagtggaaaggtggctgagaagtataggctgttaaagaaaatgtagccttttagtgatgctaaaaattctattactatggaagaaggagagaaaggatattattggcaatagatgaagtcaaaccatgtgagaacttgtctccaagaggaaatcctgcctccccagtgtctagcccacccatgatttcaagcatagttcacaatttgaaccctccagagattttggtgtctacttcatgacttagaaacctttccctgccatctagttgaaaagtactcttgaaacccccatctatcctatcctggagaggaaaatgaacccttccatcacctgcctcccctcacctctccctgcctcccacatgacgttccagcaacatctaactgcttgtattaatagcttcctccacaccccatgcacctgccttctctcttcttggtcttggcttagtctgtgccctctgcctagagtgttctttctcctcctcttttcctgattaactcccacttttcctgtaagacacagtcccaaacaggtcctcctgcaagccattgctgccttcatcccagcactcccacagggcattcagtgtcaccgggagttcccgtgtggccctgagcactctccaccactgctctgcagctcggctttctaattgtctgtgtttctctgctctgctaggccgtaagcttctccctgggaaggattctgtcctattctcatctaatagactactgtgggccactatccattatgtaatcagtgctccaaaatgtttgttaactgaattaaagatcaaatgaatgagtcttgtttataaatgcaacatgaggaccacaggagcctcttaccaggatgcttttaccaaaatgcactcttcattatcaaaattctgtccaacctagtatatgtctcctcctcctattactgctaatattaataacaacaacaactgcagtaacgaacatttgttgagtccttactatgttccagacactgctctaagcgctttagatctattaacgtatttctccttcataacaatcctggaaggagagcattattaaccccattttccaggtgagaaaactgaagcacagagaaaaataacttgcccaaggttactcagctagaaactaggagagcctagatttgaacccaagatgctccatgcacatagaaggcacttggtaaatatctagtaaaggaatgcatcttaccctggaatggcatgacaggccctcaggggagctctccagcttcacccgctattgtcaagccttcacctcctattgtctagccttcacctcaccaactttcctcctctcccctgacataccacactgccctttcatgattctgtgactctgcacgcactgttccttctgcctgggatgccctagacctcaccactaccacattcacctgcccacctgtattctttttgtttctttgttttgttttgttgcgatagggtctcactctatcgcccaggctggagggcagtgtgatctcagctcactgcagactcgacctcctaggctcaagccatcctcccacctcagactctggagtagctggggctagaggcatgcaccatcacacctggctaacttttgtattttttgtggagatggggtttcaccatgttccccaggctggtcttaaactcctaggctcaagcaatccccctgccttggcctcccaaagtgctaggagtacaagcatgagccaccgcgcccagcccccacccatattcgtcttactggactcctattgatcctttaaggcccagcacaagtgtctttgctctgtaaatccattaggagtgccctgcaaattggttctcaaacaaggcacacacacagaacaattctctgtaaacattttttacctcctactatgtcaggctcacagtgcccatcccgctaagtccagcataacgcagtctgcagggcagagccagtgctatgggtttaggggtgaggtggggcagctgcacgcagaaggaggcgtacaaatggccctaagggacaggtcagcttccaggacctgatttacacatatttctccactgttttaaggtttagaaagtccctaagaggaaaaacattaagataattgttctcgggagggggcgggggggaacgtttggaaaaatctggagacatttttggttttcaaaacctggggcagtgggtgggtgttgctggcatctagttggtgaaggccaggaatgctgctaaacatcgtacaatgcccaagacagcccccacaacaaggaattctctggcccaaaatgtcaactgtgcatggctgagaaacgtcatagcaagcccttcctccagcattatccaggagctggagaaggaagaagggtgagcggggagaaaggaaactagtgcgaccctccctctgtcccctcctcaggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggtaccgacctgccccatccttccttcacctcccttccctcctttcccttcctctgagagtgaatgaattaagctggtctccaacagcagcccaggcaggagaagcactaatgctcagctcacaggaatgagaaggcacaggactgacaccagaccccagggctctctcagacgcctcccttgaacccctgtttcacagaaccaccttctcccctctcctcatccactattcctcttatgctcacccccttagacatgctaagggatacaaacacaccctgtaagctatcaagcccccacacaaatgagtgggatcacttctgtagggcattagtgtccaggggaagacaggcaggcaggaggctgcagctaccaggcgaggtcacaggtacctgagtcccaggagagtcagccagttgagagattagtttcagtttggagtgtgaataaggcacctcatttctgagcaggcacgaagaacagggtgggcgccacaacacactggaccgcaaaaggctttcatccaggcagctcttctcctgcccccatcccgctgctgtcttccaggaatctgtgcaactctctcgaagccatgttcacctaattgggtacagcctgggtgcacacgtgtcaggatttgccggcagttccatcggtggaacgcacaagattgggagaatcacaggtaaccatgcctaataactcacacactgatctccactccataggggcatccaacaaggacctgcttttccaacaggctcatcattaaaacaccccaacacttattgtgagggatcagcgctcatgagaggacttgtgacattctttcaaacatgaccaatgtcatggattgctgttccagagaattcagagcaaattatagcctcaattcctattgcctgccctcaaacgaatacctcatgttggtgtgccaaatgggactaaaagatggacttttctagcaagaaagagtcttattttttaatctataatttacaaagtccaatttgggcgagttaaggagtgaagaatcacagccttaatttgctgtaattcatcagccacgttagtgcctccgtttccacatttgtgaaacgtgtatgttttagtctgggacccatttgggttgagggagggagctctgcatccaaaacttcaccccaaactccatacacactcagaaatggcccaagatatccaggaaggtctgcacatgtgcgaggaaggccttcctcccaggcttccgtgacaccaaccccacccttcacactgccaggcattggatccaaaaacacacagctggtgagattgttccccagtccaagtctgaggcccactgataccacaggtataaaacccgggaggcacaggcaaggcctttctcggtgtggaagccccagagtgccccagcctctcctcctgctgatcccttcccatagctctaggcttcaacgacacaaggtttttctctacttcacaaacacaccatggcctcttgtgcctctgggcctttgcatgcactgtttgctttgcccaccactcagccactcaaactcctcctcatccttcaagacccagcaggctcaaacaatatttcacaggccaaaacaaagagcattttacatgaataacaaagttgttgcgaatttatattttatcaagtgaggacatttttttttcttttgagacggagtttcgctcttgttgcccaggctggtgtgcaatggcatgatgttaactcaccgcaacctctgcctcccgggttcaagcgattctcctgccttagcctcccgagtagctaagccacacccagctaatttttttgtatttttagtagatacggggtttcaccatattggtcaggctggtctcgaactcccaacctcaggtgatccaccatctcggcctcccaaagtgctgggattacagacgtgagccaccacggccggccatgaggacatttttacaaacaactactatctgctattaccattcctttataaaagaatttcttttaacttgagaaagaatggggataatggcagacgtttcaacagaatacacttgtgattatgacagctcatttcctcatgcttttttgttcatcttgctggtcactggggaagcctggtcacagaccggcgtgtggcccccatggatttaacccacaatagcctggggatgagcagccctcccactgaagaagcagggccagaggtcagagtccacacccagcgaggcagcctcaggcccaaggcccagaaccctctccatccaactggtgctgtgggtcacattaggcgtatcagctgggcccacccacctcagagacagcaggaaagctcaacaccctcttgccgtcttgtcatcagcctgataaagaaaggaacagaaatcatatcaggacatttttctttttctctttctttttttttttttttttttgagacagagtctcattctgttgcccaggctacagggcagtggcatgatcttggctcactgcagcctccacctccctggttcaagtgattctcctgcctcagcttcccaagtagctgggactacaggtgtccaccaccacgcccggctaatttttgtatttttagtagaaacggggttttgtcatgttgcccaggttggtctcgaactcctgacctcaggtgatctgccagactcagcctcccaaagtgctgggattaccaggcgtgagccaccgcacccggccaaggacatttttcatttgtcactgtgggtagggctggagaacgggtgatctcacggctcactctcaattccttcgccccccaagtagggaaggaaaccagggctggggtgggacaccagagggtcctccagagaaggcagaggaagaaagacagggaaaaaaaacttggagcgcataaatactccccaaccacagtcagccaggaggtgccaccttacttcatgcacagacatctgtcacttgaggcccagagctttgagctcccctacttgcacacaacattttcacatacagtgaaatgtcccgcggctgttctggacgttctaatgaaatgacatcttaggagaaaaatcagcttgtttagggaaattattgacaacatacaggcaaataaatttcattctttgataggtaggttggaactacttataatgagcatattggctttttttgtatgcaaacagatggtcttgaaagtagcttgagaggtactcaaaactgatttgctcaagtaaatcaagcattccctcataaccttattcctttttttttttctttttgagacaggatctccctctgttgcctagactgggtcacagtggtgcagtcatgattcgctgctacctcaaactcctgggctcaagcaaccctcctgccacagcctcctgagtggctgaaactacaggcacaggccaccacatccacataatttttgtattcttttttattttagagatggggtttcactatgctgcccaggcctcctggcctcaggcatcataaccttgtgtctaccactggagagtttccgcaaacctctttccccgctagctaatgcccagcctgtgtgtcattgttagcaccatgaactactgtggttttactgagaaaaggttacggcgaggttttctagggaaggatcagccctacgtgtttcttcttcctgctagttcactgatgtataataatatccaaaagctaaaaagcacatctctcttcccctctccttgctcccgcgtaacccttacccctgctttcccattagggctggatgccgcgggacctttgtttgagggaagtgcccccagcaatcgtctttctccagatgatgccagttttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatggtgagaatgaagtcatgggccgggagcaccggcctacatttcaatggggcctctggaattcagcggaatctaccaacatacgggactcagggaagagttcagcaaggataggggcccagggtgtatggtcaccaagcccacccagagagaaggaatgctggagtgggcaagggtgcctgtcccccagcaggccactcctggcaacaggccaacgccacgccctgaggatgaacagagggcaccaacaggaacctccacttctcactccagccccatgtgcccaggcaaaccctctcccggggtaccagctcttctgagagttgagtccggatgcctgtggttattcttccttctctggaagtttcctcgttccagggaccgcctctattctgaaccacataaggatccacttaataggttgtggcttctcgatgaaggtctcactcttcatcccaccccatcagtttaattgaggaaattactcagactctcccaatgggaaattcagcttcaaatatgtccttgttatgccctttacctcagggcagacacggaatgtgctgttatctgggttgtgatcccacttctctctcaagtcctaaaaccgaaatattaacatgcacattgataatatgcacaggattaaagaacaaaaatgtcagcagaagcagcacattccacgggcattccaaatttcttgctattataaaatatcaccctgattaagacatgccaatcactccaagccaagtagagccctccacccctacaagccacctcaccctgatcatccaacactcagctgagaacacactctcttgtgatgacaccatcctcgcctctccaatatcagagtgaccttcacactccgcatcatctcattttggctggactcccagccttccaccgcccaggcctgagagagccttctgggaacttgcccttatcattgcttacatccctcccacctcccccactccaacacctcccctccagccaccagcagttcccagctgaccatccagccctcatcccaaacttcaccccacccaacaaagctcagtacagaccatcaggatggtgtatgggctttattttcctggtaaacacatttctgaccaatcattaccatttgctcttttgtgctaaacttcaaagtgacggaaccaaatgtaggtattcagcttgcccaagcttgggctggtttttctcagtcgtcttcacccctgtgtttgaaagggttcctggggtagttctcccagccacagctgcacaggggctcactggataactgcagattcaccttcactacctcctgggtggatgagcttgggtgagttagtggatgtcttggaagctcagttttctcgtcgaaaacagcggcctcaaggagctgcagtgaagatgcaggcagtggaggagcggagggcacgcagcatacacagcctcctagtaggtgcccaaggaatgcagccgctagcgtccaaggactgcagtgactaatcttggcatttagcctccagacaactggggaaatagcttttggcaaagtcacctgtgctgtccctttacagcaagtgtttcacatatcttgtggtggttcctcaacatcccttgagaattatttaccacagattaggttaaaatttggagagttaaaaaaaaaaggtcaaatccttagtagatcaacctcataagcttgttttgggggtgaggcctgtccagatctggttactgggcaatgtccttccaaatccaattcttgtgctggtttcacaggcctgttacctaagggatgcaatggctgctttgggacacaaggtagacattgtcgagaggcctcagcgttctccagaccatcagagtgccacgggattgtctcgtgtatctagttatattaagagaagaggagtcccacgcaagcctgttccagaaaacccaccctccaggcatcagcacctgggcattttaaattatctcatttgagatagaaatatttctataataaattacactaacctgctctcttaatgaatttgatctttccttagtgacttgggtgcctattaaaatgcctactgtaacacgctgtcataaaggagtgctctcaggatcccggcagtgcccgggattttgcctgacactacatgactcagagggtctacttcccttagtttcagtcagttgtcacatcctgctcttgtcaaggggtctgccttgacaagcccacccttgcctgttctgtgtgctactgctaacctcctgtgggctgagaaccaaggtgatcctctgagttgaggctgctttgggttaaggggtgataacgtccttcttgccctgtgttccagccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaaggtgagtgtggagctggggagccttcagaagggcaggatgcagtcccctgtccaaagggctcagaagtccccttggcttctttcctggaggtgcttcagctctgctgttgccgtgtttctgaaactgtgcaggctccagacagcaacgttgtcacagcccttctcctgtcccaagagtgtggccaccttgccgccaagggctaggaggagaaacctcgaccatttctgaaacgatccttgggttggcctctctgtccattttcatgctcccctagaatgttagatctgcaaggccacacgcagtttacctgggccacccggatctcactgtacagggacgtcaggcatctccaaacacatcctagaacccagttctttcatctctgttcacggcccccatgaaaaaactggattctagactgcatttcatttcttctaagatttgaatcagctgatctgataggacatgatattcaccctgaggcactcccaagacaagattcagcttccagtgtttcccagccagatttttaaccacagggcagaaagtgggcccagcagctctctggattgaatggaagattgtagaaagggctgtgaccacgtcttaggctgaggccagcagagaaatactccactgaaacctaaatcctcctggagggaacaagccgacatctgttgccattaacatttctgcctaatccctaaaacagctcgggagtgctttagcatctcactgtttcatcgcacagcctctccagtgctgggagaagaaatctgatgtgctgtttgactattaccaggcagatatttgtatctggagaatgtaaacaggccgtcaccaccactttgcttttagggagcattttacacaaaacattcgatgcagccatcagctccttgtggttctcccaacagccaggcgaggatggcagggctggttattatcccattctaaagaggaggaaagcaaaactcgcgtggggtgcccacagctgtgcagctgtaaggagacctggaacagggccacctgactctcagtcgtgagttcaaactcccaggcagcttatttttgaggcacaggatttctctgtgtatcggaacttttgctctccagtcaggtttccctcccttgagtcaagcaggtctaggaatgacagaaatttcttgtgggtgcgcacggcatctgaagagtagttggtgtgagggcaggatctttcgggccaaagggtccctccactggctgtcccttagggctggaggagatggcagcacgcaggtgagggaatttggaagtcctcctgcttcggggagctcctccgctgcaggctgccaattaaagactcatttgggtgaaccagctcctcttttaaatggcaatgccgcctggagtgattaagcctcttagataatcacatttcactggatctattttaatcatggaatgttcgcatcatgaggagcagttcaaccctgccgtttttcagatggggaaaccaaggcctaggcagggaaaattatttgtccagagacaaaaagctcttggcagacctggcatttagacctggggcctccaaagagtgagcagagtgatttttaaaaactcctaaacctgccgctggtctgtttatggggataagaggggtatggaagagaagggtgggggaattgctttctccttgaaatcacctgggaagaaaagaggtcatttttcatcttccagggctaaactgggcacttcatctgatttggcccagccctaggacatctactggggacttggagattgggaagggaagcatcaagagaaggaagaaggggaaacaagagcagtaggcatgaaccaggctgagcttctcccatttgccaacggccccactgcccgaccaccatgcactgctgatgtgaactcacaaggatccctttgttattaaggaagaccaaagaattgcattagggcatcattatctcacccaccagctaccaaaaccaacgtactcatccatccgtatattcttcaaacacagtcctaccctcagggggctcggtggagactaacccacgatgagttccttggagaccacatttgtgtctctttattaccgactacttatcttgctcctgggacatctagtgaggaggaggttaagggcaggactgactgaaactggtcaggaaccgaaagccccaggctggagggaggttccagtgccgagctgtggcttgtaccacaccctctccttttctttcttactttttttttttttttttttttttttttttgagaccaagtctcactctgtcgcccaggctggagtgcagtggcgtgatcttggctcactgcaacctccacctgcagggttcaagtgattctcctgcctcagcctcctaagtagctgggattaccagcgtgcaccaccacgcccagctaatttttgtatttttagtagagacggggtttcgccatgttggccaggctggtctcgaactcctgacctcaagtgatccacccgcctctgcctcccaaagtgctggaattacaggtgtgagctactgtgcccagcccataccctctccttttctgctcccccacaaattctccccagttctcctgcagcccctccagtgagcaaagtcctcacccgctcaacccagtttcacttgctagtggaaagtaacgtctctgtggtcacatcaagccaccctgggcatggctggaaagtgcactcatgcgagactcgcctgtttgaagcagctgctcatgggatactgctatctatataatgttatgttatccaatgtggtagccacaaaccatatgtggctatttaaatccaaatctaagttactttaaattaaatggaaccaaaaattcagtttgtcagttacacaagccacctttcaagtgctcaaatacgtggctgctgcatcagagaacacagaaataaaacatttccatcgccgcggagagttctactggtgatgctgggatgaagattttaatctaggccaccacagctacaccactccctgcccatcacaaccgtgatcataactgacttgggcccccaaagcctattccaccagccacctccagcattttgatgaatacatattacactcttaaaagagcagacttgcccaaccccggcctacagagaaaccacaatccccatttttcaaaaacatctaattgtacaatgtattttagtgcagggtctggttgggcaagataaacatcgcctcctgattgtagtttcacaaaggatgactaacttggcctgaattcctctggctcccaagatatttcgacaaaaccatcaaaggatctattttctacaactgtacaccagaactcgggtaaacactgcgagagtacagcagtagcaagagagaattgggaaacagtcgccgagtgaaacgaggcaatttatcgcccactttcattctcactctctcacaaggaacctttaccagtttgggagcctgtttttaagggagggggagggaaacggatctgtacggagtaaatcctgtttcgccagtgcctcctctcatttcatcctcagagcagtcagatgaggtaaccgggtggagaggagggaaggggccctcggggggcactctgcccgggcactgggctggatgtgttgtacacgttagctcatttcccatttgatcctcacagcaacccccagacagggagagacacacgcacacacagagacacggtcagggcaaagtcacacaatttgtgagcaggaagcgtcgcattgaatcccagcctttgctccttttactgcacttggcctcggcgtaggaccaaggccctcgactgagtgcctctccctcctgcggcattccagctgcatgtcccgcctcctcctctctgccctccttccacactccctcttccatatctcctccactcttctcctgtcttccccgtgctgcccttccccctcccccgccccctcacccacggccctgcactccaggctccctgggtcgggggtgaggggcacttgcttctgctgctcgccgcagccatgagagcacccttccttgctggtcggcgagatgacgagccaagctgtgactcgggcagtcggtctgtttttggcttctctcagctacttctttggaaggtttccactgacttcagggagagttccagaagaagcagggggtgtcgtagacagcacaggcttggggttgggataaggagtgtcaagaatcttggccttgctgccaaccacttatgtgaccttgacctaatgacaaaacctatgtgggcaccaaggaagaggtgtgaatagacatggggatgaaccactagcacgggacctgcaggtgggtctcaaaacctgccccggtcagttcagtgtggaggaaggaagtagatgacacccgattaacaccttctggaaggcaggcattttttcatcgccatcttatcacatttttacagcgacactacaagaaagttcctaacctgcattcacagatgaggaaatcgagccccagaaaggctatgtggtctccagatcacaaggaagcaggcatcagagaggactcaaaccctgggctctgtctatccgttgagggcccttattccacccacagcacaaagagctggcaacaggacgccagtcagcacaacagtcctggccgcacacacacactcccccatctccaccgctcgcaggcagcaacagacccccacagaaggggcaggcattggccaggcacggtggctcacacctgaagtcccaacactctgggaggccaaggtgggaggatctcttgagcccaggcgttccaaaccagctcgggcaacaaagcaagacgccatctctacaaaagaattaaaaattagccaggtagagtggtgcatgtctgtagtcccagctacttgggagactgcaggagggttgcttgagcctagaaggtcaaggctgcagtgagacatgatggtgccactgcactctagcctgggtgacagagtgagaccctgtttcaaaaaaattcaatttaattttaaaaagaaaggggcaagcatccagtctcgtgacatcagggcatcacttaaatgggactgtactgttaaaccaaaatgtggccacgaaaataccgacacatacaggtgttacatacaaaggctaacaaaatcactttccctttttcttcttcactcgcgcctgctctgagttaattcactttcattcagccttgccggcactggctgccttctttgggcagcaacaccctggacaacaccatcctgggcccctcaatcctatgatcttcagcttccctctgagttagaggcatttcgggtctaggaacaagccctctgggcttggagaaaacacaagaggtctcattcctaccatctccatgagagaaatccatacacggagggggaaaaaaaaaaagccctctttgatgtttgcaaagagagtcataatatctcccagagccaacatctaatgattcagaatcattgtttctgggaggcaaaaaatagaaagaaatatattctcttttcataaattcaataacctgatcttgtgaaaagaaaatgtaagttttttcttttttaaatggcaccagcagggtccacacagggttacaatccaggatttttcctagtgaggagactctccggaggcctcagatttctgctgtaaatggagtttccctgatcacattcgaggtcaatggactatttcatgcctttcatctttaagacctgaaataatttctcctgccagaacttgggagtatgttgtactggtctctttgcagtcacaggattaaaagcgttttccccaaatcattttttaacgtccttattaaacatgtcataaggtaaagtgggcaaaatcactcacacttttttccttaatctttgtaatagcatcattgtgctgggggtggcagggtagaatgataggcaaattgtcttttcttttcttcctttttttttttttaaagaaaaacacttacaaaaatccaaataagagtaaataattaggactgggtgtggcggctcacacctgtaatcctaacactttgggaggccaatgcaggaggattgtgtgagcccaggattttgagaccagcctgagcaacatacagacctcatctctacaaaagaggaggaggaagaagaagaaggaggaggaggaggaactagttctcagcaggaaccagttctcagcctgaaagactcatttatatttaaagttaatttcatttaaagatttctccaaaaaagggcagtcatgcaagattctccgtgcagacatggagtttctcaggagtgctcctgcaaactcaagggtgcctcagccatcagcgcaggttccgtccccagcccgttccctggtgagcctcagaaagcatgctggcttggctcttcacagcccacacaccttggcacgttccatcctcctgcagagatgctactctagggacacatgttgtagaaataggcaattctcattcataggatgtgcaagctaaaggggcctttgcatcctctaaagctgactcctgggttttacacaagcactttctcctaaaatcgtggaaccatagcatctcaaatgcagaaatcaatctcctcctactcacaatttaagaaaaagggaagaaaaagtgtatcgccaagacaagggcatgaaacattttccccggctcaggggccagacgtttaggggacaggagagcgtcctttgtggcagcgatagcccaggatggatgtcaaggggtcagagctggcaggcagtttgtcttggtggcttcattagaagcaggtgttgaaccacagcttttcttcaggggctgttggccatttgctttcaagggacagactcagcttgcagaacgaaaacagcaggcgatatagaaagagtcttttggaattagacacacctggctttgaatcctgctccactgaactatctggataactataggtctccaaacctccacttccttatttatattcaccaggataattaacactgtgtcggtctaggtctcagcagaaaacaggactccactggcctggatcagctgaagaaagcaagtgggactccttacaacagggtgggcagtgttaaggaaaccaacaaggactgaggcgactccctgcctctaacagcaggacagatggagccagggaagggactagctgtgggaaaaccagagccatggaggaggggctgctgataatcgtgggagggcagtggctgcacagtcaggctccagagcacgggggagcagagggaaaatgcccctgcctctctcttctccgccctgatctcctgctagtgcctctccctccagtggtcacacccaaccagaaaccaatcgacaagggagcccggcagatgcagcctaagggatcccatcctggggctcagagctgagcagtggagggcagagtggatgaggacagcaggggtagagggagcagatgggcactacccagcagggcatcattatttagcctgttatgaggagaaagatgatgtatgtaaaacacttagtatgtagcttaacacatagtaggatctcaacaaatgggagctattttatcatccttggtgtctttaatgcagttatatatgcatgttgttcttcactcagagagcctgtgaagtactccttggaggcctagtgtgtgctgtgcccttgtggagatacaagcagtagtgtggttccgagatggcctttggggagataagacatggacacagatgcccgtgagacaaggcagaggccacaaaggaccacaacttctagttctcttttttttccttttcaatacttgtaaaagctctttctttttccaataggattccaattagaatacacgtttactgcagaaaatgtgaaacttgcagaagaacataaagaagagaataaaaatgaccactctgccctctccagagataagcactgttaatatttttgtgaattcccctacttctatgcattctgttttgcagagttggtctcatactagacagtttcgtagcctgtgtttttttgtttttgttttctttttcacttctttcataagcattgaaatcattccaaaaatagcttttaatggcttcataagagtaaatcacatgtttgggacaatgaactgagaatcagcagactaacttctaattgcagcttcatcagttattagccacgtgacaacgacaagttacttaactttttctgagcctcagcttcttcctttgcaaaatgatgtgggagggaagataaagtaggcatcttataaagttgttgtaaagagaaatgagataattatatgaaactattagctcaatgtctgggacatagtgaagcgctaaatagtagttatcataattgctgttattagttcatagccatccctctattactgaatatttcaggtgttttcagtgtatttttacacaaatgttaggacattttttaactgaaatctctttccacaattcaactttttccttagaatatataaagctagtggtcctgggtataaacatgtaaaagttcaagttctggagtcaggttgtgtgagccgacgccccagccatatacgacttactagctgtgtgatccgagaaaagtcacttaacttctctgtccttcagtttcctcttctctaaaatgagataataatcgtatcatttgtttgagggtcaagtgagatgacagaagcaaagcacttggcaaaaaccaaaatagatattagccaatgttattatcatgcatactgccattatatgctcttttttttttttttttttttttttgagacgtagtcttgctctgtcacccaggctggagcgcagtggcgcgatctcagctcactgtaagctccacctcctgggttcacaccattctcctgcctcagcctccccagcagctgagactacaggcacccaccaccacgccccgctaattttttgtatttttagtagagaacggggtttcaccgtgttagccaggatggtctcgatctgttgacctcgtgatccgcccccctcagcctcccaaagtgctgggattacaggcgtgagccaccgcgcccggcctcattatatgcttttaattgcatttagcactgggctaaacacacagtagacttccaattaatacatatcatattaaactgaattgaagatcggttactatgagtgttccttgagaactctggaaggtaccctgactattcataaggaggttaacccaaggccagtcctcccacatcttaccccctcccccactttggaaagaactttctttttgtctcagtttgacttacaagactgttcatttgttacagagtttccttgacaaacccccaaatagtgtaagacctctccagaggcttctgggatgacaggctaagtccctctctccagtggtgccacccaagagtttagggacccttcccaggacttgcgcctatagctcttttctttttttttttttcttttttgagacagactcttgccctgtcaccaggctggagtgcagtggtgcaatctcagctcactgcaacctctgcctcctgggttcaagcaattctcctacctcagcctcccgagtagctgggactacaggcgcccaccaccacacccagctaatttttgtatttttagtagagacggggtttcaccatgttggccaggatggtctcaatctcttgaccttgtgatccacctgcctcggctcccaaagtgctgggattacaggtgcaagccaccgtgcccagccagctgttttcttacttctcacccacagcctcttttgctgtcttgagggcatcacattgctttattccaggcttgggatttgagcatctattgtattacagcaggggtccccaacccccgagctacagacagtgggcaattaggatccgggcctcacagccagaggcgagcagtgggcgagcaagcataaccgcctgagctccgcctgtcagagcagtggcaacataagatcctcatagcagcgcaaaccctattgtgaactgcacatgctagagatctaggttgcatgctccttatgagaatctaatgcctgatgatctgaggtggaacagtttcatcctgaagctatgccccctgcccccacactggtccatggaaaaactgtcttccatgaaacccatccctgatgcccaaaatgttggggactgctggtgtatagggtactgtagtaggcaccagatactacctgagctagctcttatctaaagcagaaaactcttggccaataaatcaactcttagtatttggctcttgttgtgaacataaataaacatttggtgcttcagagataacccctttagtaaacccaagagatatccccactcacatgagcaaattatatacaaaatcccaatgggaagattagtttatgccaaggataggattgtgtaatctagaaacttggcaatacaggcataccaggacactggagctggcagtaccctctgctgggcttgctgtatagctaccaacctccggtagaaatagtaccatttaggagttagtagattgattgatgaagagatgaatttccacatgctgggtacaagggatggatagtcaagtggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaatacgcagcaagtattccataaatcccttatccttttcccaaaccagacactcatcttgccacaagcctggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcaaaaaaaaaaaaaaaaaaaaaaacccaaaacaaaaacaaaagccaatcctggtctggaagctggaccctgcatccaaccctggggaatccactggggagaatatggagacaagagaaagaagtccaagcagtaatcagccattttggaatgaggtaggataattttcaaaacagctccatagctgtgccaccatgcaagctaagcaaacaccatctagggtgagggaagctaagagcacagatgctgctatttgaccttaagcaagtcactttcatctatctgagctccagttttcttatttataaaatgggggtgatactaacaatgcctacatcatagcgttgtgatgagtaaatgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagattttaggcccaagttctagaactacagttatcttatttccattaggaaatacacttattgaaactcacagagcttgtttccaggaactgccccggaatataaacgcttggtcactagggcatatatttcttggctggagctctgccccaccctgaaacacaccccatcagagagcagcaataatgtaaaatggcaatgtgttctctcttgccttgtcaaatgcctaaaaggcatatattctttgatttacgaaaggagaccctcaccaaacacatgaaatattacagcagaacttgcatctagaactcagtgagaatgccagatgtcctatactcctattctgccatcttttgttggtgaatatttatcattattacattacaaacacaatataagtcctgaatagacatttaggaaatacagagaaggaaaaacaagaagataaaccaccatttaggagcaaaaaaatgttgttaacatattaatatctatccaaactcttccctctgcatgtttaaattttaagaaataagagatttttaaatttaaaatcactgcttaaattatctctctctttctctctctgtctctctctctagtttatcattaccagttcaagatccagttcatcaaccaaactgagacaccaatacaaacaacttttaccatgtcactactcggaacaaaagagaaaatgcagaaaattcccatcactctgtgagtaggaggtgtagccccctagggtgatgacacacttatttttcttgcagaacataaatggactctgtaattttcaagagtcaggccagctacaactactttattccagacgcaaaccaaaaactatctgagacacatgtcaatcaatttagtttattttgccaaggttaaagacattatcgtgacacagcctcaggaggtcctggtgacctgtatccaaggtggtcaggctacagcttggctttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtctggattaagataaggggttgtggagaccaaggttcttattatgcagaagaagcctccaggtagcaggcttcagagacaattgattgtaaatgttacttatcagacttaaaaaggtgccagacttagttcattctctcccagatcagtgaaaagacctggatagggaagggaattctctacagaatgtagattttcccaccacaagacagctgttcagggccctttcaaaatatgtcaaagaaatatattttagggtaaaatagtttaatttctttcagggcctgctgtctgtcatgtgatgctatactagagtcaggctggaatttggtgtcttattgctacaaaaagtctgcttcatcagtcttaaaatctgggttttaatgttaatgctggtcagttgtgcctgaattccaaagggaggagagtataaagaggcgtgtcccacctccccttcccaccatggcttgaactttggaatgcccttggctgagaggaggggtccattcagatggttggagggcttagaattttatttttagtttacatgggcttgagcatttaagcaccaatcacatacagggcactgtggtaggcgccagatactacctgagctagctcttacctacagcagaaaactcttggtccacaagacaactcttagtgtttggttctttttgtgaacataaataaatatttggtgcttcagaaacaacccctttagtaaacacagcccatcccacatggccatcctggtcagacaggacatccacccaagcccgaaccctcaggtccctcctcagcctctccagttcccaccaactgctcaatgttatgcactgtgggctgagcagacagggaagccagagatggccccaccacggcctgcagtgcagaggcaggtggtgaggggcggagcaggtgttcccaagaggtcccaagagcctttccagtgagttcgtaacccagaaattcaagtggtatcttttgacttggcacagatttccaatttcaatcagcctgctctgccagcctccccatctgtccttcaccctgttacccacctgctcactctgaggctccccagcctctctggcctctcaaccctcagcatggactctccctggaaagtgacactagcccctcacccactccagagatgatcctgagcttcccgaaaattgcccccagctttggatctctgatcatcacactgattcagtcattcagcaagcatttgttgatgctctgtccaacacctacctaaggatacagaggaccctagcctctggatgctcacaacctggcagggcggggggattcctaaacaattcttcacagcatactcgggaagagctatgccaagccacacaagggacccccccccaaccccaccatccatctgcctcgccctaaatccactgctgcctctgcactgccaaaaatctctcccaggggatggttctcaatagtggaaagggcatctcgctgctctgtcaacgttgggatattttagtgtcttggagattagtgagtaaagctgatcatgatacctcagagtctgcatttaaatcttgctctaaatcggtgcatcctttttatgtgtagtttttctattactgttatgcctcactgttttaacagaggtttctatttatatggggggaggagcattacttgggagagagtgcatgctgcaggcatactatgttaaacctacagagagctgaactgtccagacgccgttgccaaagccccactgtctccacagcggcttcttcctagaagctaagctagagaaagttaactagatttgttatagtgggacttctcggagcctttttgatgtgttagccagaaaatagtatagttttcgcaattttattatctggaaatcccttttttatcctggcacacctactgctaactctatcaatagtctgttgaacactagtttgggaaatgcagcaaaaatcccaagtcattcagggaaacacaacacatcctgaatgtgtgtgaccgtcactttgctgttacgactaaactgattgtgtctgattttctttgtgtattcaaggggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaaggtgactgctgattcaatctcctattaacgtccattaagcacccacttgtgccaggcagtctcacaatttaatactcacattcatcatgtgaggtgagtattattaggccctagtgatggagtacagaagctcagaaaggtgaagtgactatcccaactttacatagccacaggtgccaggacaaggattcacacccaggtctttgaatacacaccagggtctccccactgcccgtggctaacgctgcctgcctctggagcctgaggaccaccacactaaccccaggcttctcaagcttcagtgcaggtgaatcaccaggtgatgtcagtgctgccagtccaaggtgctgtggtagatgcaacatcttttttttattgtttgcccaaagtaaatcttttaacagatcacaatatcaaaaatctcaatgtatctctctctctctctctctctctctctgtggtcgtatctttcaaatgtcagttgccaaagaatcactgggaagccaaacacatttgcagaattcctggacctacccgcagattcatggtgggcttgggaaggggtccaggatgcctgttgttgaataagagccctaagaaactccaatgtagaacaatgggtcacccataagaaatgctgctgtgtttgatttaacatctcccgtggccccaaagtctccagggatacgaaggagctggggtggggagcaaagaaaaggaaggacagagctgggcgtggtggctcacacctgtaatcccagcactttgggaggcctttggcgggcggatcacctgaggtcaggagttcaagaccagcctggccgacatggtgaaatcccgtctctacaaaaatacaaaaattagctgggcgtggtggcgcacactggtagtcccagctactcggggggctgaggcagaagaatcagttgaacccaggaggtggaggttgcagttagccaagatcgcggcattgcactccagcctggatgacagagagagagactccgtctcaaaaaataataataataatagaaaagaaaaggaaggatgctccagcgctcctgaagtcctcccagcagaagaaagggctgcccagcacaccctgccatagcaaccgtgcttttcggtcatccgtggttctccacggcagaattccaggcatccccgggccctctcctctctcttcccttctctattcaggaaacggtctctcctctcccaccttcacttgtcgcgaaggccatgtttctctttggcttgtcctcagagaggtggaaaacagcaggtttctaacctctgaactaccctcttccctcaccccctgggtttcactgccaggtgccggcctgtggcagatgtatgcccctgagtccctttatacaaccgcactctgagattttatctccctgggatgcaaaatcctggcaattactgagagcatactctgccgtctgccaacagatctcccaacaggatcaatctgggaagattaaactgctcgctcctcttctgcactgagctcttctcacatgactctttggcccattggagcagcgctgcttctgagctctgaccctgcccagatgctcttagctggagagtaattcctcagtttaggtggctgctcaccctgacaatcccatgtggcttgacctgaaagggtggctaaagcacaacactaccttctccactggggcacacccatgtggtacggaagaagaaatgaggagagggaggggcctggcccttccagggctcccacacggggtgagcattgaagcaggtgctccatggcattggtctcacgtgatctttgctgtgatcctgaaatgggtagtattggctgtgcagattaggaacctgaggctcacagaagttacacagcttgaggacattgctcaaaattgtcccagtccagatttgactgggatttgtctgatttattacccatttgttgggggtgtgctgtttccaacagttccttcttccattagttttggttccattaatctgaattttctcagtctaatctagcagagttgcagtgctggacattaacatatgtatgcatcaaacccatccttagggctgtaggaggtactgcatgcaggttatgggagctataattttttttaggttgtaaataccgagtgcctcctctgtgtctacacagtgccaggtactatcggagaatacaaaaaaaaaaaaaaaaatctgagttgtggctcttggtagaaataaactccaggacctaaccaggaaaataagatgaattaattttactaacggtgtggtccatcccagggcttctcaaactttcacgagcatacaaagcatctgggaatcatgttaaaatgcaggttctgctttagtgagtctggggtgagcctgatgttctgcatttctaacaagcgaccaggcaatgctgttgctgcaggtcaacagaccacactttgaatagtgagagtccagcattacacaacccgggaagtgtaagaagaaagttcagacccgtacacttggggctgtgctgcaacatgctttgaggaggccaagaggtgttcccagggagacaggcagccggcaaagcaatatggctggcaggatcggatggactccagtgtcagccagtcctaaactcacattttaacttcactgctcacaatctgtgtagcctcaaacaataacttcactcttcaagactcagttgtttagtgataaacgagaatcataatatacatttcatgagactaataacaactactaattttttagtgccttttgcagaccaaaatcccagaatcgggatgggaacattaaactctacactcgtaatatcgctgctaagtgcaagtgggaaaagaagtaggttaagtaacttgctctgtgcctccatggaagaaattcagtggaaggtggttttcttcccccaaaggcacaaaatcagggatgagtagggttgtggagatggtgaagagaaagagaagaaattattggccctacagcaagaccaagtataataactggctaaacctaatgagaagacattcaatttccacagtactcatataaatgcaaaataaaatcaaagaaattatcactggttactcattagtttggcaggaattcaaaaacggacaacacccagagttagtaaagatgtggagaaacgggcattctcatacactattagtgagagtgtaaattacaggcattttgtaggggaatttcattcaacaactaacgtttagtgagtacctaccttatgccagacaatgttgtggacaccagatgtataatagtgaacagacaggctgggctaaaatacaaaaaaattagccgggcgtggtggcgcatgcctataatcccagctactcgggaggctgaggcaaaggaatcgcttgaacccaggaggcagaggttgcggtgagctgagatcacaccactgcactccagcctggcgacagagcgagactccgtctcaaaaaaaataaaaaatatatatatatatatgtatatatgtgtgtgtgtgtatatatatatgtatatgtgtgtgtgtgtgtgtatatatatatacatatatatatacatatatatgtatatgtgtatatatatatatatgtatatgtatatatatatatgtatatgtatatatatatatagtgaacagacagagtccttggtctcatgaagtttacattatcacatgtttaaatatgcatactactttgagccagaattttatttctaggtgtcttatcatctttctggagtatctgtgcacataatcaaaatatgcacaaaggctatatatgaatacatatgtacagaatgtttgttgcagtactattaaataaatactatacataataagtaaatagtaaactcttgagaaaatcttaatgtctaacagtaggaaaatgcattgtggttcatccttaaaatggaatgtcatgaagcaggtgaaaaatagtgaaatagacttctacctactgatatgagcaagtctctgagtaccattttctggtaacaggaaaaattgcaggaaaacatacacaacatgatgccactcaatatatgtaaatgcataggaacaagtctggaaatgcataaaccaaatcataaatgtagagaggggagtgatgttagtgaaggccgatggtgaagaggttctttattatttggcttcatttattcctttaccatttgaattttcaagaatgcattcacaaattactcatagcatttttaaattttaaaagtccagtttagtgaagacttgaccttagacgcaattcaaagaaaaaagaagtaataaactagaatttttctacagatatatctatagatatatatttaacagatgcaattggaaataataacacaaaatggtatctcgggccaagccaacagccaaagcagtctagttgttgtttccaaaacacatagtggtgtcctctttagtggacaatgtcagctccaatatgaggaaggggcagggcttacagggctgagccaggcagaaaccgatgacactggcctcatgccaaggacctttaagaacagcatttacaaactggagcttgtccaaggagggaaggctgaggaggtaagcttgccttaggaggaagggttgaggaactagaaatgtttgccctgaagtcaaggcaaatgtggtcaaggaaacaatagtcaccctcaaatcttcgatgagctgtcataggggagaacaaaggagggctgccccaggactttccttcttacagaactgaaatcaccccagtgaagaactccaggaagtcttacactgatggctttcactgacttgggttttgtttttctctgaagttacaaaaatatttgcgaacataagaatctaacttaaaaaaagacatcacatgccttacacaaattgagtgaaatttgataaagaatgaaacacttcaataagctccacctaaaacttaatgctgtgtttgcttcctgttttctattcagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttatctggaatggctgccttatttagaagccaaaattacataaagaatctcacacaaagcttaaataaagtttagatttaaggggggtatgtttcactctcataaactgagcttttaaaaacgatatgatataactattttccagtatcagtacaaccaaaaatgtcccaattttatctctggttaaatgttaatatatgcaaataagtacaaatgcaagagccattttagatctgttgttctaatttacaatgtcttttataattaagtttcccacatgtccttgctagtttattatgacccatttttgaaccatgctagaaagatacttttttattaggtaactagtgcttcaataaagcaagattctaattaatcaccactagttgtgtataccaaatacacatcctttaagacaatacagttcttaaaagaagaaaaattataattattctaatatttatacaaatcatataacgatttcacagaaccaaacacttacaagtagaattctactaaaactacttgtgataacagtgaaagctagacacgtggtcattttaataatggaattacaaattaaataaacataattattatatcttactaatgcttgcaacaaaagctaattttaaaaacttggaatgtctcaaagcatttgctatggactgaatgtttgagtcaccccaaaattcatatgctgaaatctaatccccaatgtgatggtgtttggaggtggggcctttgggaggtgatcaggtcatgagggtggagccctcataagtgggattagtgcccttataggggataaaggatcagaactctctgccatgtgcggatatgagaaggcaactatatgcaaaccaggaagttgaccctcacctggaagtagactaccagatctgctggcacctttatcttggacttctcagcttccagaactgtgagaaataaatgtttcttgtttaagccatccagactatggtaatttgctatagaagcctgaactaactgagagagttagatgtcaaatttcaaactgtccaataagtgaaataataatgttttgaccagcaaattccatcacaaagcacatggtgacaatggacgctaaatatggtaatcagttagatatgtgttttacataattcagagaggaggaacatgttatgcacattaaacaagctaacctaacttgcacttaggctcagctatatacagaccataattcatattctcttcaccaaagcggggtaaactggggctcatgaaaacaaaaatcctggaaagatgtctgcctctgactaatcaatttaaaattatcttgcatgattcacttttatttccctttgaaagacctagaaatctaaaacttatggggtggtgggataggaagaacagctggtcaatgtttccaaatgaagcattctgtcctgaatgctaatcttacctgcaaaagtatttgaccctacttttagggaatgtgtgtgagtgtgtgtctaaaattgatagataataaaatgaacatttcccattatgtctaaaatactaaggtttacaataaaatgtttgcattggattgccaggttttatcattaatgatccagaaggaatttagaatatcacttttgaaaaacaacagggaaacactctttgctgtatatgcaacagagtccatgcatatgtattccaggagacatgtatgtgagccttgaaatcatcgcagccagaaacagcccaaatgtctgccagtacgatgcagaaatgaactgggttatagtcttgctaatggactgtcgtacaaccgtaagaaagataagccaaagctacacacacaaaagaacagagctggggccagcgtgaggcagcgagacatctagggagcaacatttaaggaagcactcatgcatttttcgtttgcacaaagacacaaaaaaaggtatagtatgatacaaacaatggataaacacctgtaatcccagcactttgggaggctgaggca

SEQ ID NO: 11778 - DNA, 10320 bp, Human
cacatatatgaggtacctaggatagatgaattcagagagacagaaagtaaaacagaagttaccagtggctgtgggtaggggtaaatggagaattctagtttaatgagttgagagtttcagtttgggatgatgaaaatcatcccatgatgtggtgatgatagcacaaccgtgtgaatgtacttaatgctactgagttgtgtgcttaataataatggtcaaaatggtaaattttatgtctattttaccacaatgaaaaactggaaaagtaaagtcaatgactataatatcataaagtgtaagtaacatgagagaaaataattcaggctaagaggatagagactgctaggtaggactattttagaataagtgatcaaggtactgatttctctgaaattggaatatttgaatagaagagaaagagctagctggcgatgcccgtaaggggtccaggcatggagacatcaaatgaagagtctgaggcaggaatggccttaatgcattaatggcagcaagaggtctatgtggtttcatggatgggtgtgtgcgtgcatgcacgtgtctgtgtgtatagttggtgtgcatgagcatgtgtatgcatttgtgagtatctttgtttttctgttggaaacaaggatgtcaacaggactaactaggtgaacctagctgtggtagttcagcaatgagatttgccaaaatggatggcaattgaaagaggaattgtgctgtattaaagcagacagctgccgagcactgtattggaggctcctaaatttctcatagttctgagaagagctgtttattaatctggagttgaaggccaggcccaggatatccttgttcacaaggttgattgggccctacattgctgagcccagcctcctccctcactctgaggcatctgccagagccccaggctagagggccagcgtccttgtcactgagtccctgctctgcagaaacaccagtaagtcatttctggtgaataaatctgggtttccggatcaagggtttggggagctgacatgaccctggaggcatggaggaggctttctaggggtggggggagtgggatggaaagcagaaatcaggttgaggatgtctctttttctgcttgtgctggagcatctgtgactttcctccattatctgttcatctgcagtggagactgtctttgttttcaaagggaaacttggaggcttagacctatggggctaggctgctgaggtttcttagggggcaatagctggaagaaagctctgaagaacaaatgaaaggttaatactgagaaatgggaggaggattcaaggcaagttttctaattgccagtggtttttgactcacagaacatggggaattcctgccagaaagtagagaggtatttagcactctgccagggccaacgtagtaagaaatttccagagaaaatgcttacccaggcaagcctgtctaaaacaccaaggggaagcaaactccagttaattctgggctgggttggtgactaaggttgaggttgatctgaggttgagaccttcctctttggatcaccagctttcagctcagggcctgccaatgagtaaatgatagttaacaggtcctggaggggaatcagctgcccagatacaaagatgggattcaggtggcagatggacccgaagaggacatggagagaaagaggaagctcctacagacacctgggtttccactcattctcattccctaagctaacaggcataagccagctggcaatgcacggtcccatttgttctcactgccacggaaagcatgtttatagtcttccagcagcaacgccaggtgtctaggcacagatgaacccctccttaggatccccactgctcatcatagtgcctacctttgttaaagtactagtcacgcagtgtcacaaggaatgtttacttttccaaatccccagctagaggccagggatgggtcatctatttctatatagcctgcacccagattgtaggacagagggcatgctcggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggtacgtgttgggctgttctgtctctgcaattctttaccttccagaggaaactgcctggggatatgaggagactgatgtcctatttgagtatatttttctcaactatactgtaactcaaaacagagattcagctctcattctctggcatctcagaattccacacagcagtttgtgactaatagttgtcttgccagcccaggaaagtggcccacaggtcaggccatcccgtgggacacaggatgaatttttcttctctgggtcattgtcatgtcagacccctattcacttcagtagggatggcaccaggttcaagaggccaaagaagagatggagtcagcaaacaaacataggttttactgggggaatctgtttacagggagatccagcagcagtgggctggacaggagaacaacaactactggtaaaaacaaatgcagttaattttcactttgcaccctccctgcagcaacctccacgtggcaactttatttcttaagttattgctctcaggtgcacaccatacagttattgagagcagtgctcagaaaggtcagtcctgggtcaaggtctcctttctcctgagaagggattgggcatcaaactcttgaagagagagagcaagaacatagatattaagtcacatttcctttgtcttccaacaggccaagggctcagaggcttacagggcccccctggaaagttggggcctccaggaaatccagggccttctgggtcaccaggaccaaagggccaaaaaggagaccctggaaaaagtccgggtaaggaccccagcaaggtctgagctgacttcacccagggttctgagaccttgagtatctggtaagaggtgccccttctcctgttccttcaaaggaagatacccaaatttgctttctgacccagtgccctcagccctctcttcattcttagagccttagggaattcctataagtgcctgagtacagacttacaaacttttcaagacaactccctcatcaggcactccctgtaagagctgagcctggattctccatcagctgaaacagtctaatgtgaggccctggtcctagagggagaaaacaggccatctaagtgtgggcttattatacctatttttacaaaagcatgtaaccatggtatgtcatattttacttcataagaaaccaagccaaagcttaatagcttaaaaacatagccgtcaatttaaatcacaagtctgtgggtcggccatgtgatttctctgctggtttaagctgggcttacccacatgtctgtggtcaactgatggccaatagtctcactcatgtgtctggctgttgtctgaatgttagctggagtgatgagggtaattgaaccacatctctcatcatccaacagggcttgttcacatagcagtgattacaggattcccaagagtagaaataagataggctttaggcttcttgaagactcagagcacattatcatttctgtcagactgtattggtcaaaacaagtcacaaggccagcccagattcaaggagtggggtaatagactcatgtcttaatgcgaggagctgtaccctattgaggccatttttgccatctactacaacaagtgatttgctcatgccctccccacttggataatgggcaactcacaaaaatcttggtttcctgactaacagaacaaacctggaaaaaacaaaaacaaaacaaaagacatcaaaagcaaaacctctccaaagacaaaaactctgcaatctttttcgtcactcttcaccaggtcataatagagtaacgcctcaagagatttctttttagttttgatagaacaatttatttgaaaaaaaaatctgtgaagaacctggcatatggattgctaggtaatcagggagtatatgtgtgcatgtgatatgtatgcgtactttgggatacagtaaacagacaaagagggacatttggggttggatggaaatagcgatttttcattctttgggcttttcagtattttttattttccttcaaagtgtaaacatcaatgtaaaataagctttttttttcagtttgaaaaagatactccactcccttgtatatgcacagttctgaggctccttctcaacaatgcttctttactttgttctaattttctagatggtgatagtagcctggctgcctcagaaagaaaagctctgcaaacagaaatggcacgtatcaaaaagtgtaagctttttctcttactctccaggcagcttgaagtttgggaaaaatagaatgcaacaaatatttgttgaatgcatataattttctgtaccctgctaggcatttctcatattcttacctcatgaaattctcacaacattttggtagaaatggaggcaaagggaagttaaattacttgttcaaatgcacagagctaataaatggcaggggtggtttatagatggaagtcagtctgactcgagagaccctaatcctttaccgtctgatattgctcactgaaaatgggacttatatccctttgttgcactggtattgagacctggccgtggggtctaacctgcctggggcaaatattttcagacattttttgtttggtctcaagttaacaatttagaattcagaagtccaaattatatgtcttttagaattctgatctgaaagcacagagaggcctttgtaccagtctgtctgttcacatttgggttgccatatttaacaaataaaaagacaaagcaccagttaaattggatttcagctgaaaaacatttttagtataagtgtgtctgaaaaattatatgggagatatactaaaatattcattgtttgtctgaaattcaaatttaactggacatactatattttatccggcaactctactctagaagactttttcttgagaaataccttgagttgggcttaaggatgagtgagtttcacccactttttcacattttagggctgaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgtttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttttgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatataggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactatagtccagctttgttcttcttaaagtcaagatttccatataaatattagaaacagcttctcaatttctacaaaatcctgatgaggtttctactgggaccacattgagtctatcaatcaacttatgcagaactggcaacttactactgaatctctaatcaatgttcatcatgtatcgcttcatgtaactagaatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaaactcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcacattttatcttgtgtatgtattattggagtggacttgttaatagtttgtttagaacgtttgcacctatgttcatgagagatactagctttttttcccctccttaatgcacttgctatggtttggggtcaatgttatgtaagcctcattaaaatgagctgtgatgtgctctcatgctccttattatctaaaataatttgtgtaaaattatactttaatgttagataaattcaccagtgaagccatcttggaatggtgttttctgttgggaaatgattttaatttcagatttaatttcctcatgatctaaacctattcatgttttctgtcttttgttcggtttcagtgagttatatttttcaatgaatgtgtcaatttcctctgaatatatatgtattggcataaaattgttacaatatctttgtatttcttttcaatataagtaggatctatagcaatgtctatgtatctgttatgattatttgcattttatctttattttattgtatttttttttgagatggagtctcactctgtcacccaggctggagtggctggagtacagtggcacgatcttggctcactgcaatctctgcctcccaggttcaagagattctcctgcctcagcctcccaggtagctgggattacagatgcccaccaccattcctggctaatttttttaattttttgtggagacgaggtttcgccatgctggctaggctggtctcaaacccctgacctgaggtgatctacctgcctcagcctcccaaagtgctgggattacaggcatgagccactgtgcttggcccatctctttttttcttaatcaatcttgcaaaggatttgtccattttattaaatttttccaaaaacttctttttggtgtttactaacctctatgattacatttatttatatctgttcctgtctttatcatttcttgtatcgatcttctgtgggtttaattggccattctttttctagcttcttttaattgacatttagagaactgattttcttccttccttctttgctaatataatcatttaaagttataatttttatttaagaactatttcagctgcataccacaggtttggatatgtatcttttcccaccaattcaaaataggtttttcatatccaattcaaaatattttataattttcattgtgacttcttcgactcatggtttatttataagtgtgtggtttaattcctaaatatttgagtattttaaaaagctatactcctgtaagtgatttatagtttaattccactgtatccagaaatatacttttatatgagttcaatcttttgaaatttgttaagattttattttatgatccagtttatgatttagaatggtaaatgtattatgtgcactagaaataatgtggtttttacagttgattagtgtatcattaggtcaggatatgaatcttctttgtattttctgtattctcactaatattttgcccttttagaaggaaataacaaagatcagaatagaaataaatgacatagagagtagaaaagcaaatagatcaatgaaactcaaaagttaatttttgtgaaatgatacaatttccaaactttagctaaaataactaagaaaaatacagagaagactcaaaatcagaaatgagaggagacacgacaactgataacatacaagtacaaaggatcataagagctacattcctttgtgttacattgttttctctttacattctgattgtctctcgcttgctcgctgtcttcttttaaagttttgtttcagaagaactaaaaaaatctaggtttaaaatgtacagatatcctttgtaacttagcattaggcaaaattgtcttagagaactcaattacttttcaagtaaaaaatgataaattgaatttcatcaaaattaaagattaactcagtttgttaaacattaggaaaacaggcaaaccatgactaggagaaaaatatttgcaaatattggcctgcatctgtcaaagga

SEQ ID NO: 11779 - DNA, 18595 bp, Human
actgcatgtttgttgtcagctatgaaaacaatgcaaaaacaccaaatactctgtgaaataggaaacaggtggaccagctggacagtaagttaaattcaaccaaccagaactcatcaaagccttgaatcccaggctgggcacacacagaggagctcacacccagagctgggtgttcagctaggcgtcgcaatgttgtgactgacctgtggaagtgacccatcctggacctcagtggtcagctggaaatgtgacatccatgggtagtcattaacagtaaaatcacaaattattgtcatgcaggagacgatgttgtgaagtggtttgacgtttggatcttggctctaggcaagtcactaagctacagattcttggctgcacagggggatgataaacgcagccctgcagggtgctgcagagattctaggaggaagtgtttataaagctagtggtggctggtgccgaggaagtgctggtgaagggtaaattgcattattaacaaaacttctggccgggcgcagtggctcacacctgtaatcccagcactttgggaggccaaagcgagtggatcgcttgagatcaggagttcaagaccagcctgcgcaacatagtgagaccctgtctctataaaaaatacaaaaattggccagatgtggtggaatgcacctgtagtctcagctacttgggaggctgaggttggagggttgctcaagcccaggaggcagaagttgcagtgagccaagatcccactactgcactccagcctgagtgactgagcaagaccctatctaaaaataaaaaaattagggtatgcaacggtcagaagtaggtaagtgaggagtcagttcaccctacatgtaatttttcatttatttattttttttgagacaaagtcccgctctgtcgcccaagctggagtacaatggcgcaacctcggctcactgcaacatctgcctcccatgttcaagtgattctcctgcctcagcctcctgagtagctgggagtacaggtgcgtgccaccatgcctggctaatttttgtatttttagtagagatggggttttaccgtgttggccaggctggtcttgtactcccaacctgaggtgatccacccacctcggcctcccaaagtgctgggattacaggcgttagccactgtgccctgcccccaacatgtaacttctgttagcttcaaagccacctctggggccctgcaccacatatgagctgaaggacacccgtgccttttcacccgtgtagctccagcatcttggcacactgtctagaatgttcaatgaatgtgcacggaagagcattctggctccagggagcgaggactgagtcagctctgggaacagatgagtcaggctggtggtccaggcattgcttttcaagtccttcatgtggctggaagaaccagtcaactggaaccggatcaacaggggtgatggcatggcaagagttatctcctggcagtgcccttctggcctcacttgccttcttgggccaggaaaggcaaagctcacaggactgtattcagtgcccaccccttcccccgtcctgtgccattggctctggaaggtccctgaaaccccgagtctggaggagaacagttgaccagcagggcgggccctcagcatagtcctctctgttcccactcacccgctctgccagccccagatcctggcaggaaggaagattggagggggtgtctggaatccaatcccagaccttcccttgcagacttgcccatctgtctgtggtctagtgtggaggcgaggtccagggtttgggaggggtgtgggggcacatgtctgccaaggcatggagccctcccagctggaaaatcctctgaacctgtaagaagagaacacagccggcatggacacacccttacccttagtctcagttcccaccaagacacagagcatttcctgtgccttttccgctatttcacaacctgccttttcttgctcaccaaggacagaggcttcttttcctaccagaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggtaagcgggcccaggcctcctcctcatccagtgctgagtgctggctgctttgtgggaaaggggaccaggagctcagagcagctcactctgacctggggattgggagtctcaggtctaccaaaatccagatgactttagttcaggaacgtccctttcttcactctggcctttggaactgggttagtaaacttccttcaggctcctaatgggttttttaagaagcaggtcagggtcacgaaaggcaggagctggaacacctgttctttgagacttcttcactacatttatgattaatactcatgtcagacaaacatctctaggttagcaaaaagggattgctatgcaatcatatgaacggggttggtatagaatcttctcagtgctgttcaccatgttggccaggctggtctcgaactcctgacctcaagtgatcctcccgcctcagcctcccaaagtgctgggatttcagacataggccaccgtgcccggcttatttttatttttaaagcgtataatctgggttttgctgacctgtgtaagatcttatttgaaacagttgtcctgcttaaaacgtttgaaaagtactatttgagaaatataggctaggcatggtggctcacacttataaataatctcagcactttgggaggctaaggtgggtggattgctagagctcaggagtttgagaccagcttgggcaacatggtgaaaccctgtctctaccaaaaatacaaaaaaatgagccaggcgtggtagcacacacctgtattttcagctattgaaaaaacagaaaacaggctgaggtgagaggattgcttgagcctgggaggcagaggttgcagtgagctgagatcacatcagggcaacagagcaagatcctgtctcaaaaaataaaataagagagagagaaatacatagcaacatcaagcatgttcttactgaatggtaattgactgccattgtctagtctaggaagtcctgaacttttgtttttgagatggagtcttgctctgtcactcaggctggagtgcagtggcccgatctcagctcactgcaacctccacatcccgggctcaagcgattctcatgcctcagcctcccgagtagctgggactacaggtgcgcaccaccgcgtctggctgagtttcttatttttagtaggaacggggttttgccatgttggccaggctggtctcgaactcctgacctcaaatgatcctcccaccttggcctctggagaagctgggattacaggcatgcgccaccacgctcagcttatttttgtatttttagtagagacggggtttcaccctgttggtcttgaactcctgatctcaggtgatcctcccgcctcggcctcccagagtgccgggaatacaggcatgagccaccgcgcccggcccgttgttttcctcaatttctaaactttaatatccaaggggattctctctcctctgccctgaatcttgggccctaaacgtgggacagcttcatcattttgcatctggttgtccttccagaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcatcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggtaaattgtgttctttcctactttatatcggctgcagagaaagaatggctggccgggcacgatagctcatgcctgtaatcccagcgctttgggaggccagggcgggaggattgctggaggccaagactttgagaccagcctggtgaatgtagtgagacccccgccatctctataaacgaaattaaaaaaataaaaacccaaaggttgggcagggcgtggtagctctcgcctgtaatcccagagctttgagaggcctgcacgggaggatctcttgaccccaggagttccatactagcctaggcaacacagtgagaccccatctctacaaaatacaatagtggcacgcgcctgtagtcccagctgctcgggttcacttgagcagacggagttccaggctacagtgagctgagatcatgccactgcacaccagcctgagcaacgtagccagactccacttctacaaaactaaaaaaaaaattagctgggtatggtggcacacgcctgtaattctagccactcaggaagctgaggcaggaggattgcttgagccagggagttccaggctgcagtgagctgaggatgtgccactgcactccggcctgggcaacagagcaagaccctgtctcttaaacattttggggggaaaaaaaaagaaagaaagaatgtccgattgaaaaaggcaatcaggtgttatcagtggccaaagaatggagaaggggagctcacctctgcaggcgtctgcttgccagggatgggaggcagggcgattttagagtccagggaggggaagggagataggtaagcaggcccagggcagggttccatatgtgcaggcgctgtccccagcatgcttcttcctacatcgcatggacacaaaaccctggccatcttcttttaggggagggacctttagccttataacaatgtgtaaatgatcttaaggtaactggaagtcacctcttccagtttgcactggttttgctctgatcttaacttcctctggtttttggcaagggatcaggaggctccaggccatctggatttttttaagcagctgtccctataggtaaagagactaaaaaaaaactgtaaaagaaaaatgccaccagtttagagggtaccgaggctatccaggtgacaattccatgctcgtggtgggggcagcattcagaaacacactttcctttttttttttttttttttttttgagacagagtctcagtctgtctcccatgctggagtgcagtagtgtgagcacagtttactgcagcctcaacctcctaggctcaagcgatcctcccacctcagccttccaagtagctgagactataggtgctcaccaccacacctggttaattttttttttttttttgtattttttgtagttacgaggactgtctatgttgcccaggctggttttgaactcttgggctcaagcgatcccccgccttagcctctaaaagtgctaggatttcaggtgtgagtcactacacccagcctatggaacacactttccaatgcattgttggctggagaggagaaatcacagcactcaaggaggagaaatagaattgggggtccaggccgggtgcggtggctcatacctgtaatcccagcactttgggaggccaatgggggcggatcacctgaggtgaggagttcgagaccagcctgccaacatggtgaaacgccatctctactaaaaatactaaatttgctgggcgtggtggcgggtgtccataatcccagctactcagaaggcttcgaggcaggagaattgcttgaaccgaggaggcagaggttgcagtgagccaagatcatgccactgcactctagcctgggtgacaagagcaaaactctgtctcaaaaaaaaaaaaaaaaaagaattgggagtccagggacccctgagacctgggaggggaaaggatgtggtatgctgcatgagtcttcaaatccagaagtccctgggtcttccagtgagaaaggaccctgggatctggaaaacctagcatccttaggaatagtgacctgaaaagtactgaagtatttcccccctaattttcttttatccctactgtattttttttaattttttttttttttagatatggggtcttgctatgttgcccaggttggtctcgaactcctgatctcaaacaatcctcccatctttgcctccgaaactgctgggattacaggtgtgcaccactgcaccaggtccccactgtatttatatcattgggattcctgggtgtctcctagggccgcttcgttaatctgatgcaggcttagaccctgaaaaatgcatatatgcacagcttcacaaatgtcacatcaaatttcaggtagttcttggacactctgaagaccatctttagaatccaaggggtttatggataccaggtagaaaatctggggaagactggttaaaaatactccctctcacaataacctcacagcaatgcatcatcatggggttgagattctaccatttgcctttctctcagcagaaagaaaagcctattggctaaagtcctaactatctactgctgaggtagtcattaaaattatgtttggttgtgaataatagaaacacccaaataacagtaacctcaacagaaaagaagtttgtgcctccttcacataaatgatacacaggcggtcccaggcagatccgtgggccaggaccctggggtcctgctgttgctctgtcccaccaagtttgtcctcaagcttctgctctcagaaggtgacgtcctcatgccaggcagcaagatggaggaacagaggggaatagtatccctcgggaaagctctagaagtttctagaagctgcttgtgacacctccatttacatccctttggtcatattattgtcaaatagccacacctaactgcaaaggaggctgagaaatgcagggcatttggggggcaatgggaggcagggaaacagggaaacgtggacaattaattctatcacgagagaaggagggagaataatttctggtgactactagcagtctcatttacagatgtgctgtgaatttctgggacactgtgaggtgggaggaggtagcaggggctaaaggattgagtgtgtttctatttctttttttttttttttttttttttgagatggagtctctcttggtcacccagactggagtgcagtggcgcaacttcagctcactgcaaactccgcctcccgggttcaagcaattctcctgcctcagcctcccgagtagctgggattacaggtgcccaccaccacgtccggctaatttttgtatttttagtagagacagggtttcaccatcttggccaggctggtcttgaactcctgacctcatgacccacccgcctcggcctcccaaagtgctgggattacaggcgtgagccactgcgctcggccttgtgtttctatttcttcttgtatctcgtggcatgtctgcttatgaagttgcaattagagtcttggagtagagctattcataactgttaggtcttcatgatgagttccagtctttagccctataatgccccccttctttgctttttcttttaagatggcatcttactctgttgcccaggctggagtgcagtggtgcagcatcaacctcctaggttcaagcaatcctcctgtctcagcctcccaagtagctgggattagaggtgtgcaccaccacacctggctaattttttaattttttgtagaggtgggctcttgccatgttgcccaggctggtctcaaactcctgagcttaagcagtcctcccaccttggcctcccaaagcactgggattataggcatgagccaccacccagccccttctttgctttcatttaatggttattgaactcatatgtgagcagtggtctatttattccttcattcaatactcattttccaaatgcttgcatttgccaggtactctgctaggggctgggatccagctaggagcgaggtacacaagtcaccatcccctggaagcctccactcacgttatgggcagccagggatgggttcaagtggcaaaggaacactggtcagaatgtctctttccttggcatcacctgctagatctatgtctgtgcaggaggaacagcacaaggccatgggtctttctttaggataaatgcccaagaattccaaggctcaggaatgtctgaggtctggcccttagctctcaggcccagtggcctgtttgcttcctcactggatggaagtcgggggaggacaagctaggaagtgggcagagtctaactgagaactcgcacatctcaggcaagggctgtgtccgctgtgctttgtgatacctctgtgtaagcaacttgggtttgccattcagggggtttttccactgcatgtccccaggaaggccaccagacacggctgcgagtccccgttgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaaggtaggcactccctgcctgtgggctcttctctgccaggcacttggacacactgggccttacttcattttcccaacaactctgggttgttggtgcattaaccagcattcttgggctggaaatggcaagaacacaatataaaccagtccagcaaagaggggagctacaggtttatgttgctcagagatccagggggagctggcttcaggtatggctgaatccagaggctcagaggaagtgcctctcagctctgctgcctttggcaattcagccattcctccctcctctttcctgagcacccctccccatgccgctggcagcagcaccctcagccttgctaccagaaggagatgttcccctccagagttggcaccagctaaagatggcaggagccaaattcaagcttttcaacaagtgctgtttttccagaagaaaattcagaagcagctggagcatctgaagaagctgagaaaatcaggggaggagcagcgatcctatggggaggagaaggcagtgagctttctggtaaggtcagaggtggctgatggcccatccgtccctgggaggagggtgggaagagtgagcaggggtccccgagattctgctgtggttcacagggcagcagggatggccacctcctctcaggggacagagggtaaccagcagccaagggtaagctcatccctgtagagggagaccacccccagcaggcaggggtcacctctgaggatcctgtcatgctttctcatactcaccagaagatggtagagagcaacctatgccggtgactattgcagaaagatgggattgaggaaaagggaggagaacgccactttctttttttgtgacggagtctcgctctgtcacccaggttgtagtgcagtggtgtgatcttggctcactgcaacctctgcctcccgggttcaagcgattctcctgcctcagcctcctgagtagctgggattataggtgagtgccaccatgcctggctaatttttgtagttttagtagagatggggtttcaccatgttggtcaggctgttctcgaactcctgaactcgtgatccgcccgccttggcctcccaaagtactgggattacagatgtgagccactgcgcccggccaagaacacttttaacttcataatttactctctgtttttttgttttgtttccaagatggagtctcgctctgtcacccaggctggagtacagtggcacgatcttggcttgctccaacctccacctccgaggttcaagcaattctcctgcctcagcctccttagtggctggaattacaggcgcctgccaccgcgcctggctaatttttgtatttttagtagagacgggatttcaccgtgttggccaggctggtctcaaactcctgacctcaggtgatccacctgcctcggcctcccaaagtgctgggattacaggtgtgagccatcgtgcctgggctggtttttttgttttttagggttttttttttttttttttgagatggaatctcactccgtcgtccaggctggggtgcagtggtgcaatctcggctcactgcaaaccttcgcctccccagtttaagcaattctcctgcctcagcctcccgagttgctgggactgtaggcacatgccaccactcctggctaatttttgtatttttagtaaagacagagtttccccatgttggccaggctggtctcgaactcctgatctcaagtgatctgcccaactcagcctcccaaagtgctgggattacagacatgagccaatgcacccagcccaaatttccccattttataagacaacatttatattggattagggacccacccaatcccagtaggaccacatcttaactaattacatctgcaagaactcttatctccaaataagatcacatgctgagtactgggggttagggcttcaacgtgtaaattttggaagggacacagttaaaccttaacaccaggtttaaggacattttcccagagctagccccagccatgctcagtcttttctggaaggttccagacaatatcgcctcctgctctggaatctaggccttgaagaggcagcataagcccacctcttatccacctccaggaggtgggcttctgggggttcctggacatccacgtccacccacagcacagacccccatacctccctgtcctctgctccccagaaacaaactgaagcgctgaagcagcgggtgcagaggaagctggagcaggtgtactacttcctggaacagcaggagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggtgggtgtgcctgggcccggctttcttgggtcccctgtgcctatcaggatgcctcaggctcccagctctgccatcagccgtgctggaacaagtgggtgaagcccctaaggcctaggataggacttggtcttggtgacccacagtgcctcttgtgcccagacccctttgatgaggtctctcaggagcccagggtggcctggtatccaggggatctctgccatttcccagaagggatcagcagggcttgagggccgttccattgcaggcctcgccacctgggatgcctgaattcccgtggttagaattagacttgaagaaaggtgctccacttccactgacaccctagggcagggagccctggtaagtgcagcggggagctaaaagtccaggagcccagaagtagaggccaggagtcagcccagccactaggagcctggtaaccgacagtttccttcttttttctcctaggacattggagacatcttgcacaggtacagcgaggtcctgtggtgtaccctggggtgtcttgcagaaagcatatgggggagacagtcccagaagggacctgggagggagatgttcccaaccccggggtctgtgattccagactcctccttttttctgcagcttcccaaagcctctctggatttgatagggagaagggcatctggtcagcagggaggctggccgggtatggagctgcagactgggaagggtgaattcagcccatcctgctgaaacaagatggaggctccctaagaaaccttccgagtgcattgtgtcccgtgcagttcatctgatgaaagctgccccttcaggcctactggtggccttgggaagcttgtttggagtggagctgggctaagcccagcaggaaggggaggggagggaagggacaggaagaggctaagccttaaaatcacctgggagctttacaaaatcccggtgtccttttgtgtctggcttcttcacttagcataatgtcttcgggcttcatccgtgttgtaacgtgtatcagaatttattttctttttatggctgaatcatagtccagtgtgtgttcatacattttgcttatccattcatggatatcgggacttcttctaacttttggtttgtgaataatgttgctatgaacaagggtgtacaaatatctgcttgagaccctgctttgttattttgggtacctacccagaagtggaactgcgggaccatgtggttatcctgtgtttaattttttttgaggaaccaccatcctaattctcacaggggctgcatcgcttcacattcccaccagcagcgcacaggggctccagtttctccacatctttgccatcacttattttcttctgtttcactctctctctctctctttttttttgaagacagcgtcttgctctgtcatccaggctggagtgcagtggcgcgatcttggctcactacaacctctgcctcccaggttcaagggattctcccacctcagcctccctagtagctgggactacaggagcgtgccaccatgcccagctaatttttttggtagacagggtttcaccatattagccaggctggtctcaaactcctgacctcaagtgatccacccaccttggcctcccaaagcactgggattacaggcgtgagccaccgtgcccagccatttctctttccttccttccctccctccctcccttccttcctttcttccttccttcctttcttttcttcttgagacaaggtctcactcccatcactaaggctggagagcagtggcacagtcacggctcactgcaggctcaacttcctgggctcgggtgattctgagtagctggcatcctgagtagctgggactacaggcatgtgctaccacttccggctacttttttgtatttttaatagagacagggtttcgccatgttgcccaagctggacttgaactcctgggctcaagcgatcccactgccccggcctcctgaagtgctaggattacaggcatgagccaccatacctggtctatttttttctgttgttgctgtttttataatagccattctaatggatgtgaagggatattttgttgtgtgtgtttttttttcatttattatctttttatttcaatagaaagaaaggggtgtataatcaatttgacatagataattctagtagataatatcaatgtcattttaagtccattctgaaaactccttgtggttttgatatccatgtctttaaagcaccccagtacatgacagtctgtggccaaagttgaggaccagcatttagacctctgaatccagggaagacttttctttgtgtagctcaggctgggctaggtgtgccctgtggagaatgtagttcatttccagctcacgggtacttgggccaccccctcgctccggccttctctggtcaacagtcttttgtctctagggctaagacagtgcctgtccctgaaaagtggaccactcctcaagagataaaacaaaagatccaactcctccaccagaagtcagagtttgtggagaagagcacaaagtacttctcaggtagatgggcttgggagaagattggaggtgcatgctcacttcctccctaagatccacatagcccagagcccctcacttccctcctcttcccctggtcttgctgacctgccttcaacctctcctccatctgtccctggctgagggacctaactccagcttctctctgctccctttcccacattttagaaaccctgcgttcagaaatggaaatgttcaatggtgagtccagcggtaatggtgtgtgctggcctggggttgttgcagtgttcccttgtgctgttgacttgaggggccctatttagaagacaaaaaaaaaaaccaaacacctggagcaaaggtaggagaaaggtcatggcaggccccccaggctctgtgcgtgactcattgactgagttgactcattagaccacagtccccaacatggcctgggttcctgggaggaacgggattatacccaacatagcatgcagggccctaagcagggggttccttgtctttccttgttgtcaggacagtgtaatttagcccctcttaatgctaatgctcaggatttttttccctatctgatttttctccgtagttccggagctgattggcgctcaggcacatgctggtaagtgcccagatcaaggcaagtggccctggcctgctggatccctgtgctctcccctaccacgttccagaagaactaccctgtccctgtttcctgcaggtggggagaaccctgtagggatgttgcccatggacccctacctaggtattcaaattttctttgcagttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatctggtcatttgcatttgtcactcaatcactgtggaatcccatttcccgactgcatttcaggaagcagatgggactactgtatggaaaaacatttggcatgtattccaagtgtcagattattctgtcttggtttgtatgggaaaatctgcgggttgtggaatattaggttctacttcacacacatcccgtgcatttgtccttcatttaaagagatgtaaaggggccgggcatggtgactcacatctgtaatctcagcattttgggaggcaaaggcgggtggatcgcctgagcccagggattgagaccagctgggcaatgtggcgaaaacccgtctctacaaaaaatacaaaaattagccatagggatgggggtgggaggatggcttgagcgcaggagatcgaggctgcagcagtgaactgagactgcactacggcaatccagcctgggcaacagagtgagtccctgtctccaaaaagtggatgtaagaagaaaaaaatcaaatgaagattaaattccaaactcctatgccaactcctctgtcttcactactagagtgtagattggactcagatactccatggctatgatgagagcaggtaaacttgctgggctttcctccacgagttttattctataagagtaatccacatcccaggacagttcacatgacctacggcttagctgttccctgcggtgggtcatgtcttattcccgattctcccttgttataagcttttcatgaatatctttgtgtatattttccaccacctcaccatatacatatttttttctcctgtgttattcctaaaatggttcctgaatgtgaaatatctgataatgcttcctacgggttgccataccatcctttgcaaagatttttaaaatatttcatgcccaaagcaatgactgccatttaaaatttttttgctgatttaatagggatgtaatgaggccttacttctgttttatttcattacctgttaatgaggctgtgaatttttccatgtgaatttctgctttttgcttcattctatggaaattgtacagttcctttgaatacttgctatttggaatctacatattgaacttcgtgttttgctatacttcttcatacatgttttaggctgggtgcggtggctcacgcctgcaatcccaacactttgggagccggaggtgggcagatcgcttgcatccagggttcgagaccagcctgggcaacatggcgaaacctcgtctctaccagaaaatacaaaaattagccaggcatggtggtgagcacctgtagtcccagctgctccggaagctgaggcaggagaattgcttgagcctttgaggcagaggctgcagtaagccgagattgtgccactgcactccaacctcggcaacagaacaacaccctgtctcaaaaaataaaaaaattaaaaaaggaaaacaaaaacataaatgttttaggtagtacacatttgaatctgtctgatgaaatttctctgcctagtggttattttatggagctctaaatccataccataaaatgcatccttttaaagtggaaaattcagtgtttcttagtatatgcattgtgtgtataaatatcaccactaataccagaacattttatcatatgtattagcagtcactccccattctcccccattccccagagcatgtaaaccactaggctactttctgtctctatggatttgcctattctggacatatgatgttaagtggaatcatacgatatgtgttttttgcgactgattcttttgcttagtgtgttttcatggcccatccacgttgcagcatgtgtcactactttcatcctgttttatcactgaataatccattatatgattacatgtaaatatcacttcttgttcatccactgatcacttacaggacattgggttgtttccacttttaggctagtgtgaacacgttattgtgtgaacacacatttccatttctcttgagtttataccttgaaattgaactgcttgtt

SEQ ID NO: 11780 - DNA, 15720 bp, Human
aaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcggaatcacctagggaactttaaaagatactaagatttaggtccaacctgggtttactgatttaacaacctaggttgtggctgtggcctgggaacatggatattaaaaactctccaggtggttctacgcagtggctaggtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaagattttttttcctttttttcttttttcttttctttttattttaaaggctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtgaggagatcccagagcccacgtttactgcaaccctggggagatgtcaccagagaaatgggggtggtgccagacagcagattgtggcagctgaggttttccacggtagagtagaagcatccatcatgtgtgacattcagcagatggggcgctgtgggtggcttggagcactctggttgtaactgaggcaggcaccgtgtttaggaaggctgtgcagtaatctaggctgaagggaggggaaagcctagactaagattgtggctgtgggattgaaatagcgttgaaggagctgactttgactcccggagatgatggggaaagaggaaatcagaagggaccaaggatggtgatgttcttaagagaaactgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttagaggatataagggggtgaaaggggggcctggctttgagtcaaagggaggagaaggagattataaagctgaaacgtctaagagagtttgtggtctgagcggttctactgcggcaggtgcttctgagaggcagaggtggctgagatctggaaacaggtctgcaaatctggtcactggtctcattgccagtaacgctgtgcgcggttgagggagtgtgttgggagaatagccacgcgttgtctgtcctggaaggaacaagccagtgagagccggtttaatggggcggccggcgaaaggggcttggtgaggcccgcgctcctcggggtgggggcgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtccttttgccctcccagctccctgctaccccttcctgtgtgctgttctctgatccatttctagggtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagacccccaaggggaaccctgatgctaatggcagttgggccttaggcagggcgcagggcagcgcagatgccccctcccctccagtgcagatgcctgctctggaccctgcctcattgtggccccttccccactccttcatcctcagcctcaccctcttgaggaccccaccctccagcccacaggtgctggaccatccctccctggtccctccgcccctctccaccttgggaccttgtgctgctcctatctcttgcccagctgccttgggccctcagcacgttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccactccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttgactgtactcaccctgctgtgctatctactagatcttattcattctaattatatttttgtacccattattaaccatccctgctcccccactccccactacccttctcagcctctggtaatcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccgatttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatatcctagagagtttccccaatgttttcttgtatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgttgttctttaaaagtttaattgtggtaaattatacattacataaattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctggggctacaaccttcctaccctttgtgcctcatgaccaccccctcccttgtccccgccatgcccatgatgagtctcttctcgaggcagctccccttgcctccatctcaccctcagcctatgcaccacagccacactggacatgggtccctctgagcctgagtcccttcccattcccaccatcccctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgtccagggaaaccctccctgtgctatggatgaaggcatttcctgttggcacatcgtgtcctgattttcctctattgttagagccactggataaagacagagggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccgtaacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtcgtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggatgtgtctggcagtagggtcgctggtttctcatccttgaacctaattgcactgtcaatcggcccctcaggcctgagcagatgggaaggtttgtcccctgccctgcagcaagagggccctgtccaggaggcacccacaacaggggcagtgcaggtctgtggtcactcctgctctcacctgtggcgtctcccgtagagggattgtcagttctggttccctgtgggcaggaatggtttcctcataggtcactggagttttggccaggaaaagagtatgaagttcatgtgccagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttcctgatggggtccccagttaggagctgcctgctcagggctgggaggggaggagcactgagctgcagatagagggcagagcccacagtgggcagggcctgccctggtgtgtaggtgcctctgcaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagtgaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacagacacttctagtctgttttatttcatgtgtctgggagcggataaagtgtgaggttcagggagaaagagaggtctgtctcaatgccttggcacggcatgaagacaatctcccctccttgtcccctttccctgctagctcctgatgactgacagattcacagcagaacagaaaggactgggaagggatggaggtgggacatctggcactgaccttcaggggctgaccctgtgggggaacatctgccctgaagagttggagccttcatgtgatgacacagagctgaagtgtgatattcgggaggggatagagagtgcttggaggttttctgattttgaagaatcccagtcagtcaggttctggcgtaaagtgactgctggggaggtgtggactgaatgaatgaagaataaatgaaccaggaaagtggacatgcaagaggtgggttattcctcaccctatttcttgatgcctcctgactgctggtgttggggcacacagatgggtgatgcacttcttggtcaaggcaacctcagccccacccacgtaaggtggtcatggcagagagtgtaagggtgacacctgtgaaaaagacccaaggcagggatgggagcccttcttgcagcaggagtggatgcaggacctgcctggaagcaagagaaggacgagggaccctggctgggccctgtttcctcccactgcctggttcacaaagcaaccagtaagggagctggagtagggaattcactcatgtgctacttactgatccagagatgtgttcgttgacattttcttttatgttttcaggttgatgtcatttacacattcatgcatttatgttgtgtatttattagtcttgtttattttagttagcaagtgtcacttgttgaattctgttctcattaggtataaattttcatattcattgaagtttttataatcaaaatttaattgtccatgattttaaaagtcaaatatttgcataggatttctctagagaaatgagtcctctctgcatcttctcaatttctgccttcctagaggcaaccattttcaacatttttagctaagtctttcaactt

SEQ ID NO: 11781 - DNA, 16410 bp, Human
ttggcttgagcacctaggagagttgtcattatctgagatgtggaaagtggccggtgcttggtctgggttatgtttgagacacccagtggccatctgagtgaaggtgctgttggggctcagaaagcgatgcctaaaaatatggcacttgggcatgctgagtactttgaaccaaaggacactggaagagcctcagaagcaaagtatctctctgaccttctcctgccccccttctttctcccgtttttctcctgcaaggcaggccatagaaactaaaaatcctcctccctaaggtgagttatagcaactacaaatattggctgggcacagtggctcatgcctgtaatcccagcactttgggaggctgaggtgggcggatcacgaggtcaagagatcaagaccatcctggccaacatggtgaaaccccatctctactaaaaatacaaaaattagctgggcatggtggcgtgcgcctgtagtcccaactacttgggaggctgaggcaggagaatcgcttgaacctgggcggcggaggttgcagtgagcagagatcgcgccactgcactccagcctggtgacagagggagactctgtctcaaaagaaaaaaaaaaagaaaaaaaagtaactacaaatattactggaaacatcccccacctttctgtgtcgggcctggccataaaggaattctctgatctaccttgcctgatactaggtcataagactctcattccagaaggggtcctgccctcctcccagcaggagggaatgccacacagagagaacaagaagaatccgaatctgaacagacattgctgggtttccacactcagctattaacattaaatcattcccttttgtctaatcgcgtttatacacagttgtccattccttattcctttttttttttttctgttgcccgggctggagtacagtgacacaatcacagctcactgcaacctcgacctcctggactcaagcaatcctcccacctcagcctcccgagtagctgggaccacaggcacctgcctggctttttaattttttgtagagacagggtctcactatgttgcccagactgtcgttaaatgtctggcctcaagcgatccccctgcctcagccttccaaagtgctgggattacaggcatgagccaccagacccggccagggctgtccattcttcatcaaaccgagacataaaaataaagatttccctgagtatttgtgtcttcattcctgaaggctctcaagtcacataaaacattgagtaaatcaatctattatgcttttctcttgctaacctatattttatttgtaggagtgtccgctgtgacctttgggatgagtaagggaaaatatcacacctttctgcccctacaatgcccagaacaaagcatttggcacttagcagtttctcaataaatacttgatgaatgaatgaagaaggaagtagcccagtctgtgcgagtagtccctgagcgtcaggcggggaaggagagccggctgcctttgcgggagctgtgaccgcctgctttggtgcctcccacgcaccctccttgtagagacgattaatcccagacttccattttcctagcagctcactaggcgggccttgcttcagagcagtctctcatttcctctgcacaaagccctcaaccgtcctctgcacggccgcttactgagcgcccacggtgagcctggcacgatccttgccctcttggtccccacagaggtggaaggacaggcctcgcggggtccgggccacgaaggacagccccgagtccgttctgccaatgccagcctcgctagcacgcagggcgggagcccaatggggaagggcttagggaggctgggaggccggacccatatgggcagggcacagcgttgctaggggggattctgataggttgcgcgaagggttgccttcgtgaggccccgccctcactggaacgcttcggacttatcaggttaccggattcgagtcagaagcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacaggtacctacaccggctggggtggcttggaagggtaggggtgagtgctacaaggagtgctttggcccttcttccctaatgtgggtatgtggagagacaggttcctctctcttttacttagagctgggcaggaagggaggagatgcttccccatacgggaatcatttctccttcaaaggggcccttcctttctcacttcctctccctcaagcacagaggccctaactgatggatatcagcatgtgcggagaaccgcctgtacagtccctacagtaactccatattacagataaggaaactgaggcccgagggggaaaggtctcacttaggtgagctgattgggtgcctatcctggctggcttacttcttaagcctctctgaggcctcttgagggtctgtggtagagagcaaagagctctggactggggctcaggagacctggagtctggccaatggtcccgacttaacgatttttcaactttactgtggtgtgaaagcgacgcacattcagtagaaaccacagtacgtatacaacctgtgtttcagtattcagtaaattgcatgaaatattcaacaatttattataaaataggctttgtgttagatgattttggccagctgtaggctaatgtgcgttgtcgcactttttttttttttttttttgagacggagtctcactctgtcacccaggctggagtggagtagagtggcgtgatctcggctcactgcaacctccatctcccaggttcaagcaagtctcctgctcagcctcctaagtagctgggattacaggcactcaccacctcaccccggtatttttttgtagttttagtagagacagggtttcaccatattgcccaagctggtcttgaacccctgacttacggtgatccgcccacctcggcctcccaaagtgctggaattacaggagtgagccaccgtgcctggcctgtccacatttttaaggtaggctaggctcagctatgatgtttgccaggttaggtgtattaagtacatttttgacatgatattttcttttttattattttgggatggggtctcgcactgtcacagcccaggctagagttcagtggcacgatctcagctcactgcagcctccgcctctggggttcaagtgatcctcttgcctcagcctcccgagtacagcgcatgccaccacgcctggctaagtttttgaatttttagtagagacaaggtttcaccatgttggcctgacctcaagtgatccactcgcctcggccttccagagcgttgggattacaggcatgagccactgcatctggctgatgtgatattttcaacttacactgggcttatgagaacgtagttccgtggtaggcctaggagcatctgtactgttaagttctatatatgggatgggaggagctgatgggggttataggaaggttaggacataaggtgttagttttgctaattccaggtgttagttttgctaattccagcaatgctgtggtgacggccagacctcaagccactgcctggcccaggcaccatcctcccacttactgctttgcaagagccagccattgcaggaagagccaattctaccctaaacccaggagtccagtttcccttatatataggcaggcagcctctgtagggctgagcaacatacagatggggtgggatgagggctggagctgtgggggcaactgatagtcaccatcccctcctcccttgccccctagtgctcttgctgggacatgtggcccaggtgctgatgctggacaatgggctcctgcagacaccacccatgggctggctggcctgggaacgcttccgctgcaacattaactgtgatgaggacccaaagaactgcataaggtgagtaaggtccacactcacctgatgagccttgcccagggccctgcagattcgggggcaggaagtggagagtccactagaaaagagggcaaggtcagagttctccatcccagagactgcagccagaagtcactcggactgtctgacacctagccccatgacctgtctggagcctctgcagggactctcaggccccaacctggtcacgaggcagggaccttacatggacccagcccctgagataactcttagaaggtcaggccaggccccctgtacttcccctgacccagtcctgccttttagcctggggccagccactcctttcaagccagcttgcttatggctcatcgcacaatctctggtggtcatttacactgatacctggcttagggctcagcaaggtcatggtttttatagcccagattcaatcagagctgaggcagggtgtgggtgagggccgggctgggtccctgagctaccccatccctctgcccctcactagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgtgagccgcaccccagccctgcccttggcctcagggctagaccactcctttcaccctacctcgcttagggctcacttacgtgattgagatctcacagtctagtgggggaaacagacaaatgaacaccgacttttggcctattctgttgagtgagagccagaaagggcatctcacacagcctggtattctaggaaggttccctggaggaggcatttcttgagctgagcccagagagatggcattggaggcagagaggatggcaggagcaaaggcctaggggcaagaaacagccgctgggaggtgtgtgttgggggagaggtgggccatcatgggcagaggccgggccagcatgctgggaccatctcctttggtccgtgggagccactggaggtttaatgggacagggtcagatatgccttgaggaggctccttgagggtcctgcttgagcccactgtgtcctcaaacccccacaggttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccagggtgagttacgcagctggctggggcacgtaggcaaacggggagggtggccatggagacccacccagcgcccacctggctgagcttcccaattccccctacccaggggttagggggattgtggctcccaggctccctaaatatgagtggcagcatagcccaccctggaagcatttgaggctctgggtatgtggggaggcacctactgtttggagcttgtttcttcacatctgttgggaaaaggtctgggctaaggccccagactgcctcctgcacttcctcaggactgaaacaggttgggctttctctagggtaccccaagatggctgctgccctgaatgccacaggccgccccatcgccttctcctgcagctggccagcctatgaaggcggcctccccccaagggtaagccattctgccccctgcctgatggcgcttcccacacccaggcctccttacctcctgagtgccaggcttcagggacggggccttccagagccagggctgctctcaccacaggtgcccatatggtgatttgtaggtgtctagagacctacattaagtagccgcaaagagcaggtgggctcagccagcccagagaggtgtgtgtgttggagggagtggcgggccttagagaagaggcccttgtgaagtgggctgaaggagttggcatcagaggcaggagagccatctgtgctggcacacagtgcccaggattccaggaggtgcccattaggcgaggagacccagaaggctggggaggccaggcaggtggggccaagcctcagaggagcctgtgggctcatgagggctcccttagcatgtttgacaccaaaaagggtgggctcaggcctctggagctgagaagaaagcagacagcagtttctcactgagagaacatgggggtgggtgggtgtcagggagggttgtttgtgggtgcaccagcctgggcccacaccctgggtttgacccaagctggcatgagaaggcagggtaggctcctggcaccagcatgcacagaagggagaccccggtagccccagagcagggccaccctctgaggccctcctcatcctgagcaagccggtggggcctgttctcttccctcttccccactctctgtctctcctgctgagcctcctcaactcctgtgtgggtccctgggctgcagcgtgtgattctggtgctggactctgccttcccctcgacatccaggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatggtaccaggatggagggggatgtccctaggcccaccatctgtgacgaccctgctccccactgccctgtgctttcttccttcttggaggctcactgccgggttctaggtcagcgcttctgaaatgtgtccctgaactggttgctttagacttgacttagaagctggtttccagggccccatcccccacgttttgcatcacaatgttcaggggaagaacactgttaaccatctccccaggcaattctgatgtttctgaaagctcaagaacttgggtctgtagtgaccctggaataagatgttattgctctgcaggttgaagatcacgaccttgctattcctagtgcctggactgctctcccccgtgtgcctctgatccttttgtcaatttcctgcctcatcctccacagggacaactggccctcacagtcctgcttctagcccttccattctatctcggtcattgccctgtgacattttgttgttgttgcaatttatagctttatagttatctgttagtcaacaagcatttactacctgattgatcctatgatgattataagaattacaagtgctaagccaggtggagggagcaacctggaggagcaggaactggcctgctgtggagtcccagctctagctctgccactttacctcgggcaagtaacttaatttgttctgtgcctcagttttgtcaattggaaaataagaatagtagctaccttatagggttgagggttaaaataactctgaaatgcttggcacagtgatgggcacacagtgcttaaattgttgtcactaagcctgtaattgtgtcctgactatggattgcttgccctggggtcaggagtcccccttggtccattcagctgtggctagggcaagtgggtgtggccagtggtaggtacagggactttgtcccgttctgtttcttaccactgtcaccttgggacatttattgacttgacctagtttataagctttttgacaacaggagcccatttgatcatctgaacaacctgtgatgtagccagggcatattaccacccccatcacccccatggggtttttgttttttattgatttatttattttttgagacagagtcttgctctgtcgcccaggctggagtgcaatggcgcgatctcggcttactgcaacctccacctcccaggttcaagcgattctcctgcctcaaccgcccgagtagctgggattacaggcgcctgctatgacacccagctaattttttttttttttttttttagtagagatggggtttcaccatgttggccagactggtctcaaactcctgacctcatgatctgcccgcctcagcctcccaaagtgctgggattacaggtgtgagccaccacgcccagcctatttatttatttatttagagactgagttttgctcttgttgcccaggctggagtgcaatggcatgatcttggctcaccgcaacctccgcctcccaggttcaagcgattctcctgtctcagcctcccaagtagctgggattacaggcatgcgccaccacgcctggctaattttgtatttttggtagagatggggtttctccgtgttggtcaggctggtttcgaactcctgacctcaggtgatctgccctcctcagcctcccaaagtgctgggattacaggcgtgagccaccgcgcctggccttttgttttttgagtcagagtctcactctgttgcccaggctggagtgcagtggtgcaatctcggctcactgcaacctccacattctggttcaagttattctcgtgcttgaacaagtagctggaattacaggtgtttaccaccacgcctgggtaatttttatattttcagtagaaatgaggttttgctatgttggccaggatggtctctaactcctgggctcaagtgattcacctgcctctgtagcaggaccagccgcagataaaactcctcagacaccagattaaagaaggaagaggtttttattcggctgggagtgtcggcagactcgtgtcttaagagccgagctccctgaaaaagaaattcttggcctttttaaaggcttacaactttaaggggtccatgtgaaagggtcgtgatacatcacgcaagcgtgggaaacatgactggaggctacatgcatcagctaacagaacaaaaagttttacaatgcttttttcatacagtatctggaatttgcagataacacaagtagtttaggtcaggggttgatgttattattattacttttttttttaactcctagggccaggtggtggtgccatggttgtctggctatttatcttacttttgtttatttccaactttttgctttttctctcctcctgtcttgtgaactaggcaaggttgggagaggagggcagcaggagtagtagtggtctccttccttacctcagcctcccaaagtgctggcatttacaagcatgagccgccgcacctggccatctgcccacccccctaccgccgactcctgttcttgatggaaaataaaaagctgaagctcagatggaaggtgacttaactcccccaaggccacagggctagggaatggtgtttgctgaaccaggcctcctccacatacagccatctttccctaatccctaattgctcttcctcggctacaagtttggggatggtccctgtgtctacctccttgaggagatgagagctgactactcctcttctctgcccccagctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggtactagggtgtggagggaaggaaggggagggctgaggaactgggttctcctgagagaaaggctgccagcctccctgggggcaacacctggcgaggtacaggagtcgcccagtccccaaccagggctaccccttctggttgcttatggttgaggactctgatgggagctgctccaactgtcctcctcttgctgggtgagagcagggctgagcaggacagctcaagggagtcggggatgagaggtgtcagccacataagtgcacatagcaagggtgaggcacagagcttctatacacccgtgatggcctgcagagagcttggacttccctccagagcaggaggagctggtttgtttgtttttgagacagggtctcactctgtcacccaggctggagtgcagtggcacaatttcgactcactgcaatctctacctgccaggttcaagcaattctcgtgcctcagcctcctgagtagctggcactacaggcgcctgccaccacacccagctaatttttgtatttttagtagagacaccatgttggccaggcttgtctcgaactcctggcctcaggtgatccacccgtatcagcctcccaaagtgctgggattacaggcatgagccaccgcactcggccaggagaagctgttatagccaaggaatactacgactactggtggctgctatttattgagtacctaccatgtgctgggagttttagataatttttctcagcaaggtagttatcttgccattttacaaatgagaaaaatgaaacttcgagagtctgagtaactttatcccaaggctacacagttggtacaaacaagactggacttcagtgtcacctcaaagcctttttttttttttttttttttgagatggagtctcactctgtagcccaggctggagtgcagtggctccatctcagctcactgcaacctctggctcccaggttcaagcgattttcctgcctcagcctcccaggtagctgggattacaggtgtgcgccaccacacccggctaattttttttgtatttttttcagtagagacagggtttcaccatgttggccaggctactctcaaaactcctgacgtcagctgatccactggcctcggcctcacaaagtaatgggattacaggcatgagccactgtgcctgtctgcctttgctctttaccaaatcctggattctggtaaaaagaaacctacagaactatggaaggcacctatagaactggtgatgcccagaggaagtaacaattccctgccagaggggctgatggtggagctgggcctggaaaaccttctggaggatgggagttcacatccagctccactctccaccctcctggaacagagttcactgttcccactggacagcaccctccaggccagcactggcagctgtttggggccagcactcatacgctgtactgttgttgcgcttccctgtttctgcgtttatccctcccgttgtcctatgagcttctggggcagggcctcatgcagcacttgtctcagtgtgctagcataggggccgggctcagagtaggtgttgatgagtatctgctgagtcagggaaggtgggcagatagggttagataagctggggtgctggaggcccgtggcatcctccctaaacctgtgtgacatggagctgtgaactgggggacccagaactcagggagggccagggaggcaatggtaggtcctgtctgagcaagggaccccagccagtagccaccttctgtgcccaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggtgagcacccggctgcctgcagccacccgcctgggcttcagatttctgtgggagggtattatggggggtggttgttcacatatggcctcccctgagccgtgggcttagggcctctggcaggtgcccatggggagctgcaggcactgagagctgcagccagtgccgtgctctgcaccagtattttcaacctatgcaaacagaactactgcatataaatatgaatcccattagcctctacggctgtactcctcccaagggtcagcccttgctggcacgttcctcacagttttccatgggctggggctttctccactgcccgtgcttgggcacctgctggatttgctggtggagaagtgatggggattcagggctcccacttctgtagggcatactggaagcccagcacagacaggccaaagtccaggcagaaggcttctacatcctctagcggggggggtctctgtgccgccactctcatggtggcattggtgatgtccctccccactgcaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccagcatccagctccagtaaccatcaatgtgtaccattatttcatctctcttcctgcacatgctcttctgatgtgtgagctagagtatctgaaaggaaatttcagaaaaccctaaaaaccactatgtctctaacagataagggctttaaaaatacatatatgagccgggcgcggtgactcatgcctgtaatcccagcactttgggaggctgaggtaggcggatcacaaggtcaggagattgagaccatcctggctaacacggtgaaaccccatctctattaaaaatacaaaaaattagccgggcatggtggtgggcgcctgtagtcccagccactcgggaggctgaggcaggagaacagcgtgatcctgggaggcggaggttgcagtgagccgagatggcaccaccatactccagcctgggtgacagagccagactccatctcaaaaaaaaaaaaaaaaaaaaaaaaaaaaaaaaatatatatatatatatatatatatatatatatacatacacacacacatatatgtgtatatatatatatatatatatgaccttaatacaattttcctatctaaaaaaacataattttaaaataatctaataaccaatctatgttcagtttttgccagttgtctcaaaaatctctatagtttgtctaaatcaagatccagtaaaatagtccagtacgaactactgaaagtttgctcccttcataaaagcattgaaaaacctgccacatactatcaaaatcaactttcacagaactctggaaattagccaaaagcttgcggcaacccagaaaacttcaactgaaaaaaaaaaaagttgaattctagtagaaacagcaagctatgtggtattttaccttattaccagattttaaatcagctattttaaacatgttcaaagagccaaaggaagccgggtctaaagaaataaaggaaagaataagaatgatgcccaaacagaataacaaagaagagataaaactgtagtggggaagaaagcacaaattctgaagttggaaagtacaatagttgaaatgagaattcactgaagaggtttaataatagtagatttgacagaaaaagaatcagcaaacttgaagacagatctgttgaaattaacctctctgagaaaaagaaagaaacaagaatgaagaacaatgagcaaaacttctaaaacctttgggataccaccaaatgtacccatatacacataaaaaaagagaaaggggcagaatattggaagaaagaatggttgaaaatgtctcacatttgatggaaaatattaatctacctatccaagaagctcagtgaactccaagtaggttaaactcaaagagctccatacctagacatatcataatcaaaccctcaaaagacagaattttgaaagaggcaagataaaagcaactcatcacacaagggagtctcaataagatttacaactgacttctcatcagaaaccatggaaacaagaaggcaatgggtacatttaaaaataactaagtataattggattgtttgtcacaaaggataaatgcttgaggcactagataccccattttccatgatgtgattattacaggaatgcaatgcctgtatcaaaacatctcatgtactccataaatatatacacctactatgcagccacaaaaattaaaaatgaaaaaaaaggcagtgggttgacatattcaaagtgttgaaagaaaaagactatgaaaaaatttgttatttggccaaactatctttcaaaaatgaaggcaacatgaaaacattcccagataaacaaaaacagagttcatctctagccaccctgccctacataaaatactaaaggacatccttcaggccaaaatggaaggaaactagtaacttgaatccacatggagaaataaagagcaccagtaaatggaactacataagtaaatataaatgattttggtttgtaactcattttttgtccccatctgatttaaaaggtaacttaaat

SEQ ID NO: 11782 - DNA, 139936 bp, Human
  misc_feature (1)...(139936): n = A,T,C or G
tagtaagcactcagagctggcagctggcttaattttgacatattttatgtcaaaagaaatggtgggaggcaggtgcaatgaatgagctggggggtatgttttccttccttgaaggcgcatggaaagctcattctgctcaccctttgttattatgtattttttaaagcgccacttactagggagttgagtttcttaagctgaaggcggacctactgcttaactaggggtgttagaagttctcaggggcccctaggccaggcagtggggtgtgaatccttacctctgttcttcttcctggaaactggcaagagggtggagagagctcctcttggaccttgcctggaggtcagggacccctgcaaattgcccatgtgttgtgggaaggggtagaagggatgaggccccccctcttccattagctctcgttttccttatctgggaccgggaggtgggaggggctgtctggaggggccacattcctcctggcagctttggtctctggctgtgcctgcaggtttgagtgtaaaaccctctagcagccctgtgaggtggccccattagctctctcctgacagatgaggacagcagggatggtactgggcttccaggtaactgtgccatgtgcccttcactaccctgcttatggctggctcccttgctcctatttaaggggcctattctcctccctgcttcatggggacaaacagaagctgcttctccagtcatagcccctggctcccaccagcctggccatggtgacccacatccttgtttcgataaagaaacaagaagcatcccccaacccacaacctttgatcagaagccacttccagctgtgggacagctgcagggtggggtcaggagccccacacgcctatcctgggccacccatccacctgtccacacacatctgtacaccacacacatctgtacacccttggcgccagggacgccctcccccaacagtgtggggcccccttccttcacaggggcagtgaggtcactcctcagggtatggcttcatgagctcagcctctgtgtgagcactctctggcctcagtttcctcatctgtataatagacttaaagatagtctcgacctcatagggctgtggtgaggtttctatgagctcacatgtgcaacgcatttgggccgtgcttgtaatgccctgactctgttggcagtagggagggcagcgtctgctgcagggtccctacaccttctctgcaggactctgcacccagtaccagtgcccagtggggcagaggagtaagccttctggcagactctccctcctaaacccttctcggctgtgcccacttctcgcctgccctcctccctggcttcccttcctccagcttctccattctgcagcccaggaaacctagaaaagatcctaccagacttaactcataggccccacagtggaggccccgcagggtctggcccttgcttcccttaggctgcccctctctcgcgcacattctcctggacgctgcacatttagagtcctccagttgccccacggcctttgctcaagccctttcccttcttaaacaaaaatcgccacctctgccccgaccctagcctgggtcagtctccctcctctcctcccacgtggtttctttattcctatgtgttcttctcccgggtgggctggtacgccagatcggggactgaaccagaatcaagatgtcctctgcttcaggacctccctcccaccacgaaaaggctgcagatgctgcccgctaacccgacctactgtctgcagccggcagcccgctcatttatcctggccgagctcttgggcccccaatctccaggagccccgccccatcggggctccgcccttccccaggtaccgccccttcccgtcccgtggaatttggctctggaggaggtgggtcaaggactccatgccccgccccctgccccgcccttaccccgccccatgcattggcacccggaggggctcagctgacgccgcacttcacgtgacgccggtgccgggcgaacatggcggcggccaccgggtgagtgctgcgcctccctcgctctttcccgctggcgtggagaggggcatgggtgtcccggccggaccgcgggtgagagcgtcagccggggtcgctgaatgccgcgggtaggcgcctcttcccgttggcccggagtcccagcgccggtcggcgagctgcacgctccgagtcagggtcagcgcgggggccgcagctcctctccaccctcctggctggctccggccccacctgcccgcgtctggcggccccaccgtgtgcggctgcggtgggggctggggtcgacacgcatgttcgctgccaagacccccgggtaggagggcggcgttgcgaggaccccagggacccgggcgcttcccggaggaggcggtattcgagacggacttggaattcccttttcccagcagggcacttccccatttctttcaggggccaaatgtcaccccctcagggaatccttctctaaccatctatcccactttttgtgccctcatcatcacctgataaactatatagagcattgtttgtacttgttctttatcttctctgcatttagagtgcaagggcaggtatgttacctgcttctcagtagcccggtgccttgcacacagtaggtgctccatactgggctaaatgaaagaaagctgagtggtcgtagtgggaggaagggtggacagatgggttcaccagagcgttgggcggaatctcccagatagggagcatctgagcccagggtaagggacaaaggttgagagttcagagtgttctggggacaggggtgcatgcctggggctggttggaaggtgtggtgttccaggtggcggcttcagactttgccctgatgggctggaagggttttgttacaagctgcttgatctgttttttaaagattaggctcccctgagctatgtgtgagttcaatgggagaaggtgtgggtctggtggtacagtggggtagggggggcatggtgtaggagggagcagtattccagatgccaggttggaaactgaggtcagaatgggggatctagtggactgaatgcatctctctttttaagatacagggaaaatggcaacagaaagtgggttctaagttggcccccaaggttgagggagcttagagcatacaaatcaaatattttgtgggcacctgctatattccaggaatagcagtgggtcttcccttaaggtactcacaggccactggaacagatggacacatgggactctgtcatccatctgcttgccgtgtggtcttgccatttgcaaaggaggggcatggactctgagctcagataaagtgtgggaaggcttcactccctgggtgacttttgtgctagtccttcagcaatgagactcccttcaggtagagaacagtgcagacaaagtctcagatgggtgtcacggaactcagggtcagatccttgaatccagcctgtgacccttttaaagggtagactgagcaggctggtgcccagctgtgggtgtgctgtctctctggttaggctggctcggtgctcacagggagtgccaggggttgcatttgggttcaggattccaagctggcctgagacctgctgctctcctgaaggaaccaagctgatgtctggacgggagcaagtctggaactgactggatcctggaatgagagcttttctttttctctttctttttttttttttgagacgtagttttgctcttgttgcccagtctggagtgcaatggcatgatggctcactgcaacctccacctcccaggttcaagcgagtcttctgcctcagcctcctgagtagctggaattacaggcgtgtgccaccacactcagctaattttttgtatttttagtggagatggggtttcaccatgttggccagactggtctcgaactcctgacctcaggtgatccacccgcctccgcctcccaaagtgctaggattacaggtgtgagccaccacgcctggccccagaatgagagcttttctagcagaaccgattctctgggccaccacacagggtgggtgagggaggcaaaacagagtggcaggtcttagagaggtctgctattgagagggtgtgggagcttccagagcctggcagtctccttgggaagagccatcccagtctggtatggggctttcccatgtactttgagcctgaggttgaccccagtggcttcctttagagcagaatgattaagtgtgtttcccgcaaagctcagctcctagccacactcacagaacagatcatagagtcaggcataacgaggcatgatgccagcaagtcacggccattgccgtgggctcactgggagttgggtttggttgtctgtagaatcctaccagagcctgggacagagggggtccatgagagttccaggtgactggggtgtgccccatatgatttggggagtaggggaagccctaaactagcatctcagatttaatttgaaactcaagaatctactctgaatgcatctctctttttaagatgtggggtgtttcagggttgatcctactttctcttgctagcctgggtgtaggcttcaggttgagacagagtgcgctgaggtcacctcccatcccctcatggagaggggtccctatcccatggcacttggtggcactgctgctgtctccttaagcaatgctttgagctttccacagacaggattgataatttgaaatctgtcagctccagccagacctgtctgcatctgctctcccacatggctttttccattcccttcttcccttgcacactcacccaactagccctggaatgttcttgtcctctatatgattcttcacgtatttgcaggcccagctcagatggttccctttcccagaagcctttcccagccctcgggtaaaggtttagtgctcagaactccagaacactcagttttctccccagcagtacatttttacacgtctgcccattgtgggttaggagttgcttcccttcatgcctctcctagcatccttagaacccctggggttcttttgtatccgcagggccagtctgtggctgccctgtgattggtgcttggtgaaatgaatgaaaaggggatttactctaaattagtccagcatcccatcctgctttcctgggagactcccagtgattgagggaaggagtcatggtggggaatggggacagaattccgaggggtaggatgaagaaatagccttaattctttaactgagtggctcccaggagctgttgcagagccaaaaagaggcaaaggtgaactgccctgggcgtgtacccctgttgagccgtaggttacactggagtcagcattcttctggagagtcttctgcagaattcacattctgggtcaagagcccaaccccacaatgtgaaccttgtgctccaggagcagaagactcaggccgactgggggctagggacgggtgggcctatgggaggcaggctggccactgagtatccctgtgccttccctggctcttccccaggtcctgactccacacagctgtctcttggtttctgtgtatgcttggcacccctatccgccccaggagacagaggtgcaaggtggaggttgctggccagttgcctcgaggtcctgttccgccgtggcaaccctctccagcctggcgcttacggtctggtgcccagtgggctgcctgagcatctgtctggtgcctggccccacgctggaggctgaggggaggaggtggctggtccttggctggcctctcctactgggaacttagcggtgtgaccctgtctagaagtggctccacatttcattttttttttttttttgagagggagtctcacactggagtgcaatggcgcgatctcggctcactgcaacctccgcctcccgggttcaagtggttctcctgcctcagcctcccgagtagctgggattacaggtgcccactaccatgcctggctaatttttttgtatttttaatagggatggggtttcattatgttggccaggctggtctcaaactcctgacctcgtgacccacccacttcagcctccccaagtgctggtattacaggcgtgagccaccgcacctggccagtggctccacattctagtgcagagatctttccttgtctgtgcggtagaccccacgggcatcagtgaaacctacgtaccattctcggcatcaggtttttttttgttttttgttttttgttttttttgaaacggagtcttgctctttcacccaggctggagtgcggtggcttgatcttggctcactgcaacctccgcctcccagattcaagtgattttcctgcctcagcctcccgagtggctgggattataggtgtgtgccactatgcccagctaatttttgtatttttagtagacacaggggctcaccatgttggccaggtggtatcgaactcctgacctcaggtgatctgcccatgtcggcctcctaaaatgttgggattataggcatgagccaccacacctggctggcataatgtttttaaatgtatgaaataagtacataatattacaaaagtaaaacccaattatatggaaatacaggtatcaaaatgttacataaatttgagacagggtctcgccctgtcccccaggctggagtgtagtgttgcgatctcagctcactgtagtctccgcctccagtgctcaagcgttcctcctgccttagcctcccgggtagctgggaccacatgcacaagccaccattcctgactaatttttgtgttttcggtagagatggggttttgccatgttgcccattctggtctcgaattcctgcctcccgcagtgctgggatgataggcatgagccactgcgcctggcccaactactttaactttgaagttgtggggagcaaaagtgatattttgagatactggaagagcaataacatggtattaaaatacctttgatttttgttggtgacagattaacatgcattgctgacactgagtagtttgttgcttatgttaataactgaagaaaatgtaaattcgaattggaggttagagaaaataaaggtatagctttttcccatctagtagatggagcccctgaatttgaggatgaatccttgggggtccctaggccttaggtaagagccctgcacgtggctgttgaggagagggtgtcccagtactgatacgggggtgtgggttgtgtggagacagagacggcttgtgggggcagtggcatcataccctccttgaggactggcctcagtcttggtcactccgttcttggtcctgggctgcttactgggtcttggttgtttccagggcagcgggggtcctggcctctggggctcagagacttgttctgtgggtctctgaggccctggagctcttgtgccttgtctgtctgcagcaaagcatggcttatttaccctgggacctggggatgataatggcttttgccttttaaattctgggtgccagttaacaaaagctgcagcagaaacctgttagagatgttttgttggtgctacatttgccgaatttgcaggaagaattcgtctgtgttgactctgagcctgacagtctctctgggggcttggtttatgccatgggaaatcaaagggcatgtctctataaaactttattacttggtgtcctgtaattaatgactgtagcatattgccttgcctcgtggctcaggctagcccttcttatgctcagagccctgcacagggtgggttctgttctggcggagccccatggagaaataagcatggttgtagattttctttgcagtggcagctgagtgttcaaggagaaggtggcttatcaagttttctgctcagcccttgggatcccagtctgggtgccctgagaaatttgtctctcagaaggttctgaacaaggggaaggccagcccttctgtgagcattacaggtgggggcatggtgtcaggccatggggagccagcacctgttatgattaaggagtgtggccaggcagggagaggggagtgtgggagaggtgggctgggctgggctatgcaggctggtggctgaggatgggcattttcggccggtcatgctattcgacgactgtggctgaggctgtccatagcagggtctcggtgtcattgcccctaagctgttggggattctgcagagacgagttttgcctctgtgcccatcccaccatgggctttcctgagtgaagggaaagggcgtgggaggccatgggggatatccgagcacaaggtgctggtgactgcacttttagctcctgacagcatggccatctgggatgtggtcatgtttacgaactctcaccgacttccctctgccctttcatcccaatggctgagcgtggcagaaaagcagccccagcccagaggaagctctggccgctggtgtccacccagccacctgctcaccctcctgggagggtaggaagggcacgtgggggagcgggcggggctctagtcatgtcagcatgtgcggctgcttctgaccctccacccttcctgggcaggctgggactccagggctgcttcctgccctgctgcggctgatgtggcatcttctcatcccacagctgtgtgtgtggccccgtgtgtcattcagcagatatgtgttgagcgtttgctgtgtgtcaggcaaggcaccaggcgagggcacggcagtgaccgaggcaacctggagctccatctcccagtgtttccacccgaggcggcgggccggagaacaccaggaagcaccaggcagcacccgctgcgtttaggttggaaggtgctgtgtgctaagtgttgtgttagccagggacctggccccacgttaggagtttactccagggggccactaaggagagttgagagaggggacgatacacagagctgtgcgaacgttaagggaaggcaggcacatgaggctaggggcaggaggagagggaggaagacagtggaaagaagagtggggaacctggtcagaaacccagcaggggctgtgctgtggggcagggcgctgtcatcagagcagcggccctggatggaggggtgcccccagccatttagttccagggtccccagggagggagccaggggagtggatccactgtcttcctccctctcctcctgaccccagcctcatgtgcctgtcgttggctcagtgcgcctggagacaggaggcagcgtgcatgctgaggaggtcgggtaggttggcctctgggcacagtgcaggggggtgtatctggagggcaagtggggaaacctcaggccagggactagtaggggattgggcaaggagaagagctgcaggttcaaagagggaggccggggaagaccatccggaaaaggtcgtattggagccaagatgtgcaggaggtgtgacctgctcatgtgaccctggcaggagggtcagggcctctgagggtcccatgtgaggtgagtgtgaggtgccccagaccacttcaccgtgctgtgctgtgagggcaggtttcatccacagcttcactgcagtccccaggcagagctctctgctcgcaccagctctgggatgtccctgcctccttgacctccgtgcccacccactgccccctggctggagagccgcaggggctccctcctgcacaccctgcccctgcttactcctcctccacctcatccccattatctctccacacccggcctccagcctgcttgctgggaccaccatccgtttattcattcattccatagataccgacacctgctctgtccctgccctcagggagcttacatgttacctggagggccagcaaacaaataaatgaagagtgatgggggctctagagagacacgaagagagctgggggatggggtgggtaggaaaggggcatttctgcagaggctggggtgggtaggaaaggggcatttctgcagaggctggggtgggtaggaaaggggcatttctgcagaggctgggtaaaagggcatgggatgcccttgggaagagcattccccacagggcgccgcagcggcaaaggctggagtgttctgggggtttagggaagagcgaggatgcccgtgccacagtagaggaagccaagggtgaactgggggtctggatcccttgtggctggggagtgaagtctgcactcagagaagccagctggcacggggttgggcagggagtgtgtgctgggattggcattttgaaagggcccttctggcagaaggtgcagaccaggccacggggaagttgcggccaagagcaccgttgagagttgcctgcagttgtccagacgggacatggggaggtggccctggggatggggatgtgcaatgagggtagaccttgctggtggccaggaggtgggatgagataggaggccaggatggcctttgggactgtccaggtgcaggtgctttgtgtcgggggaggctggggaggagcgactttggttcaggtgcatcttctgcctgctgagggtggctgatgggtctgtgagtctggagctggacatcatcagtctgcagatgcagatggtcctttgagctgaaggactgggtaagctcagctgagctgagggagggagccagttagggaagaggccccagggttgggccaagctggcctctagcagggaggttgagccgggagccaggggcctgcctggtagggagcctggaccggctgctgttggagaaggtttccgcagagagagtggcccccagggtcatgggcaccaagtggccagtgaggactggggacctgctgcagattcgggagcgtggggtcactgtggcctgctgggcagttggttggggggcagaggagcaggggggtggagtcaggacagcatgggtggtggaggggagacaagcccctgtggtcctcagggggatcagtgaggggctgtttctgggtcataagtaggtggagcttgggcagcttgccccgtgctgatgggggtcccacggcaggctcgggcctccggtcaccccgacctcaggtgtgggcatgcttggagatgctaacagaggcctgtgtggcggtgtgtgctcttgcctctgcagaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggtgagcctccccgcttggccacaagtgagcaggtgtgtgatggtgctgctgtcctgagcaggagttggaggccccagcttggccagtgctgccccttgtggccctccctgagcctctgtttcctcgcctgggaagtggtccaggggctccttgaagatgtagaacttgaagatgtggggcagcgggtggcccagctgcaggaaaccagcctggccatggtggccatggctgagagtcactggcggcactcagtccccaggcacaggaacatgaggacacccacccaggaagactgtgaggctctgagctgggcccactttcacacatcttagcattatacccattttgcagatgagaaaactgaggctcagaggggaaatgacttgccaagaggtggagctgggattagaactttgtcttccaactctaaatctagtgctgttttctccccgctgccatgcccagagctggagcctgaccacagcaggaacttcagaacctctctggggcaggcagagcctagggaatgtgtccatgcagcatcctggcaagaggagagatgggaatgcgaaggggagctgagtgtggagaggatatgggaaggcgtggcttccctagctggaccctgtcgccccagcaggccacagatgggctgagacccattgctgagcgaccgcagactgtgttttttctttactaaaagcacctcctgcctgaagggtcccgtctctccactccattgttcgcgcagctgcaagcctgcaatcccatggctgtgagaaacatggaggtctaaataagttttctctggctagtcttgatgcttctccaggtttaaatactctgcggcttaaaaaccgatttcctaaattcagctgttggctccctttctgatggtatgcaaggctaattttggaagagatcctcctccaccatacctttatgacgtccttttagcgcagcattcatccctaaacactgaagtcatcagccgtcccgggggtgggagagggaagtaagaagtcttaaatggaggaatccatttctgtgcagatatccggcctgggcgtcagaatccggggggcgtcttgcctgcctgcacgtggcagagaggcagggttgagctggacgtgtggtgctgctggacgccctgttgtgggcccgggggtggggatacaggtggactcaggcacatgcctgacacagcatcagggagggctcccagcagggtagaggagctgccaggctgccccctgccaaactacgggaggatgagctggggagtcgagtgctgaggggaagggatgtctggggctggggtcagttacaggaggctgtcggtctgagctggctctctagggtgctgtgatgcagccaccggtccctccttgcacctcatgttccactggctaacaatagttcttgttcccgccacaggagtccttctttcactgggcgttcggtgtcactgagccaggctgctatggtgtcatcgatgttgacactgggaagtcgaccctgtttgtgcccaggcttcctgccagccatgccacctggatgggaaagtaaggagcagcctggccagggcaccatggctaccaaccatgggctgggggtgggtaggggaggtgggatgagagagctgggttgggcctggggacggggaggagggaagagctgcaggaggaagggcatgcggtcagggctgtcacagcctgcctctcgccagagccctgcacccttggctgggaagggatgttagagctggagtatgactgtgtggtaggagttattgagaaattgttttaggtagatagagaggaaaaggggtccttgggaagttttctggtaaagccccagctcctagagccaggccggcaacctttgatatgcaaatgcaggccattagaaactgggtccacccaacatggcaattcccaaggccttcttacccttgcctcacatgttcctggcaacatggccgccccacatgtgtagaacatccccaaatatccccacatgtgtagaacatccatggctccctgcatttgcatattaaaagactagggtgggagagccagctttttagtgggctatgtgaataacatgcgtggtcaaaccaatcccctgagccctatgtaaatcagacatcgccccttccagcctctgcatatatacttggctggtgtccactgcacttggggacctcctcttttggctttggagcccccctccctctgtctccatatggaggagcttcttccttctgtcttctcccttccttcttgcctattaaactctccgctccttaaaaccactccacgtgtgtccatgtcgttttctctaattcaactcgagaccaagaaccctggtgttcctccactcatcagagccctgtcaactgggggccttgtttgtttagaagtgcagtttgttaatcctgaaattctagcttctccgtctgtgaaaatgcctgagggtttggccctgcgaggccgtcactcctgcatggcatcgacaggtgtggcatggccctgtgcgtgcctgagggtggtgggttgggtttggatcggggaaccgcctctctgaggcccatcgctgatatgctgggtgtgttatttgctgccttcctctggacgcagcgcaggtcctgccctcccggctcacctgtgagatagagcagaggctcgggctgctgggcaccctcctccaccctccatggtgcctgctgttccaggtactccccaccgccgaggagctgttctgcctgctcggtggtgccagggcggacactgtacttaaccagggaggtttgaggtgatcagaggatcccgctaaatgctggctgcctcactgcgtgtcatctccgcctggagagtgattattctgggctaatgtataaattgcagcctttgctgcctggtgccccagaatgctcattaccaggtgggctgcagaggctgtggctggtttgagtgacaaggcccctggctgccacagggactgggctctctgctgaggactggggccacagtggagcttcccctgcttccagtgctaccctcccttcagtgcagactccgtttctgccttcgttggccatggtgtgtgctgctcctgctgtctcagggagaggggttcaggcttacaagttggtaatcattctgctcttaggccacttggcaggatcccagcctggcaagactgggatctttgctgggcaggactcagcctggagcacaattggcagcagaagaaaaggggactgtttctcctgggggtggtctcctggctcggcccctgggaagaagggcacggagtggacacacccgggccaactgcctttggggcttctgccgggctgcccctcggaggccctggcctgacaatgccttcccatcctgtcgtgatctttattgtcgacctttatcccattcccggtggaatccttatgactgccctgttacaaaagaggagatggctcagcgtgctggtgtgacctgtgcaggtcctgcagccaggtcttgctggagctgcaattggaggctgagcttgcctgctggctaagtgtggcttctgagaggccgtggggcttgcaagtgggtctggtcatgtttggggctccagttccttctctgtgatgctgctctggaggccccccaggactggagttacagtgctggccactgtatctctgacactgacatgaggcagggatggttccaggaggcagattgtcttgtccaaaaatggccacagcagtgtttctggacactcgctgtctgcaggtgacatctatttcccttctgcctgtcccaggtctgggcctcatgacggatgtggcagtgttgctgtgtgacgtctgaggctagactgtaaactgcactgtggcttccacctggttctctcccatggggtacttgccctgggaacccagccgccacatcatgaggaagcgcagactccccatagggggaccccagccgccagcagcaccagccgccagcgtgcatgaggcccagccttccatctgctgaggtcctagatgtggagcagagctttgctgtcctctcggggctcggtccaaattcccgaccttcagagtccatgaacatgattggtggttttgcactccactaagtgttggagtcgtttattccccagccgttgtaactgggacagcagtgacgaagagtttaggtctgctttctgcaggaggattctcccagcatcccctctctacccagagcagagttgtggcctcagcctttcttgcaaggggcacgactcaggacgagcgagggcccctgtgccagggtacccttggctccgggtgacacctgcagttttgacctggctgccctctcgcctcctcatggccctcactgctggctcagagcctgttgacatgtcccactgctcagagaagtagctcagcagtcaggtcggatgcctcctctgtgagatgtggggatggacagagaaggagaaacagcttcagggagggtctgatcaggggctaaacagggccccacctggggtttccaggggtttccaacaggggtctcccctgttggaaaaggctgtgtacatgctgggcaggtcagatcaggcagccttggtcccgagggggcatctggccccatagctgagaggtagagccttgtgtcctgctgtcctggctccctaccacagccaccccgagcaggcctctccgttccactgtcctggagtgaccctgtctgagtctccacatcctgagccctcaggagagaaggctcagttgtaacagagcagtggtggcggggttgactatgtgggactggagctggggagtggccagatctgattgcgtatggctgcttccagccgctcctggaatcaatagggcaccaggagcgaggctgacgggagtacctggcctttgcaagcaaaacccaccagacttcacatttgaccttcagctcctcagcttccttttgagtccctatctgatggtttttgaaaatccatctggcagatactgcaatccaaagtcgcccagggaaacgacacccccgtctgcaggatctgccgcttcctgtggaaacggtcttgctgttgtcagggttgcagacgccaggggccgtgggcagcctgaagccggcccactcctcaccccaggcctgttctgggatggggagggtggtagctctgaatgcatttttattcagagtctctgctaacaatagtgtgtggtgtctttttgatgtgagagcatttcccatcatttttcatcggagttgggcttagtggagggtggctttggctgtgggcctctgtgagtcagcgccccaggcagcttcggagcccagagttggggagccagtttgaccaggtcgggggaccctcctggaacctttgtaacgcattccgtccccggctctgggtatgcagggaggggcgctcagccttcccagggccatacccacatcttgtgtgagagatggatgcgggtatggtgggagggtttgcacatgcatggtgtatgtgtggggggctgtgtgtgcatatggagtgcacacctgtgtgtggtgtggtgcatgtggaggggtgggtacgtatggatgtgatgtggagaggacatatgttgggggtgtgtgatgcatgtagagtatgttgtgtggggggggcatgtgctgtgtttgtggtgtgtagggtgtttgtgatgggggtgtgtggtgtgtagggtgtttatgaggaggggtgaatgtgggtgtgcgtgtgctgtgttttgtgtgtgtggtgtgtagggtgtttgtgatggggtgtgtgtgtggtgtgtaggttttttgtgatgggtgtgtgtgtggtgtgtggtatgtaggttgtgatgggagtgtgtgtgtgctgtgttgtgtgtgggtgtgtgaggtgtgtagggtgcatgtgagggagtgtgtgtgggcatgtgtgtgctgtgttgtgagtgggcatgtgtggtgtgtagggtgtttgtgatgggagtgtgtgtggtgtgtaggttgtgatggaagtgtgtgtgtgctgtgtgtgtggtgtgtagggtgcatgtgagggtgtgtatgggtgtgtgtgggtgtgtgttgtgtagggtgtttgtgatggggtgtggtgggtgtgcagtgtgttgtgtgtgggtgtgtgtagtgtgtagggtgtgatgagggtgtgtgtgtgagtggtgtgtaaggtgtttgtgatggggtgtggtgggtgtgagtgtgctgtgttgtgtgtgggtgtgtgtgtagtgtgtagggtgtgatgagagtgggtgtgtgagtagtgtgtagggtttttgtgatggggtgtagtgggtgtgagtgtgctgtcttgtgtgtgggtgtgtgtgtagtgtgtagggtgtttgtgatgagagtgtgtgggtgtgtgagtgttgtgtagggtgtggtgggtgtgaatgtgctgtgttgtgtgtggatgtgtgtgtagggtgtaatgagggtgtgtgtgggtgtctgaggggtgtgtaaggtgtttgcgatgggggtgtggtgggtgggagtgtgcctgtgttgtgtgtgtagtgtgtagggtatgatgagggtgtgtgagtgatgtgtaaggtgtttgtgatggggtgtgggtgtgagtgtggtgtattgggtgtgtgtgtagtgtgtagggtgtttgtgatgagggtatgtgtgggtgtgtaagtagtgtgtagggtgtttgtgatggggtgtggtgggtgtgagtatgctgtgttgtgtgtgggtgtgtgtagtgtgtagggtgtttgtgatgagggtgtatgtgggtgtgtgggtgtgtgagtaaataatgtgtagggtgtttgtgatggggtgtggtgggtgtgagtgtgccgtgttgtgtgcaggtgtgtgtgttgtgtagggtgtttgtgatgagggtgtgttgtgtgttgtgtgttgtgtgtttttcccagctctgccccactaagtgtccccaggatcgaggcttccccagcctctctggtgcctccctcccacgctccttgtgattggcagggtgtcgggggccctctttgccgtgcaggcctctgagaaggggctgaggagctccttcggctgctgcccgggtggtttgaggcactgaccctgggcaggcctggtcactggacctggtctccagcctcccgggcagcgctgttccctctgtggcccctgcgaggaagcttgctccgggagtggtctttgggcataggcacctgcgtcactgtggcgaggtctgcttttgtctctgaccagctaacatcctcagatggctgccggcttccaccgcagagcaaatgccgctgccttctgtggagagcagagtgagagtcggcgaggcagcattgtttgtagctgaaggcaggccgggccgcgggaaatggatggtgatggctgtaatttggccctgttacttattcattaatcgcatgcaggtggtcagccagccagcaagacctgctttttgaaatttcattttctagagggctcctcgtgtctgcactgtgtggcattaatttaatgtctccttcccacccgtggcccccacagttgctggcagtcactgcagagtgtgcagtcatgggctttgactccggggactgggaaaggcctctctcatccatgccagggcccaactggggtccctggatgctgacccctgtggaggacgagagcccctttgggtaggaggacttctcctctctcctcccaaagctatccttggcatttgaggggagtgtgtgtggggtgacagcagcttctctgctgacccatcctccccagtccagtaatttctttttcttttttttttttgagacagagttttgatctcatcacccaggctggagtacaatggcacgatctcggctcactgcaacctccacctccctagctcaagcgattctcttgcctcagcctcctgagtagctgggattacagccaccacacccagctaatttttttgtatttttagtagagatagggttttaccatgttggccaggctggtcttgaactcctgacctcaggtgatctgcccaccttggccttccaaagtgctgggattacaggcgtgagccacggtgcccggcctccagtctggttgtttccatccagacttcccatgcgatggggcctgacatgaagtaccgttgctggaccccagactccccacagggcagggtgcaggccctccctctgagtggctgcctcctgccctggccagcctggcctcagggagtccagagcccctcaggggcctctccagccagctttgcagggcttgtgtggccacacctcttcttttctcatcaaccccaccaaatcatggctgccaagccttcggtggctggtttgacgtgggagtctggcacgcatatcccttaggatgacgtttaaatggtttttactataattagcccccaaacatgaaaaataagtactatctaaacttaattatctctgccctttaaaagagaatgcaatgcacagttgccagaaaagctgcttgcagcttttcaggttgtatctgtcgaatggctcttctgttgagaaccagacctctggcttgggaggcgctttttggcaggaggggcgggaatgcatttcctggtggcttccctccgcacagttggggtgagttgggaggtttcaggcccataacgggagtggaagtgacaaggtcaggtgccacactgatggctgagatgcccctctgtagggcgctggcctcaaaatcagatcctttgtacttccccactctgccgtgaggttgccttccactcctgtcacagctggaggcaatgaagggagggggctagaggcagagctgggaacaactgagggacgcagggtgtttgttatggagccagaaagtccgagttgatgtgttgatcccagccacgcatttcgctgatggccctgccttttgtatttctgacacctgcttttgtgccgggctgtggggtcaactcggtgctgagagtgtggttgctcagtagcaaagggtctgtaggcttcccttgagccagctgcacaataagccctgcgtctggggcctccgaagtccaggcgaggcgctcgtcatcaattcgtgccccataactgctcgaggccgtgctaatggaggtgtcagaccttggccatttaacttttgagtcctgtctcaaatgcacaagtgaatgtgactgaatcatgcaaatttaattaacagcaggagcttgataccccgtgatcatttcagagaagccaaaagggagagaaagcaaagggcattgtgggctgcactgagcagtccattgattacggtgagaccagcgtctcccgggccctcagtgctccttgttgttgctccctgcagccgtccctgggccctgtggccagtacttcctggtttgggtggggagggaagtggtggaggactcagagagaggagcagattctgtttcctgcaggtgatgctggtccttagtgtcacaaaggctgagaatggcacataggacaccagttcaggagctcactcgtgaagttcatcacctccaagtcccaaggttctctccctccaccgtgttccgtggggttctccaggcacattatccttggcacccacaacacccccccccgccccccagttatccgtagagggtcttgactgcaagttgtccaggttgttgccattttgaacaaagaattggacaaaacacacaaaggaaagaatgaagcaacgaaagaatgaaagcagagatttattgaaaatgaaagtgcactccacagtgtgggagccggctgagcagagtctcaaggcctagtgacagaatcttctcaggtccagatacccccaggaggtttcccattggccacttggtgctcgcctggtgtaaatgaagtggtggcctgccatcagtctgattggttgtggaaagcaacctttgtaacttcacttctgcaaccaatcagaggctaaagtgaagttacaaagttgcgtttctttgcaaaccaagactctacttgcaatcagaggtactttcaatttcccatctgcctcaaaaaaaagggggggtttgcaaagggagcagcctctggtcctttgttacttaggtgtggaaagttagggttttcctttcaatttagttctaggaagtcagcatgaaaaagccctaacgcctcccgaccctattctcctgcctcaccaccaccccttgacagcccaggaaacaccatccagaaaccatctgctgtttttttgtctgaggcctatttgggacccagcacctggtgactgtaacactgtgaggtcacagacagctggagggctggagcacggctggggatagagcccgtgtgatgaggtggggcccaggtgtgggatgacataggaccgagtatgtgtgcgtcattggacttggctctcagtgtctcccctgtgcagtttgtgttcctttccccttgcgtaagctctgtcactaacagagacattgacttatctcctgaccaagagcctgggggtggtggcttgctggacccaggctggaggtctgcctagcacagctgtgaccaaagggcccatcaggaggtggacgagggctgcccaacctcatccattctgtgtcttctcactggcagatttttcaggggtaatgaataagcttgagtttttctcatcacattgagtaatactgatactgactttctaaaaatgctaatttttggctgggcacagtgcctaatgcctataatcccagcacttcgggaggctgaggcaggaagattgcttgagaccaggagtttgaggctgcagtgagctatgattgtgccacagcactccagcctgggtgacagaacgagatgctgtctctagaacataaaataaaatagtaataataataattattattatttgagatggagtctcgctctgtcactcaggctggagtgcagtggcaccatcttgactccctgcaacctccgcctcctgggttcaagtgactctcctgcctcagcctcccgagtaggtgggagtacaggcacccgccaccgcgccctaattttttgtatttttagtagagatggggtttcaccgtgttagccaggatggtctggatctcctgaccttgtgatctgtctgccttggcctcccaaagtgctgggattctgcggctgaccttaaaataaactttcctttaaagatgctccatgaagacctggcaggcagattgttttatgccacagagggacgggtgcactggctggctgccctggtggactgtctctggcagtggaggggatgataggggttttgtctgcaggggctggctgcaggtggctagggtcacggaggagcggggcttgctgaggaaagcagctgtggttcagccgtcactccatggcctaatggcctttgccctccaagtgtgtgttgggccgacctgttcggtgccgggtgctgggtgctgggtgctgaccgtgatagggatgggactggggctccatggcctgggcttggcaggcaggaaggtggccatgctgagccattaccaagccctgaccctgatattccttgtgcttttctttgaggatccattccaaggagcacttcaaggagaagtatgccgtggacgacgtccagtacgtagatgaggtgggtagccggctcctcctctgagcagcccagggcttccagcatgccttccactcctggagttcctctccttccactgccacaaccttgctggatgtcagggacactaccacctggccaccagtccctgcgccgcaggtgctcccatttggaaggagtaggcagcaacccatgcctcaggcttctctacggagccattgctttgcctgggaaggcccctgactctgtgggtagaagtgtctggtgacctgggttgtggccgctgagattacatgaggtgtctctgagaggcgggcctgcctgcagcggtggcacacggtctaagtcaccacaaggctgggccggggtcttcgtgtgtctcgagccctggttgactgcagatgccactgtcagaaaagcccgaggctgtgaaaggcttgtagagtagcattggaggtcccctgacttcaatccacttctcagtggggttgtccagcaggtgtcgtgtggcctgggtaggcatgtggctgtcctcttggggttttgaatctgtgccaaccaagttcaggcaggtcaaaggggctgccctgactcctcgactccagctctccttcctgccagtggggcagggctgggacagaggcgagagcacagctgggagcccctgtggtctacttgaccaaaggccctgacactaaaccactgcctggcacacaggaggcctctgtgctctggccctgggcgctgtcacaaccccacgtcctgtgcaggtcagtgccgtgtagaatgtgaagcacccagaagtcaatgcctgccactgggagtccaacctggacctggcagcatcagctttggacagggccatcctgtagccacatttccccagacagagattatgtgtcggccatgctaagagccggggctgcagtgtggaagtggccaggggagccagttctggcggccaagcagcttcccccttcccctgggcaggacacagcctggttgaagatgacggcactgggtgagaagcaggttcccagggatcatggccagacacagtgctgtgagagaccagttgtctctgcccagcatgtgggggcccagcccggcccatccagctcgggggtggccagccctctttgactgcaggtgggccagtaccatgtgcccagccctgcccccggtactgctgtcctggaatatgttttccatttctctgtctttctcctatccatcttttgaggccttgcaccagccttgtagcagccactgtatctgctgtagactctggcccacactggtgccccttccctgagccctcaggaccaagttgtggacaccatggacgctgactgtgttctgatgtgcaccctgcccttgactgtcttgtatttgtcttgaacgtccagttctttttccccagacattcctcttgcactctttccctgcccagtcccagggacatgtagggcatcagaggtggccgagacccagggctgacctcaacagcccagggcacagtccagtgcaggaggtgaccacatgagtgaacagtcaccgcagggtggtggtgcctgggcagagatccctggaagagcctctgtgaagggcactgcccacctctacagggccacgggggcctgtctctacagcatcttctgcctggttggactgtggagagaggaggcttttgatggatctttatgttatgttatttcaatcccaagcttttgggggtgactcttaacatctgaagattctgtcaatacacatgtgacctatcatattgatcccgttgagtacaggatctaaaatagacggaacgtttatttgcatgctcccaatgagaccatctgccacttgccttgtatgtctcagaagtggagcaggaggcacctactccttcattctcgttttccttccgaccctctccttggcagatgtgttccctgccccagaaactgtttcttaacactgttgtcctttgaaaccttgacccttcaggtctcttcgatgtgaaacctggaggggcagcctggggtgggccctgtctcaaggaccctggcgggatgggcacctgcctccaggaccctgtctcagggatcctggtggaacgggcacctgactccaggatcctgtctcaaggactctggcggcatgggcacctgcctccaggaccctgtctcgaggaccctggtgggatgggcacctgcctccaggaccctgtctcaaggactgtggcgggatgggcacctgtctccaggaccctgtctcaaggatcctggtggaatgggcacctgcctccaggactctgtctcaaggaccctggcaggatgggcacctgcctccaggaccctgtctcaaggaccgtggtgggaccggcacctgcctctgccctggactcagctgctgagtccgagccacctctggaccacagcctccccagccactgtctgacatttttgtctttataactgggggaaaattcagctccgtgtctactgtgatttctgggggtgaggaaggagaactggtctctaagcaaagtaagagacaggccaccttgagtgttagggcagggaagttgttaatggttgcacagaatgacagcacagagaccggctcattcttcgtcttcgtatacaaagcagattgtcgaggcttcagtagagttcaaaggctagaatctctttagggttcgggagcaccccaccgcaccccgtcaacgccactgccattgcagattggtgttgatgttactgttactgctgctgtttttactgggaacaaggctcacgttgacagcagagcaagcgcttcatgctggggcggcccacgtgggctccagtaacactagagctctcttggagccccttggccctcccgctgcgggagggacacagcggggcagggactgtgctgggccgtagcccccaccccgttcatagatatgaggctgaggctcagagagaaaggcctcgtccacagtcccacagctggaggggagtggtactgggatgtgacgccaggggcctcccctccaggcctccctttcccctcagaaaggagggctgctgtaggacactcctgtggaggcgacatggactccctgtgcctttgattttctgtggctctgaagggagcctgccaaaaagtgtgacttgctggactgaaccccctgagctgggaggtatcccaggttgcttgaggtacccagggcctgttgcatcatgggaggttacaggaagccctttatgcagggaaggggtccccaggctggttctgcagtgctcagccccatctcacttggggtggccttagctgtcagtgacaaatcacagccaacgcttgtctcctctgaaaaaaggcaggaaggcctccagtgccatggctggtcacgtgatagcatgtatgccatgcaggtgtctgatggggcacagctggctccgaggttccctcctccccacagaggatcctgagtttattgagaaggcagttcccctgagaaggaggcattcagcagaaccttgagtggggccccgaggctctgccgtgaaggccctgtgcaaaggctggcgggatcaccggctgagagctggcaggtgaagcgtgcgttccatgcacttgcttccctttatggcgccaggcatatgtgagaaggtccgagggtcaccaagtctgctacaggcaggacagatgtaagaggacaaccgcagcagcacagggacaggcatcggaagcgatggggtcagcaggggccactgtgctgtgggaccacgagcccatggctccaggaacctgattgttcaggagtagccacacatccagactgttggtgatgtttcctgatgtttacatttgagaaacaaatttgaaattgtaaaagcagtgcaggccaccagcgtgcaatactgttggaggagaatgccacgaaagaaggtttattttcaaaagcttcagtgattgcagggcagagccagctctctggagccttgcaggctttcccagcgctggcaaaggcatatccagcttttttgtccagcttatcaccctgcgaaaagcggccctcgggcctggtctgggccctggttaggaaagtgcaggaggtgtccgtgggaagcctctgattgtccccaggggaggatgtacacccacagggctctgatgaattctgcccgtgaccatccagctccatctgccagagaggccgggggctgccggagaaatcgatgctggctctggcatgaagcaaggcagggtcatttaacagcgcagggtgagagaggtccccagtggccaccactccgtggaaacgaggccctgagttgacagagccgtgctgtcttgtgtgctggggatacatcgggagccagcaacgcacagcgcgtcgtgttcccttaatatttgaggcacggagtcagggtgtgctgatgagagcgtagcactaatgggtctccatggggaagggcgggtggagctgccaggtcgggagaggtttttgcagccgcagaagtaaccagggcccactcaagcagttgtgatcaataaaagatgttgccctgccaggactaggagatgcacagcctgctctcagagtcaggcctggattgtctgagcaccgggctgcaaggagacggctgctctcccctcctccattattcctaaccagcatgtcctgagagtcgtcgcccggagaaaaaccatcagcccacacatttgttatcctgctcctccctcccaagacgatagcagatacaatccccaagtgcctcctggctttctgattcagctgctgtaattgacgggctccttctgtgcagctgaatgcagaacattcacatcaacgtaacaacacacctagggccggcatgtgtacccctgttccttttaataagtctccccttccttcaggaggggctgagggtgtgtagggacacagctgaaccttttgggtgtttttttttgttttttgtttttgatactgagttgcattcttgccccccaggctggggtgcagtggcgcagtcacgactcactgaaacctctgcctcccaggttcaagcggttctcctacctcagcctcccgagtagctgggattacagtcaccaagcccggctaatttttttgtatttttaatagagacggggtttcatcatgttggccaggctggtcttgaactcctgacctcaagtgatccacccgcctcagccttcccaaagtgctgggattacaggcatgagccaccacacccagctgagccttttgtttttttgcaacactgaggccaaaggacacagccattctccaagcagtcactcagtaacatgagggaggatcccgggagattgttgatacatgtctggaggatcattgggccaggagcatggtaaaccttgacaaagtctgtggcttttgacccaacagttttaaaggcatttaatttttttttttttttttgagacagagtctcgctctgtcacccaacaggctggagtgcaatggcatgatctcggctcactgcagctgccgcctcctgggttcaagcgattcttctgcctcagcctcctgagtagctgggactacaggcacgtgccaccacacccggctaatttttagtagagatgggggtttcaccatttggccaggctggtctcgaactcctgacctcgcgatccacctgcctcagcttccaaaagtgctgcgattacaagcatgatccactgtggctggctggcatttaattttaaggaaatacttgtatgcgaggatgttcatcacagcgttatttataattgctaattattagatgtaattttttttttgagacggagtcttgctctgttgcccaggctggagtgcagtggcgcagtcttggctcactgcaagctccgcctcctgggttcatgccattctcctgcctcagcctcctgagtagctgggactacaggcacccgccaccacatccagctaattttttttgtatttttaatagagatggggtttcactgttttagccaggatggtctcgatctcctgacctcgtgatctgcctgccctgtcctcccaaagtgtattagatgtaatttaagtgtccgtagaggaatgagtagtgtccattaagagagtattctacagccataggttcaaatctgggctgcgctgttattttttaaccagactcaggcaagttctctaatctgtaagccattctcatttgcgaaacctgcatgtttgccgcactgtctccccgtgtggttaaatgagatgctgtgtgtaagatgactggcacaggccgtcttcagcgacctactggacgtttactgtccccagcggtagtgactgctaaaaattgcatgtttgaagaacatataatgacaggaaataagtgaagcatgtaatttcatatgatccaaatgtcattacagatctctgtttttatgagcaaagctaaaatgtctctggagataggattgtacgtgcattttatctttttatagttttcaatacgttccaggttttcttgggaggcatctcagtattaaaaaaggtatatgtatacatatgtcaaaacttatcaaaatgtctatgttaaatacaggcagcatagagtatgtcagtgatcactcaatcaagctgttaaaacaacaacaagttctcctcactctccccctgcgtttcgggtgtaaagagttaggataggggtgtggggagaggcgagggctgtggagatgagactgttctctgcccagggggtgctcagaaacaagagggtctgcagtagccaagatgcaggccagactgaggaggaggggctggcagaggaagaaattgctcccagcaggctggttggcacatggcactttgctgggggaatggtgactgtcagtggggcagtagaggagggagtgaacgaacctgcccagggggctggggctttcatcctgagtgcacattgatgaggcactaagatgggaagaaggcactcagggagagataagagctggagcagaggcgtggagagaggagctggcccggcatgcagatgcaagggcttgggccgggaagtaactggcttgcagtggcaggaggtccaagtgggtcatggtggagggacagagagtgggctgtggggtgggggccagagggtgggattggggaaggccaactcccttgggtctaggggttgaatggggagcagggagggagtcttctgccctaggaaccagaggctggtaggcctggagcctaaagggttcccgggggacgggtctttgagcagggactttgcagatgggcagaggggctggccttggagggtgggtagggctggctgcttggagccagggatctgtgtggtgcctggaagcagggcggtgcggtgggaagcgagccaggtgtaggtttatcctctctgcccctcgatggctgtgtggctttcagaagtccttcaaccaggggaagctgggtttcttcacctgcagggtgagggcagcgcccacgtcgcctgttctaatgatctgcttgataaatgtgcactgtcattatgaaggaatggtggcatgtcatcttcattaggcttagtggtgcctctaaagtgggtttttctttccgaccttctagattgccagcgtcctgacgtcacagaagccctctgtcctcctcactttggtaagtggctggtgtccaggggtggggcagtgcttggctctggggagggtttttatgggggccacctctcctgcagaggtcgggcccataggggaggattaaaaaacggagaggggttgggtccaggggctcacgcctgttatccaagtgccttgagaggcaaggtgggaggatcgcttggagccaggagttccaggccagcctgggcaacatggcaagaccctgtctttacaacaaattaaaaagttagccaggcctggtggcatgtgcttgtggtcccagctacttgggaggctgaggtgggaggcgtgcttgagcccaggagtttgaggctgcagtgaggtatgatcgcgccactgtgctccagtctgggccacagacaggaccctgtctcaaaaaaagaaaaaaataaaccaagaggaatggtcatcagtgataagtagcgatacctgctcagtctgaatagctgtttatgggaccccatccttgagtctccctgggacctgctgtgtcctgtcgtgaggatgtgggcctggcgccacacccactcctaaggttaaacctggctagaagatgtatttgtgtcaggctgagctcctggaatttgtggatgtagaaagtcagtttaatgggtaccaaaatatagctaggtagaacaaatcagatctggtatttgatagcacaacagggtgactacagtcaacaataatttattgtacatttaaaaataaccagaagagtgcaattggattgtaacagaaaggataaatgcttgaggtgatggatagctcatgtatcctgatgtgattattccacattgcatacctgtatcagaatatttcaggtaccccataaatgtatacacctaatatctacccatgaaaactaaaaataaaaaatttaaaaaggaaaaaagaaagtttattcccaccctctgtctcccctgttaaaggggtctgaaaaccacaccaccgggcgtctgccctcaaggtagcaggggtgtggggcgcagtgactgaccgagggcctgggctagggtggggggtgcgaggtgggctctgggtacgccggcagggttttgggggcacttgagctgtggtgtgcccccaaagaattctctggaatttctcagagaagtgtgctttcttacacttctttgagcttgggagtttcatataagaggcatgtccacaagccttccccccaaagtgacccttccctcttgtctttttttttttttttttttgaaatggaatataaaaagtaaagtagaggtttctcttcaaagactttcctccccgtctaattagaaataaacagtaacttctcttagaagcaaaatttattcaaagacctgtgctaacattcttaaatatctgctagctgtaataaagaaatcaatatactttatgtttttagctcccacaatttaacctaaatatttgccctgatgtgcttatactggtccaagcaaacataaggtcatagcctgttcctcttccttatttaaaagtgtttttacctttctcagcattccacaagttacttcctccttcctttctccccctctacctttgcctcttttaaaaagttctaagttgctagccaatcgggacaaatacagaatgtggggtcccgttccaggcagtggaaaccggacacagcagtagggtggacacgccaggttataaacgaccctgtctcctttgtttggtgaactctcgtggcaaaactgctggagagtgtaccctttctgcaggaagtgaaaatggccttactaaataaattaaatttatgttcaagtgctatttctttatggcactgaagaacaaacatttcaaacatggagttttgctcttgttgcccggctagagtgcagtggagcgatcttggctcaccgcagcctccacctcccgggttcaagcaattctcctgcctcagcctcctgagtagctgggattacaggcatgcaccaccacacccagctaatattgtgttttttgttagagacggggtttcgccatgttgatcagtctcaaactcccaacctcaggtgatctgcccacctcggcctcccaaagtgctgggattacaggcgtgagccaccgtgcccagcctttctcttttcttaattgatttttaccaaaatagttatttcctttagcacttggccccttttttttgctttactgtcttgatggctataagggaaacttatgtgagatgattatggtcatagatgatccaatgtgttcaatttagatatacaattagacatcaagctgaagttctgggtaaagaaatggtgatttaaaatgccttgcccaggctgggcatagtggctcatgcctgtaatcccagcactttggaaggccgaggtacgcggatcacttgaggtcaagagttcgagacaagcctggccaacgtggcaaaaccatgtctctactaaaaatataaaattagctgggcatggtggtgcgcacctgtaatcccagctactcgagaggctgaagcaggagaatcacttgaacttgggaggtggaggctgaggtgagccgagatggtgccaccacactccagcctgggtgacagagcaagacactgtctcaaaaaaaaataagtaaaataaatgaaataaaatgccttgcctttctggagagggcccatttttctccaagtcccttgttttgtctccattcctgtccaagtcccatttggagtctccttggagttaagagagggatgtctccctgcttcacagcagtcctgccacagtcaggtcctgcacacctccccagaagggctgggttcgacaggactctttcggatgttatacagttagtggggagtgtgtgcaggagagggaagatggaccaggctggggagagcagatttatattgggagtggtcccgggtcctcgcctgtgcctgggcagcctggctggtttcagcagagtgctctgacctccatggagaaggccttgctgtgcagctgggatgctgcagagtttggggggcccccacttcctccacttggcaagtggtagcaaagaggtctgtccttgtgttggggccgggcctggagctacctggctgggtggctcatctgttgggggaaggcaggaggggatcctgttcttacctgtcctgagcctagctggaggcctcaggggtgcaggctgtgggggcgccatgcggccccgtgtgtcatgtctgtgttctctctccccagcgtggcgtcaacacggacagcggcagtgtctgcagggaggcctcctttgacggcatcagcaagtgagtcctgggcccccagggactctttccccaccatcccccactcccaccttcactagcaggtctttcccggtctacaaataagacatgaactatgcaaacttctttttaaggagtttgggcattttgaggaaatgtttagaagcataatttgccaaaaatcaccttgatttttcttgaaggaaaggtgccccgtgtctgtttgctccataaggaaagtgctcaggcagccctggccagggcaggggcaggggcaagggcaggggcaggcacaggtgggttgttttccctctaaacatctgctgtgagcccctgtggtctgtgcatcaagccaccaccccctttcttttatttttttattttttttgagatggagtcttgctctgtcacccaggctggagtgcaatggcccgatcttggctcactgcaacctccatctcccggattcaagtgattctcctgcctcagcctcctgagtagctgggattacaggcacccgccactacacccggctaatttttgtattttcagtagagatggggttttgccatgttggccaggcttgtctcgaactcgtgacctcaggtcatccacccacctcagcttcccacactgctgggattacagatgtgagacaccgtgcctgtcccaagccccctctcttagtcccagccattaaccccttccaacccggctctcagcagctcccctgtgtcccctgctgtcctaatcccaggcaggatccctttaacctcttctcactcttaaccaagcgccaggctgagcctccaaaccctgcttgggaagcggttccccttttctctccaggcaggaggacagaccttgggcacagggaaagacgcccctcccctgcttgtcacccctcacccacagcccccgggagagcctggagagggcgggagagccctgcccactggatgtgcttgggtccctggactggctggtgactggccctgggggtctgtggcctgcattgctggctgatgccatagcagacaaggcccctgcgctcgaggctgctgcacgtggacagtgggcagctcccagccccaactttgggacctggatccccagcccctcccctatcatgcatcccctacagcccccatgtcttctgttgtcctctggtggaccaaggcagtgatggaggaaccgccttataattatgtatgagcccaagctgctggaatctctgtgtgtgatgtaggggtgatgagggattatgagctcatgaatatgtatcacctcccacctccccctatgctaagagcagtggggcgggtggaggggcgggtagtaggtttgctttttcactgcacagatcttcgtgtcctcctgggagtttccccaaagcggccccgcctcccacgcctggcagcaattagcccagcttgttgaaatgctggccatggagctgctctctctccccaggcccccaggccctcagaggggctacgggcacagccagctgctgcctgtcccagtcccgggactccctgaatccccccagcactacctggtgctgggtctccagtgtcctgcacacctttcctcgaccatgccatggaacctctctatggcctctgtttgggtctctgcagcagggggaccctcagctcctccacgtgtaacctggtgctgcctgggcttgtggtgggcactggaggagatcatgctcacctggagcctggcacagagctggtgctcagtgacagttgcccgcatgcaaaccccagcaaatcccattgctcctctgtgcctcagtctccccatctgcgtggtgggccaggtgggctccaggatcaccaattcccagtttcccagatgtcagtgagtcgagggccttctcagcggtgagagctttgcttgctcctcctctagagagaatgctgagcccccctggaccacgtctggcagctgtgtggtgggtgtggttcccagccaggagctcaagatgtggcctctgaagcagagctctgccagctgctccttgaggttccccgaggaaggcaggtggggccctgggcttccccagggccctcatcactgtcagtgagtgtcaggaagcaaaggtctcgttctaccccccaggaggattcctaggtgtgacctctcatcccagtctctgtcacctgttgccccccagtccctgtggcctctgccaagagcccagaggagcctgtgctctgcaaactccccaccccaccctgtcaccactgggacactttttggagagccagggactgccttacttttgcaccatctccccaggcaccgggctggtacctctccaatctctgatccaggccaggctggggctgactggggggtgctcacccggcccctcagctgggggctgggctgagacactgccccccaccccgggtgctggtgcgtcagtttccgcacctacgccttgggctgctggccgagtctctgacttggctgttgcaatgcgcagcgggtgagaaccctcgtggccatctctggcctgcttgttctcctccctcccttccttgtcccctgcagggggccatccacccatgtctctcccctcggggccttccacctcactgccaccagggctgtttcactgaggcaggagctctggctggtgccccctaccctgcatgccgtgggccttgacatggggccccagcctttgcctccagctgctcccagccgcttccctgtggacagtcttgtctgcattcctggggtccaggtgcagctcatccccctgccttccactcacccaggctgccagcacttttgtgccgggctgggcagagaccacgtccccaagagccgctgccgctcagcaaccgcattcccctgcctgccgggtgcacctccagctgctagctgggatattaatagcctgtttcccaagcaagatgaatcttgctgtcgtcctcctctccaatacgcagctgcttccgccccagttgcctctcactgctctgatgaagctgcttgttcccggcattgtcctttttgacccttttaaatgtctctgcagcaccttgcaccttgggcttcgattgacctcctcctctaacagaagttcaggtttggcctcttggtttgacctgatgggcccccccagctccccttatcccctggcctgcagggaagaggagcttgtggtagacagtggtccccacctgtccacccagcctatacccttgggaccctggtccagctggatggttgggccaggacccctccaggtgtggctactcggggtgcctggcctggggtctgtcccatttgggctcagccttggtctcagacctccctccacctccccagatcagggccaggccgcctgctgcctgcagtaagagtgtgtggggtctcgaggtgtggggacagcagaggacaaggagcagaggggacagggcagaggtgggctgagggtggtgggcatgcacacggccagagagaccctgtggactgaggcccctgggctcacccagtgatgtggctcggtgtgatgacagtagcgtgaagggtgtaggccgggatggtctgtaggggcttgtgagtttggggtccggcccaggcagcagttccgtgtgtggcttgattggagcagtcccaaggaagatttgggaagagcaggctttgctgcgggctctggcaggaggggtgggtgtgggcatggggtcgggtgctcattgccaggtcctggcgggggcatgatggggggttggtttgggggctagtgggggctgagatggggaggggaaccctgcagcaagagacttgagacttcttcctgcggatggcaagataggctccctggaacacttggctcctgaaggctgggagcaaagtcagacatggtagatctctgaaaacatctaaggaggtagacgttagggcaggttttcctgagagcaggagactgaccatgaaggagagatggtctgttgggggattgttggcaggggctgggtggcctgagctgagggatgcctgtccatcaagtttccatgccttaacgagggtgccttcttggcacaaggcagtcgcctcccagacagacagaagctgtacccaggagccctgggccggggcagcgagtgacaggggctccgtttcctgccattgtatatggtcagtattttacatttcttacatcagtgtaagaaatacacttattcaggctaagtgtatttcttatctttcggcatttacttagatcaccctgcatatttgaagacaattggtaacgaattgattccatttaagcaagcagttaaagatgaaattctgaatttgggggttgttaatgcaggaatattaatatccgaagatgtgaattttaaaacccaggaagtagagggacattattaaaacttgacgattacagcaaaataccaatctgtggtttgaggaccgtggttttctggttactgttaacttggatatcaagttaatatttaggattggcttcttttttttttttttttttagacagagtcttgctctgttgcccaggctggagtgcagtggcacgatctcagctcattgcaacctccacctcccagattgcaatgattcttccgcctcagcctcccaggtagctgggattacaggtgcgcaccaccacacgtggctaatttttgtatttttagtagagacagcgttcaccatgttggccaggctggtctcgagctcctgaccttaggtgattcacctgcctcggcctcccaaagtgctgggattacaggtgtgagtcagcgcgcccagccaggattggctttctaattgtgacccatggagttctcggtgaggggagggaccctcaagaggtgagaacctgacccaaccctttggcagggagcagagtggaggggctgcctcatctttgggtgagatatgcccggaaagaagccagtggcctgggacaggggctttggccctctcatctcccagcccacatttagagctcatcaggaaattacactctgcttccagggcacgcctaccctcacaggcccagtgggatttcgttgatacttttacacgattaatacatgctcattgtagaaaatgctaaccagcatggaggcaaaaatgagaactatatgaattttattacccagggttcaacctgttaaccttgtcttttggattcttccgtgtgtgtctgattgtgtttctctgagtatatttttgtgtctgagtgtgtgtgtgtgtgtctatctgtgtatacacattgatctgtgtctgtgtttacctgtatgtgtgtatatcagggtgtggatctttttgtgtgtcttaagtatttgcctgtctgagtatgtgtgtgtatatgtgtgtctacattcccctaagcttgtgccttagtgtgtgtttgtgtgtatgtgttcctgttcatgcctgcctacatctgtgtgtgtgcatatacagtggggtctatctatgtgtgtccgagcatgcccctgttgtgcacatggctgtatgtgtccgtgtgtgcctcttttccaagcgtatgcctgtctctgtgtgtctgcgtgtgtgcatctgtgtctatgtgctgagtcactctgtgctgggtcactttgctgcttgtgtgcatgtgcacgtgtgtatgcgtacgtacgttgagtaagatgaaatggtggtggtgtgtttggctgctgagtagattggccactgcttttcctagggtcaaagtggcatttggtgcagtgggagccagagtctattttgtagttttgatttatgtcacctgctgccctgttcttcactttgaaccacactggctgcccgtagtctctttgatatttcataagtaaggctttgattccacaacatttaggttgactttgaatcatatagttctgtttgtatagttaaggatcctgaaagcttcagacatctggaatcctctcagtctgctgttacccccttctctcttctctcccctgtccctgcccctgttcagttggctcagctagaagggctgctggcctcacaaccatggcattacataggtgttttcaacaccattaacgaagccatggagggtccctggctggcaggaggacaggaggtcacgaccctgcgtgtgcttgtgtgtgctatccttccctaagatggggcaggtctttttttcttttttaaagagacaggcttttttaaagagactgggcaagagtcactcttgcccaggctgctggagtacagtggtgcaatcatgaatcactatagcctcaacctcctgggctcaagcgatcttcccaccttagccttctgaatagttgggactataggtgtgcgccaacacacccagataatttttaaattttttgtagagacaaagtctcgccacattgcccaggctggtcttgaactcctgggctcaagtgatctttctgccttggcctcccaaactgttgggattacaggtgtgagccaccacacctggctaaggagcaggtcttggaatccagagagttgaagtcttgccgaggcttctctgctgaggcctatagcttgtgctaggctaccttgttctccagcttgagctctgtgtcacacagggttctcttgtgtcagagatgtgctctgacctgatccttttgtctcctggggtcaccttttcaatgatgttcatcttatcgaagagcagcttttggctttgtagatttttcttatatggttcctttttatttcattgctttcttcaagggtcattcttaggatggaagtttagatcgctgattttcagtgttcttttctgctgtgtatgtttagagctatgagttttcctgtaagcactgctttagctgcatttctcacaggttatgatatttcatattgttattttctaatttcattgtatttttatctttgagccatggatattttttgatttctcatttaattctactgtgattaatgaatgttctctgcatctcagccctttaaaatatgttgaaacttccagcacgtgaccattatgataaatgttcacatacacttaaagaaagcatgtattctgcagttatgggccatagtgttctgtatatgtcaattacgtcaagttggttaatttcttgtttatatcttctatatctttcctgatttccctgcttgcttattctgtcactactactttgttttatggctgaaaaatatttttttctatggatacgtaccacatttcgtttgtccattcatcagttggtggacacctgggttgcttccaacttttggctgttcctgagtaatgctgctatgagcatagatgtcagacttcttgtgtgaacatatgctttcagttcccttgggtatatacctagaagtggaattgcagggtcgtctggatgcctttcatgtcttttcttgcctgtttgccttggctagaacctccagtacagagttgaatagaattggagacagcagacatgcttgcattgttcctcatcttaggggaaagcttttagtcttttaccattcagtatgctatgatgttagttgagggagttttttgtagatgctctttatcaagttgaagaagttcccttccctccctagttcattgagtatttattatgaaaaggtgtttgattttatcagtttatttttctccatctatttatacaagcatatggttttattatgtgttctattaatatgattgatgtgttacattgatttctttttgtatgttgaaggaatcttgtattcctgggaaaaaatcccacttggtcatgatgtatatatatcctttttatatgttgctggattctgtttgctagtgttttgttgaaaaatttttgtctctattcgcaaggaatttgggtgtgtaattttgttttcttaaggtgtctttgtctagcttagcatcaaggtaatactgaccttgtagagtggttgaaaagtattgcctccttttctgtttttgttgttgttgttgttgtttatttgtttgttttgagatggagtctctctatctcccaggctggagtgcagtggtgtgatctcagctcactgcacctccgcctcctgggtccatgtgattctcctgcctcagcctcctaagtagctgggattacacgtgtgcaccatcacgctgggctaattttttttatttttagtagagatggggttttgccatgttggtcttgaactcctgacctcaagccattctcccacctctgcctcccagagtgctgggattacaggcatgagccactgcacctggcccttttctggtaagagtttatgaagattggtgttaattctttaaacatttgatagaatttctattcatttcatagaagacatttggtcctgggcttttctttatgagaagttttttattacaaatttgatctcttgttaaggtctgtttagattttctatttctttcttttttttgtttttgagatggagtttcactcttgtcacccaggctggagtgcaatggcacgatctcggctcactgcatgctcagcctcctgggttcaagcaattctcctgcctcagcctcctgagtagctgggactacaggcacaagccaccacgcccagctaatttttgtattttcggtagagatggggttttgcaatgttggccaggctggtctcgaactactgacctcaggtgatctgcccgccttagcctcccaaagtgctgggactgcaggcatgagccactgcgcccagcctagattttctatttcttatatcaatttaatagtttgtgtctttagggatttgtttcaaataggttatccaatttgttactgtatgttatttataatattcccttataaacttttttatttctgtaaagtcagtagtaatttccccctttttcattcctttgtaaggtttgatacgtgatccattggttatttaggagtctactgtttaatttctacatatttgtcaatttttctattttccttatgttactgatttcttatttcattccattgtggtcagagggcatgcttagtgtgatttcagtcttttgaaatgtattggaacttgttttgtgacctaacataaagtgtatcctggagaatgatccatgtgcacttgagaaaatggctgttctgctgctattggctgagtattttagagctacgtgttaggtttttgatatacacacacacacacacacacacacacacacgctatatatatatattttttgaaacggagtcttgctgtgtcgccaggctggagtgcagtggtgcgatcttggctcactgcaatctccgcctcctcggttcaagcgattctcttgcctcagcctcctgagtagctgggattacaggcgctcaccaccatgctctgctaatttttgtgttttcagtagagacgggttttcaccatattggccaggatggtctggatctcctgacctcgtgatccacccgccttggcctcccaaagtgctgcgattacaggcgtgagccaccgcgtttttgttcaggtcttctgtttcctttttaatcttctgtctaattgttttattcattaccgaaagtagattattgacgtctccaactattgtcagtttctctctccaattttgttagtttttgatacatacatcttagggctctgttatgtgcatatatttgtaattgttttatcttctttgtggattgacctaattatcgttataaaatgcccttctttgtctttagtaaaactttgtatcttagggcttattttgtctgatgttagtatagccattctagttccactttcgtttctgtttgtgtagcatatcgtttctcatcattttactttcaacctatttgtgtctttgaatctaaagtgtgtctctttagagcatataattggatcatattttaaaaaatcattctgtctggcttttattaaaaagtcaaaaaataacagatgctggcaaggttgcagagaaaaaggaacacttacacactggtggtgggagtgtaaattagttaaaccattgtggaagacagcgtggcaattccgcaaagacctaaaaacagaaataccattcaacccagcaatcccgttactgagtatacacccaaaggaatataaattgttctaacaacacatgcatgtgtatgttcgctgcagcactattcacaatagcaaacacatggaatcaacctaaatgcccatcagtggtagactggataaagaaaatgtggtatggtatgcaccatggaatactatgcaaccataaaaaagaatgagatcatgtcctttgcaagaacatggatggagctggaggctgttatcctcagcaaactaatgcaggaacagaaaaccaaatgccacatgttctcacttacaagtgggagctaaatgatgagaacacatggacacatagagggcgacaacacacactggggcctattggaaggtggagggtgggaggaggaagaggatcaggaaaaataacaaaataactaatgggcactagacttaatacctaggtggcagaataatctgtacaacaaagccccattacacaagtttacctatgtaagaaacctgcacatgtacccctgaacttaaaattaaaaaaaaaaaaagaattcattcgccaatccttgccttgtaattggagaatttaatccatttacatctaaagtaattattgataaggaaaaactctaccattttaaaattagttttctatatgtcttataacatttttgttcctcactttctccattacatttttttgtgtttgattttttttttattgtcacattttggtttctcatttccttttctgtatgttttagctgttttcttaatgattatggggattacaattgactacttaaacttgaaaatctagtttgcattaatgtcagcttaatttaaatagcatgcaaaagcttgcccctatatgtctccttttcctcattctcttttgtgctgttatggcatgtggattgcgtctttattcattttgtacttatcaatacagatttacaattatcgctttattcagttgtcttttaagtcaggagagaaaaggagttacaaacaaaaaatacatttatactgtctttatatttatctgtatggttaccattgccagtgctctctttctcttcacgtggattcaggttactctgcagtaccttttcattttatttgaaacaattccctttggtttttctttcagggtaggtctgctagtaataaattctcttgggttttgcttatctgggatgttgtagttctccctcatttattaataatggctttgctggatatggaattcttggtggacttttttttttaatctttcagcactttaaatgtcatcccactgccttctctccaccataggttttgatgagaaatcagctaataatctaattgaggatcccttgtaagtgatgaattattaatacttttctcttgctgctttcaagatacttttttgacagtttgattatcatgtgtctaggtgtggatatctttgaatttatcctacttggagttcatggagctttatggatatgtagattaatgtttttcatcaaattggtgaggtttttgctttctctgcattctttccttctggtactcctattgtgtgtattttgatatacttgacacaagagactatgctgtctgcctagtggggatcagggctggtgttttgtagccataaagcttgctctccaactgactgcatttggaggacatggcccaggctgccaggtctgctgaaggaagggatcaacaggccttttgtgggtcaggaagtcatgaaattaaagtgtgggaccctctttaatgcatcacgtgtgcatgtcttgaatgaggtagttcttgctgggacatgacagaccgttggattaatgggcttgatttcttttcgccctacaggttcgaagtcaacaataccattcttcacccagagatcgttgagtggtgagtacggcctgtggtcaccttgcctgtttgttgtgctcggctcatggggatggaatgccctgttgttcctgcccacaccgtctcagagagcccctcagaaagcagattcccagaaccttctcccatagccttttctgttttgcttgttctttgttgttggttgactggccgtactttttttgaaaggacgtgagtcacttaaacatcagttaaacttatttcccttatttgcaatcttacaaaaactcctaccataagtaaaccaaacttagatagctccagcacgaggtagatggtgaaaagggcagaaataaacataacacataatcccattgccagaaaggtaaacatgtcacgcatgtgtcttgacaaaggtggcattctgttctacgcattcttctgtcaccttcttccttcccatggtgatactgttagcccttacctgctgcacaactggcttctactagctgcctacaaagtgagctgtcttatgctgggcgccacctctgtgggccctggaggtggccctcgcatcccagtgtgccaccagttttcttcctaagccatcgcattgctctttgacagcagcaaggcattttttctttgatggatggctgcacgtactgagaatgtagaagagaggcaaggccaggcctttgccacatcatcacttgccaaggagatgtgtagccttctcacatatgaccctaagtctgtatgatcacattttctttcctgtctagctgggagctctgactcgcctcgtcttagagcttgggaccaaggaggtatcctgaaagatgaatgggcatcggctgtggaaaaagaaggagtaggagagagtgaccctggcaaaaggaccactcgttcacagaaacaagagaaagggtggtggctctgtgtggccagtgcggagccagggagcagagcccgagaacagttggagagacaggcagtggctgggtgggccttggtgtccgttttgactttttcttgagaggaatgggaaacacaggaaacccttgaagggtttaagcaggagaatggtagaattgggtttgcatttaaaaaatcatttcgagccgggtgaggtggctcaggcctataatcccagcactttgggaggccgaggtgggtggatcatgaggtcaggagatcgagaccatcctggctaacacagtgaaaccccgtctctactaaaaataccaaaaattagcagggcatggtggcgggcacctgtagtcccagctcttagggagactgaggcaggagaatggtgtgaacctgggaagcggaggttgcagtgagctgagatcgcgccactgtactccagcctgggcgacagagcaagactctgtctcaaaaaaaataaaataaaaaataagaaatcattttggcctcagactagagacccagctgtagggcaagtgtgggaacaggtggcaagttaggaggctgttgcaggggtccagctggcagtggagggctgtggcaggacagatctgagtggtgaagccgcagtcaagagggaaagctcctgggagggaccggttatgatgcgtgagtgaagggcagagttgaaggtgactccaggtttttgtcccgcatagctaggtggtgtgtcactgagatggggacaactgggagggccagataccggggcagatctgggacttggggtgtgttgagtctgaggtaggtgccagtgggagagagggctgagctgggggtggagaactgagggccgatgacaggcgctaatactgaccctcggggttagaggccagtgggtccgacgcccctcacagccacactctgtgaagacagggctggtgttcttcaagttcacagccacctcttgtttttataaagtaacaaagccaagctggtggctcacgcctgtaatcccagcactttgggagacaaacacgagagaatcacttgaggccgggagtttgagaccagcctgagcaacatagagagatcccatctctacaaaaacaaaattttaaaaaattagccgaacacggcattggactcctatagtcctagcttcttgggaggctgaggcaggaggatcgcttgagcccaggaggtcgaggctgcagtgagccatgattatgctaccatactccagcctgagtgacagagcgagaccttgtctcaaaaaaataaagtaacaaatgcctgacttgtccgtaaaaggcaaatgattcataggatctgaagagaaaccagagagcctgtcctatctgtagcccccatttggcagaagaataaatcctgggtacttagaatgggccatgtccacttatactgcctcacatgggacattcccttgtggtcacttacagcttgggtgccttggagaccatggctgggtcctgtactcctgccatctcctaagggataagtcattaattcgtcactttcaaagaagcatgctttaattcaagtgacattttcgaggctttgaggtcgagcccgcgttcctaagcatacctcccaactttattaaagcaagcagcagaaagttgatggcagtagaaccattttagaaatgtcacattgtccctgctgctcaggggtatgttttaatagcctgggtcccagtcactctcggtgggtccactgtagtcatgatcatcacactccctggggcactgaaggaaggatgctgtgtggggcagcgggcgggtcctttattaacaggaatgggtgggctttccatgatgttagattacgactcagggactcatcttttgcccttaggtcttgaatgccttcaccaccctctctctgtgggagggttatggggataacaggaaaccatcaactcgggcacatgtgaattctagccctatctcctccctgctcaggaagtcacttgacttttctgagcctcagcttcttgatctgtaaaacggagatgtggtgaaacctaactcatggtacggatgtgaagattcacccagcctcagtttcctcacctgcaaagtaggctcaaagattgaatgagagtataagtgaaggactggcatgtctttttttttttttttttaagagacaggatctcactttgtctctcaggctggagtacagtggcatgatcgtagcttgctgcagccttgacctcctgggctcaggcgatcctcccacctcagccttccaagtagctgtgactccaggtacacgccaccacatccagctaatttttctgttttttgtagagatggggtctcctgtgttgcccaggctggcctcgaactcctggccttaagagatcctcctacctcagcctcccaaagtgttgggattataggcgtgagccaccgcacccagcctggcactttttttttgagatgaagtcttgctctgtcacccaggctggagtacaatggcatgatcttggctcactgcaacctccgcctcccgggttcacgtgattcttgtgcctcagcccccgcctccccactacaggtgcgcaccaccatgcccggctactttttgcatttttagtagagatggggtttcatcatgttagccaggctgcagcctggcacatcttgataacactgactgtcacctgttgagactccatgtgtacaaggtgttgtgctaagcacttaacacatgtcactgtatttaaagatatttgtggtgtattaggtaagtgttctagttatttccatgctacagatgaagaaactgaggtacagggaagttagtgacttgcccaagaaaatgccagttgagcccagactgttgatcccaggctcttgcactgctccttgcagctctgagggggcacccgtggagtggggctgcctgagtgtcagtcatcctcccagctcactgctggtcccactgaacgtacggtccagcacccttggaatggtcttgtgctggggccagggtatagtagggtggagaaccagggggcagatgcttggcttccttggcacccacatgcaccccagcttctgctagcagcttggctggggacacagggttcctcaggagcctgtcttgattggaaggcagcaagcagcctctcctagcacaggcaaactcgctttctcatttttgttcggctgtcattcatttccttcctgtgactgttttattgttttccattctctcaaggagcgcctttttgattgcctgtaaattcctctataatcatactcttccccacaaacatgagatcataactggataatttcttttcttgtgctgggtagtgcagtttgaatgtgaaggtcaaaagttgaaacttcaaaagagcaggcatcttacttccataatttaggctgtggttctgctttactgttttgcagatgattaaattgatctgaaggcaaggtgggaaataaaaggagatgctttcataccacctgatagctcagtgccttgggtttcggttaagtacctctggaagcgtcaggggagagcaggcgtgtcagcaattgccgtgtgccttcttgggttttaagcgagactgtgttaaattgagtcatctgccggttttagagctgttaattacacagaacgaaaagtgtcctgcatgcattaatcaggcggtgggtaacatgtctatttctgctccccggcctctctgtgtgcacaggagatgggaagctgtggttggttcacaggtagacgtgtcccaggattctacatcctgggtaacatgtcccaaattagaaaagatacgtagatgatgacctaaattctcggtgtgtctgtgaaaaggattccagtagcattgctcatctttgtgtcctcatgaataggcatttaaccctacgccagcaagaaagccacatgggaagtgggactcctaggggagagtgagaacttgagtcactgcgcgccaggaggcaggagatggatgtgggagcatcagacagaaggaaaggcgtggccaggccctggtccagcgtggaggtggacctctgccccacgtctgcccgtccctggctaggtttcaggcacactcagctcgcagctgagctaaaccatcattttcttcatggctttggtttcttggagaggacttattgattgattccccagaggatatgtaattccaaccagctcttttctttctgtccttccccttgtgggattttatcctttgcatcactgggtcatggagtgtgggagggatagttgttgcgggttcagtggtgttgaattcccgcccacctggctccaatagaatcattccctgcacatccatctccaggagagatggaattcctggccctttaaatgagttttgttcaacacggtgccactttgatgcttagaggctgattttggaaatccttcatccttgtctcactactattttaatcagtggagtgtttagatctcagttaattgatatcttaattcagggtttaatgctcagaggcagtgctgtgacttgtgaatgtttaaggaaaaaaataaggttgcacaagtacatctttgcctcatctactttttgtgattttaggtctgtagcaggagagtaggcctacatggggtaggagactttgcctcccagcctccctgtctgtttgagcagcctccaggcatgttgatgcccacagcgtggccatgagctggggactctctgtgaggctgtgcagtgcccacatttcctggcacgttttttcctggccaaagagcctgagctgacttctgccccaagttctctttttagagacagggtcttatgctcttgcccaggctggaatgcagtgttgtaatcatggctcactacaacctcggactcccaggctcaggtcatcctcccgcctcagcctcccgagtagctgagactacaggtgcacactcccatgcctagctgatttttttttttttttttgagatggagttttgttcttgttgcccaggctggagtgcaatggctcaatcttggctcactgcaacttccgcctcccaggttcaagcgactcttctgcctcagcctcccgagtagctgggattacaggcatgtgccaccatgcccggctacttttgtatttttagtagagacggggttcctgcatgttggtcaggctggtcttgaacttccgacctcaggtgatccacctgcctcggcctcccaaagtgccgggattacaggcatgagccactgtgcctggccatctggctgatttttaaatgttttgtagacacaggttatcactgtgatgcccaggctggcctcgaattcctgtgctcagccttggccttagatcctctagccttggcctcccaaggtgccgggattacaagtgagagccaccatgcctggcctgctcaaacttcttaggtggcatctttgtcatcctgtcctgagccatgattctctgttgcttcctggaggaggtggcctttgtcctctcatggggctgtcagccttgtagatcatacttctaacaaccaccccacacatcccctggggcagacaaggctgggactgagtgtgaccatgcatctctcactccaggggccggtggacccacggaggctggggcacccttttgtcctcatctgttcatgctcaagaacactggaaatgggctcatcatattcagggtggtgcattcctcctgaagacagggagaaactgcgcggaatgctggaaaatcctgttcttttctacagttatcttaaaaacagtttctggtgtttgtgctgtgagataaccaggccaggctggggtgcatccctctatgcctggcgcctgggtgagacttcaggcccagagtgccctacggataattggttaagccagcacacagcagacgtctatttaagcatagattcaattgggccaggccaaagcccagccaggctggtttcatcagagaactgcctttgtagaataatttgccctggttcagtttgattttttttttccacttcccccaaagtaagattagaaaagcaagtaggtccctgggcctcgatggcagagatgattatcacctctgctgggaggaggatgtggtcctttctcctttggcagattacgacctcttcctgctcatcaccataggaggatgccccagctgcagtgggaggcagagtggagagcctgggagtgtgggctcctgtggtccaccctgggctgctcttcctacctgtgggactgggacgaggcagtggcagagggattttgggctgctggagcctgaggaggctttgcccctgctgtgcccggtttggcaacatcccatgctgccatggggtggggaaggttgggtggagaggcctccttttctctttgaaatgaggccatcagctctccttgttggaaatgagctgttgtctggcttcggtggaaggacaggtagctttgatgacacatagttactgtgtgtctgtgccggtgctaggaccctgtcttccaggactatatatggcctttcagaagagacttaaattaaaagaattctaagtgttagaggtttctgaggattcgtctagactacccagggaacacagagaagggatttagcccagggtgggagggtagaagggggtcgtctccgacccctagaaaagtgtgtttcgggtgggtgctagaggtgggcaggaacaagttccaggcagaggagggaggaggctgggagagcacatggggtgagtggtggagatggcctgcacctacgtgagttgtgctctactagaggtttaccttcatcctgaggccactggaaacctaaaggccactggaaacgaggggaagcctgataaggtttgcatttcctaaagatccccagctgctatcagggcaggtgggctggaggcctagaggctggagggcttgtccaggccagagaggctggggctggatagagagaaatgggggggcctgagggaggtcgtggagggggagtggcagcccttggccgtgaattggatgtgggaagcagcggatggatgtgatgggagagggcgtctaggatgacgcccgggtctctgctgaagcagcaggaagatggcagagcctcattgagatgggggcacggtgggggttctcgcacactgagctccagggcaccccaggacccacaggtgggtgcagagggaaagcagggagaggcagagggaaccacgccttctgcgagaaggggaggggagggctggcagcatgatgggggtgaagagagaagcaaagaggggagaggagaggggaggagatggggaggaagttcaaaatagaacgcaaaagctgctttccctcctcccccaaggcaaggacggttagggcctggcaggcagcgtaggggaggcttgactggaagaggagaaggaggcaagtgaggggaggattcttcacttgtagaggaagctgtttcggtggccatggagcttctagcaggagctggtggaggttggagctgggatccccaggtgggcgtgtgagcttgggaagaggatgcaccttcccttaaaagggagggaggagaggacagatggggagtcctgggagtttggaggaggagaggtgagagtggacccatctgctggctgctgcgcgctccaagaagtaggagtggaattcattcatctgtggcggctcccgtggggggcagaagttgggggtagatatcttcggaaggtgcgggaagttgagaatagccctcctgcgggttcccctgcagctcacggcagagctggggcctcgctgaggtgactggggcttgcttggccattgccagtgcatgacttcccctggcagtgctcagtgctcctggagcaggcacaggccgagcctgtggggatgggtgggcacagggctgaggagtctacagcactggcaacagtagtggccatagagaagggccagggatctaagccgaatgaaggcagagggcggctccaggagaaagtaaggggttggagggcgggagatcctggccctcacccatgctgtcacccagtgatcatcactgcatttgagagaagagagacctgctccctgacagcgggttccccgggctggcgtcatagagggtggcagtgggaatgacacctgagggaccacaagtgggttcggacctcgggagcctgagctgctggcccctgtcctgcccatggctctgaactgtcaccctctggggacaggagcaagtgcctggtcccagataatgggactgcacccgccatacggcggcatcagagacaccttcatgatgattaacagcatgctgtcaggctttagggctgcctccgccgagagaaagggcgttcattcgagaaagtctccctgggcttgtgggtttgttttttccacattccccagaaggttctgtggtctcgggaaggtgtcgctgcgctgcagggtgcccgcctcgtttcccagtgacaaatggctggctgtcccagctgtgcagcgtcacggagaccgtgtgagtcagcggctggctggcatgggctgctcccttgaagttcccaagggcttgctgcctctgatgggagtgggggagccaccaggcccctcgcattcccgccatcctcgcctgcctcggggcctctgtctgggctgcctcgatggaggccagctcaggtgggctcttggccaggccgaggaggaggaagaggagatgcaggagaggtgccctttgacagaggagcgagtgctggtctgcgtcctcagacaccccagctttgctcccaacagaggggtgggtgctggtctgcatcctcagacactccagctttgctgatcttgagagtgtttgcattgatacctttgtgagagtcacgggtgggcctttgggagctttggtgcaggtaggtcatctttagtaaaggaaaaggagctggccagggggtgcaccgggaactctctgccttgtgcagagggactcagctgggttgcccacctccattctccaggtctctcagtattacagacctccctcaccgggtggccagccccaaaccgaaagggctcgtgcctctccatcattccctcacatagcaccccggctcctgctcttagcagccctccttccactccatcattgtgtgtttactcgcgctgtatccgtctctccatggtctctgcgctccattaggggaggacgtggccctttcactccactccatcaccggtgcctggtacatccagctaacacttacttattagtgatgtgaaatgaatgaatggacatttaccattatggacagcacctcattaaggtttttaaagtgctatcaaagcaatatgtacccttggtttaaaaagccactagtacaaaatcagtacgggaaagctaggttatcatgaaaccagcgactcctgccagctcatctctctccacaccacccctccccaaagcgaattctttgggccatttctgtcacctccacccatcttttcatcatatgtttattgctggttcttccatgggttccatttgccttcttgtcctacatttgagcctcctttagttcttgctccgtgaactttccaccccatcttgcctttgccctgggtgagctgaggctgcacagatggggccctgctctctctacacatcttttctccaacccgtctttacctcccgacttctgttgctgtttccttgttagggtttgtaatatttccattgcatttatgtgagcagtaaatcttacctgtttgggggagacattaactctaaaaggttaaaaaaaaaagccataaaactgtgtttctatgatgactgtgaccgtggtctatgcagaactaaggaatgtatcagggcgggagtgccttctctttgggtcggatgtcacaagcccagggcctccctcaagaggaggctcctagcatcaagagcacataaactgtttttctttttctttctttctttctttttttttttttgagacggagtcttgctctgtcacccaggctggagtgcagtggcgtgatctcggctcactgcaagctccgcctcctgggttcacaccattctcctgcctcagcctcccgagtagctgggactacaggcgcccgccaccatgcccagctaattttttgtatttttagtagagatggggtttcaccgtgttagccaggatagtcttgatctcctgacctcgtgatctgcccgcctcggcctcccaaagtgctgggattacaggcttgagccaccgcgcccggcctagactgtttttcttatataaccaccagctatacaaaatcactccatattttagtttattctctgtttaaagaatggtttttttattagaaaaaaatttttatttcttttttttttttcattagtacaaaagcaacatatatacatgcattgctgaaagttagaaagttcacataaacaggaattcctccagttgtccataagacatcctggacgtggccaatatagttctatctcttacctgggtattgtgatggttttccccccagatactgaaaggctggaccagttgtaccacagcatcccaattctggatttgtatggttgttcgcttgtgttggtggttagcttgttcttctatccccatatttcctgcaaactggaagttagatctaaagccatagaagtttaaaacatttgccagaatacatcccaggtgatgtgtatttcttattgcactgcattcagacacaaattatacttagttgacccacaatcagtgatgctaagactgatcactgggttacattttcccccttgacctggagagtaatctacctggtgttactttggtaccatgtgaataaatgcagccttcatacatatatctgttttgttttgttgttcctagagttttaatttgcctttcgtctttcttattgagagaagaaacatatcttcttcaccatatcactaagagctttaagcttcctattgattttatctgcagaaaggaatccatgccattctttttgtggatgtttttctcagagccacatacttggagttctaatttctactgattgctttctaggcttgctgtccagtgtctaattatacttttggattgactccagtttttaaaaatatcccattatatcacctccttctctttattggcttgtgctttctccctctccccacccttctacccttctctctctgctggagtacatccttaagtacttccccaatttctgagtttttgaatgtctaaaaaggactagtttccttctgtatttggttagtagtttgtctgggtgtagggttctataatttttgcatggagtgcaacaaaaagggggtgagtgtaacagagtgggtcatgcgctctttgacattgtctcagttaagtctcagtgtcgctatctgtaaaatgggaaggtagtacctgttctaggttgggttccatgggaagctgagtctgtgagccaagtaggcaggaagcgtattgaggagtgctctcaggatcagcgtgtgtgtcagagtaagggagcaggcttgggctgcgatgctgtcacaagggcatctcagctgctcccatggggagttttggtgctggagtggcccccagagatgtccccagctgaagcgagggagctgagtcttggctccctccatcgaatcaaggagaccagtagaggggtgtggcctcaggggatgagttgggcagtgcacccagcatccactgcaacttacaggacccaccatgcggcgggtccccagtaaatggcaatttaaagtgaagggaagctgcgtttgcctgctgagatttctctagctttgtgggcctgtcatgaatactggggagtaatgttttgatgagaatcaagatgtcctacctaaggacatcagagcattccacctggctttggggtgggaagtatggatgacgtggtgtctgcaggctttgcatttcgcttggtttctggaacaagtgtacacagcacttactgtgtgccaggcactgtccttagtgctttaaaaatgccaactccgttctcactgcaaacctatgatgaaaacagtgttcatatctccgtttttcagatggggaaaccgaggcacagagtagggatcttggccacaccgctgggaaggggtggagctgaactggagcccagggcctttctcccaggccggtgctctgaatgcctcagcatggctgccctttctgtgcccgcggacccagggtttttttaaatgggtggaggtagaaaacgaatacttatttggctcctctctgtgggtcttactcgcgggtgagattgattgcaaccaccagaaacctaaccacatttgggcaaattaacacaagtttgttgggaggacctggaagcctcaggagtccagttgcaggaggcacagcccagccaggaagggacagcagggtccctcgattgtgactcccctgcccacgtagaccaccctctcatctgtggctgcctccctcttctctgctcctggtctcctgctgtgtctgctgtccagctgtttccacatttgtaccagcacacacgaaactggaatggcttctgtcccttcacctgaccctgtcacccacccgtgggcaggtgggtgggggtggggaggaaacgaggcctcttcagccaacaggacagagccctgggaggcagcaggcttaggattatggcccagtagccatgccatgtagatttcatcccccttcccatgcatggggaaactgaggttgagggaggcagcctgtgacaagctgcagcaaccaggcttcttctcccaccgcagcggcttccagatcttatccctggaaacagtctgcccgctggctggtgttagggaaggtgggcagcagctctgctccctgctagaggttttcttctagactgttccatggagcttgtcactcctgggccttggtggccccactctggccttgcacaacacgccttctgggctgtgcagggtgtggtaggccctgagctctccctggaggggtccagccagtgcctcctgaaagtcactgatttgctgctttgttcttctgtctctgaagccgagtgtttaagacggatatggagctggaggttctgcgctataccaataaaatctccagcgaggcccaccgtgaggtaagtcaggcaccggctctggttgagtggggaaagcagtgttgctgtgtggcgagagaactgcgtgaggatgaagggtttccaggtgggctctaatccctgagggccaagtgagaggtaggaagttttacacagtgattgttctcttttctgttccctggtgggcacagggcagggacagaaggggctctgccccaattcctcagcttagggcacctgcccatcatgcagtcgtggacactaatcctcaggaaattatccaacaaaaagtcccaattctgggagggtagagtgctccttcttcatatcccagcagttctcagctcattttaaagaatcttttgtccttaactgtggttcaaacacactgattaccatcatccattttctgaaaatttctcttccaaaccttcccgctttactggaggaatgagaccaaataaggaaacacatgtcttgaaagatgaggatggcccaccgtctgctcaggaacattgcagttttgtgttaggaaacagacaagggtaattgatgggcagcgtactctgttgtacgagataatgctctccgtgttttatgaaagttaaacaaaggaggccttttagtgatcgtcatagctttcgtggcattaagtattcaccaagcacctcgtggttaaatcctcactgtcctcgggctgctggtggcctctgagctgtaacttgaggcatggcatttatcggcttccaaatggaagtgcttcatagcagtttaaataaactgtatggattttggagcttttaaaaagttctaatttgtcacatgtctgtaccactgcatgcacatatcattctttttttcctttttaaagaagaggtgcttttgaagaagtgctgtatgttatttatcacgctgtgttactgatctgcttaatacaaatgtctttgcttaatatccgtcctccaggtaatgaaggctgtaaaagtgggaatgaaagaatatgagttggaaaggtaagccaccatgtttctccgggtaaaattaaaaggtaaaaaacagtaatttatgttccctgagtgagtaacagatgagacgccgcagtggcacacacaccgtgagcggagattatgaacagggcttcaggatcacaagcaaagattatttttcttccgactgcgcccgcctccctggctcttggcagagtgtttgatgtaatggttttcgatgacttttcagggtggtttagtgccccaccattctactctcggactttgtttctgccatttgcaggaaactttaccaaattgctgctcttatgactctgaaagccgccagtaaaacagcttgccgtttttatgtgtaaacactgccattatgtctgctgtgctcgggcgactgggttgagggatggttaaatggcccataaagagctctggagagctccattggccttctgctcctattagggctgcagcgagccagtggcacccggggagcttccggcggctgcccagccgtggcgggtgtggcctggccagctcagccccgctccaggacccagaagtcagtgtgctgccacccatggtacaaggaaacctttgggtcagacccaaactgcctcagtggctcccttcccacccgtgtcctggggcaggaggcccccattccgagacctcccaccagtgttggtaccacctggaagctctggggaggtgacactgaagaggctgccatccccatgtcctcactctgggctttcctttcctgcctgtccttgtgagagcttggtttctggtatcccttaccccccttgcagggcccaagtccaccccagatgtcctcagggcctgctctgttcagagccccggccctgggggtgctggctccatatcaccctcccaggctggcctgcctgccatcagtggggtgcagggccgaggtcggatggggcccgtagtgggctgcttggatgcttcagttcgctgtggctgtgcttaggggacgagtgtctttttaaggtcttgccctggaaggagttctgagcagtcagtgcctgtgcttctctccttaccccgcccaggaggaggttaaaatggcctgacccaggtgcttggcatcctgggaggggccgtgtaacacacgttaatcagaagcccagctccgtcagccggggaggctgagaagggctcgcagagctatcccagcacttgcgtctgcgtggtctccttctgcagtgcggtgtctgtggcccagcattcccaggaccccctgcccgctccgaggatctgggatgggaagtgtgttgtggggctcctccagcgaggtgggctggacagtgggtccctcagattggcactgccccggaaacctgtcccagcttgagttgaatcacagtgacccatagctgatgcttcaaataaaaataactgagaaattggggcaggaatagctgagcccagtgtggaaccctgccgtcctctgcatgctggctgcttgagccccgtgctgcaggcagtcctgctcccaaggtggctactgggaggggccctgagcctccctccccacagcgtcccagagcccgaccctgcccaacctggggacagggctgcatgggctatgggtcaggggccaggggacctggaatacccgccgttccttagccctcatgccttccaggtaatggaggtctttttttttttttaaacaggaaatttcaatatccaaaataatagaaaagtataatgaaccccaaagtccccaccaggtttttgtgtttagttttgtttgctagagcattttaaagccaaatcctagacatcgtgtcatagcacctgtaaatacctcagtaggtattccagttggtgagaacttttttctacttttacataaccaccatgccaatatcacattcattatcacaaacgaaccgtaactccttcatgtcatgaatatctagtccatattgatcctaaactctttttagcattggtttgttcaagtcaggatccacacagagtccacatgttgtacttggctgctgttggaagcagggtgtcgtgaacctgagctctggggagatgtcacccctgtctacaaactgctccaccttccctccacccccatcccaagaccctgggttggccttgctgccgcctcctgcgtggaccagagtggctcttggagagatgagctcgaagccagaggccacagccgagtgcaccgggaagctctcagccaggagcagcctcccacagggtgctgagtggcatcgggtcagcgtgtgtacctgctgcccatgctgtgcacctgccatgtgcacccacctgctgcaggccacaggacatagggaggggaaaccgtgcccaccagggaagctatctgatctgtgggcccctgagagcttagagcaggggggtgggtacggggactgagacaggaagaacaagagatggaggctgttcctgaggggaccgagttgggagagaggggtcaccccctctgaagatggtgggaagatgggtgtctggggaaagtgtcacatcatggagtatccctggccagatttgaggaggcgccccgattgccagtgtccaggttgaagcccctgggacatctgcagccagggagctggcctgacacttcttccgcctcgagctccctctccagggcaggatcactatgtgatgcagttttgtggtccttgtcctggagagcctggaggcgccttcttggggaccatgtctcatttatctgcgcggtgtctgacccactgtaggtgtcgggaaatgtatgtgggtggaaaagagaagaaaaggttttaagtgatttttctgccatcttctgtgtcactgggaacttgagaattcttttcttaactagtcggggaataaaaatctcttctaaagcccgtgtttttggttacccgggggtgtgcctctttgaacacaggctcaactgctaccagggaaggctggggggcagctgcactgctgtgtgaatcgctgactcactgggttcaaaggaaaccagccgctcttctatatgtgttgacagcaccctgtgagcaaggtgggcatccttaagacctgctggactttctgctgggggcctggctggcttcagccttgcacagggacactgggcatgaaggcagggagctctgcagttcaggactcggggcaggagtcagggctggttttctcgaaggtggacacaccacccaccccaggactcaagcgatggtggcctggacctccagttctaagcctcatctgtttttgttttattatctatgatttgttataaaatcttgaaggcatgttaaaaaaaaaaaagtgagcgagcggatggcatttatgaagactcctccctcatgcggcgcctgggagttgagggttcagaggaatgaaaatcattttccgcaattgaggtgtagtaaattgtgttaaaccaataagacgtccgtgttgggtaaattgggctctaacagcaggcccaatcaggccatccgtttttccgcctcctattatttcatgttagtggcgtacccagcttgtagccagctggcgtggggctggcggccggatccattacctgcaaacgctaatttagagcatgctcccattgggctgtgtaagcgagtccccagctcacatttgccacaaggagattaataacgcgatgtgtatgacagcctgagaccttgattgaaattatgctctttctctctgagctgtgaatggggcatttggggcccttttgtttctggggggtcatgagaatcatgggaaagggagagatctgtgtagtgtgacgggtaccgtgtggtggcgtccccttccaggcctaacccagtggtaccacatgctcgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaatcacttgacctgggaggtggaggttgcagtgagcctctgcattccagcctgggcaacagagcgagactccatctcaaaataagtaaataaaaaagactagaaactttgactccagtaaggacagccaggaggtgggagagtctgtgggcagcccccctcatccctgccagcccacagtgctcaggactgcagggggcgtggggccgcagagaggacgcccctctggggcgatctctgcttgctgcaatctctgcctcccgggctcaagtgatcctcccgcctcagccccccaaataactggcaccacaggtgctcactaccttgcccagctaattttttatttttcgtagagatagagttttgccttgttgcccaggctggtctagaactccagagctctagcattcctgctgccttggtctcccacagtgctgggattctaggcataagccactatgcccggcctggcaccctctgcttttcatccgagtccctcctgtgcagcgactcctgaagaactgtatctcggatgcctgtgcccacatggtcctcctcccgtgtggggctacacgaggctgtgttgccgggcactctgggtggatggtgagacaccttgtgtgtctctgaccagggctggggcccctcacagggcatgcagaggacgcaggtttcactggagagggaagtcactaggaggtccccgtcttcctccgggaggtcctggagatgcagtctccatcatccaggcacagtctgacctaatctgctctcagcctggacaaatgtgggcatcagtgagactgccatccatttagccacccccacaaagggtgctgcagttttgaggactgtttggaacaagtctgggtccaggcggcctctgagaccggagcccccaggtaagaatggatgtgatgggccctggggaccagctgtgtgtccgtgggcaggaccctgcacccgctgagcagacacatcctttctctgaaggctgtgttgatgggtgagggcactggcacagcccattcagagaagagggccccttcagacacaggtctgggctggagaaacaccctctttgcctcaggtggcttggagtaggtttgctgctagcacttgcttggctgttggagacgggccccagcctatcatgagagcagtcaggaaacaccatctgcgtgtccaagccctaggagggcagtccttgagtcctgcaccctggctggccatgcctagggggatttaagctgagcccttcccaagagccagggctgtcttgggtggagaattccttagtccagagcctaccctgtgctggcagggcaggtcctgtgtgcccgtccatcctgctgtgtctacaccacttggcatgagggagggagttggggacaggcgagtgtggagagtctctccaccagagattcgacagagccagggatccgagaatgaaactggggctctcagcggggtcaggctgtgggaccctgtggcttaaagcagggatggctcattttgcctctaggagtaactgaggaatgggcatgtggagaaaaccaacttggtgtccagccagaaagctggacagagaaccagagagaagagctttctgcaaatgtgtaacctggtcgatgaaggactagagattttggggcaaaactaacataaataggcattgtcttttcaaatgctgggcgcattgctcctggagaatcatattagaaatcataaggaactgtgctccctgtggacatctttatggattttcctctagtgtttcaccattaaacctgatattgccaggcatggtaattacacactcatgcctgtagtcccagcactttgggagtccaaggcaggaggattgcttgaggccaggagttcaagaccagcctgggcaacataggagacctctgcctctacaaaaaaaaaaaaaaaatgtttttaattagctgagtgtggtgacgcacccctgtagtcccagctacttggaaggctgaggcaggaggattgcttgagcccaggaagccaaggcggcagttagctatgatcacaccactgcactcccatctgggcgacagagtgagactccatctcttaaaaaaaaaaagagaaaaaaaagccaaaaacctgatgctgactgttgatttcagataaatatttatcacgagtttaaggaagtagcattgtcttcctggcttactagattttatcaggaaaggatgtcgaattttatcagctgccttttcagcatctcccttggccttttccacgtgtgtgtttaatcagtaaactttttattttaggatagttttggattacggaaaagtcacaggaacattagagagttccatgtacctggcacccattttccctattatgtattagtaaagttattaacattactttagaacatttgttaccatggatgcacgttattgatacttaattattatcttaagtccatgctttattccagcggccttagcttttacctaatgccctcctcctgttccaggatcccatctgggagaccatatcacgttccattgtcacatctccttagcctcctctgggctgtgacagtttcttagaattgccttggttttgatgaccttgacactttcgaggagtatggctaggtactttgaagaatgcctttcaattttagtttttctttcagcgagacaggagttatgagttactgggaaggagagcacagaagtgccattgtcatcacatcacatcagcatgacttatcactgatgatgttgaccttgatcacctggctaaggtagtgcttgtcaggtttctccactgtaaagtcactcccctacccactcttctgtactcttggaaagcagtcactgtgtgccacccacacttaaggcatgggaattatgctatttgtgatccttctgtacacatttgtctcttctccctcatttatttatttgttcaaccttttttttttaaacttgaaattgtactttctttcttttttttttcttttttggagacagagtctcgctccatcaccgaggctggagtgcagtggtacaatctcggctcactgcgacctccacgtcctgggctcaaatgattctcctgcttcagccgctcgagtagctggggttacaggtgcccaccaccatgcccagctaatttttgtatttttagtagagacagggttttgccatgttggccaggctggtctcaaactcttgccctcaagtgatcctcccacctcagcctcccaaagtgctgggattacaggtgtgagccactgcgcctggcctcttttttaaaaaacttgtatagacccatggatatttattttatactttataatccagtattctgtgatgctcaaatccttccagctttgggcatcgagggctctttcgtttgactcctgtgtctttctgatgcaccccgtcattttagttttggagcattcccttcctttctggcattgcgggttgcaccgggctcatcttgtctgttccctgctccaacctcagagttagccatttcactaaggagcccggttccttttattggaggatggtattagaaaccaagattgggtgctgggtgcaccttagatgaattttatgaccagacgtcctggtgtagagccagtgaggcatcccagtacacactactttattgtggtttatcaggactttaagaagccgacttaggaggcagtatagtagagtgggtagagcatggtccccagagactagtgttcttggtttgggtcccagctctgctgattaccagcttgggcacattgataacactacctcagtgtcctcatctggaaaaaaataatagcacttcataggaggattaggaggatccaatgaattgatatacaggtatacctcagagatattgcggcttcagctccagactactgcaataaagcaaatattggaaattttcgtgtttcctagtgcatataaaagttatgtttgcagtatactgtagtctcttaagagtgcaataacattatgtctcaaaaaatcaatgtacatgccataatttaaaaagactttattgctaaaaaatgctgacacacacaaagtgaacacatgctgttggaaaaatggcaccagtaggcttgctaaacgcagggttgccacaaaccttcaatttctaaaaaaagaaagcaaggcacggtaagatgaggcatgcctgtatgcataacacatggagcagatggacatccactaagcatccttatggtgcttgttgttgcttttttatttatttatttatttatttatttttttatgacagtgttttgctctactgcccaggctggaaggcagtggtgcaatcacagttcactgcaacctcaacctcccagtcttaagtgaccttcccccctcagcctctggagtagctgggactagaagcacgtgccaccatgcctggctaattttttatttttctgtggacttgggatctcattatattgcctctccaactcctggactcaagcgatcctcctgccacggcctcccgaagtgccgggattataggcgtgagccaccatgcctggccattgttgttattttttcactagcattttatacaggctcaaaataggaaattgagctatatatttttttcctttaactctcttagccatattttgagaccaaggtttttgagatcatgttttgggaagcacccccatgtttttctgttttctgaaacaacttggaaagcatagggcttggctgtttcttgaaggcatgaagtcctttgaatctctcagaccctgttgtttctctggggaagatttctttggtaacttttcagattttcctatgggattgttttagtccaaattcatcacttttagagtcagtaagtatgttttcctataaagtcttagttttcatcaaagattttacattgtaaccaagtaaccaattttattctcatatatttttaaaatcttatgtttttaaaatatctcctttatatctgtagctgttttttctttctcattcctaatgtaacttgtgttttttctctatggattataattgctagagttttatcttctttattggccttttcataaaatcagctcttaaatttatttttcagttctactgttggtcaaactcattgatttccagttttattattaattcctttctcctctcttcctgaaccttgttttgacgcatctgtcttttaacttgtttagttgaatcttagtttattttttattttttcctctttagtaataaatagattttggctagtttatttttgaatactgccttagctatatcctggtatgtctagagtgatttgtttttgaacctaagaactaacctagtgtatttcttttcatttcccagtagatgtggttgaatttttcttggtgaccttttggtttttagctgctagttctgtcaccattggagctagagaatgcagctggtgtgaatctttttggtttttaattttgaagtttttcttcgtggcttatttaaaaatattttggtcagtattttatggaatactggaaagtgtttagtttttatctttagaatatatactttggtgtacatgaatcaggtttattatctaattccagtcctctgccccctcccctatttttgtatatttgctctaagatttagagagatggttttataattctttgtgattcatgatagattttgtcttactcatttccatgataaattgtttgaggcataaaagttgatgattgttatgtctttattatatattttgctttttatagctttcaagaaaccccttttaacctatttaatctatgtcttgaatctgactttgcctgacactggtgttgctatgtttgttgttgttgttacattttcctggcatatctttgcttatccctgtatttttaactttttaaaataggttgtttataaggtgcagcatactcattgttcaaatggagagcctccccgtgttaggagagctgtttgaattcacagtgataatcagcatctgttctcttttctacagccttattttgtgttttctggtttctgttttttcctttgtggctttaaaaaagtttttctatctttggaaggttggtgaaatttcctttgctcacttttatatgtatgccatgttaaatgtagaatcacctttaaatcaagaaaaaaagacctgtatttctgttttctacttatgttcaaaagttaaacaattttaattttctaattttaacaatttaacaattttaagtttctaattttccttaaaaaactagaaaattttccttaaaaaattagaaacttagcatagttttgatgcaaggcaggcaagccctaaagtggggcttatcccacgagggttcttggcttcacccaggaaagaattcaagggtgagccagtagtagggtaggaagaaacagctttattaaagcagcggtgttacagttcaggcattgtgacagctccgtgactacccctgcagagcagggctacctacaggcagtgtgctgagagccgcagctcagggcggttttgcagtcatatttatacccacttttaattacatgcagagtaaggggcagtttatgcagacatttttagggaggggttagtaacttttggttcatcaagtcattgctatggaaaggggtggtaactccctggtgttgccatgacaatggtaaactgacatggcgcactggtgggcgtgtctgatggaaagctgcttttacctgggacctgttttggctagttctccatttggtctggtgtccgagccccgcctccagagtcaagtcccgcctcctgcctcagttttactttataatctccctttcccctaccttctagttttttattatataacttctttttcctttattttcaacatttgcattgtcttaccatcattttaccaacggttatttagtgagcactgtctcactcaatccaatgtggacctcaattttgtaccatgttttccctttgctcgtgtgagtgctttaagttttgattcagtactttcagtgccttgcttgttggagggttcttttgttgtctcctgcgtgaatggtggcttcagtgggtattgactctttgttccataaaaccattccctcctttgttgccagagatctttagcaaatcatattcctccttctttccagggaacttttcattttcttgccctggatgcttataggactattgattcttggaagtaacagtatttcctgaggatctgtctcactgcctttctgggcaggggctgcacttcagggcttagaatcctgccagctgtctgggaggaccaggagaaggcaggctccttgggaaggggcacaagccggggcttgcttagcctccaagttcttcagccagtaggcagcacggggggtctggagggacgagcaactcaggccataaagttcacatcgggtgtgttctgacctagactgataaaaagtcaagaagaagcagtcacacctaacacagagaccaggtggtgcatgtgacagatctgcggagacagaggcagcttggccaccagcaaggctggtctgcacacagtggacaggccagtggcagtggccactcctgcacccaagcgggggcatcacatgctctgcttcctgtctgttacctccctggtcactcccagaggcaagcattcatccccttgggtcctgctacctgagacctgtgatataattattgatcatgtcaccccggacagatttcattccctggtttctctgtggcttccttatcagtttcagaaggtaacgtggcacccgctgggatcggagccatgcacattgggacaccgcctggggtggtccctgtgagcacctgcgatagtctatgaccgacttctttcatctgagcagtgaaagctttctgcatctcagggtcatctttgaaattcctcctcctcacgtactaggtctcctggatgtgatccggggctgttagcttcctctcatgatgtccacttgcgcaccagtgagaaactcaagcctgtctcccattctcctgctgtgaccctgcacactcgttctgctgctgttttcttgtgtgcattttgtggcttggtcccttcctgttttggcgcaggcttctccggtgagctctcctcatggatcctgagaaaacatgggctggtggatctttttaggtttcctctcatttttcacccaggagacctctctggctctttctgcacagctggccaagagctgtctgattgaccccaccatgcggggctctgctgaaattgctcaggcccagaagaaagggggaggaacggtttaggttgcttgtaggttcactgtgcaagatgggcgaccccagaggagctgaggagggggctatgagttgcaccaggtggtccagacagtaccgagtcacctcggtggacatggaagatgtcttctctacagtgggccagctacctggagttggctttggccacacccccatttgctgcctgccttcccccgaggcccctgtgagagtggactgcagcctctgggggcctctgtcccgtcagggtcttggttggggagtgtggggaaaccctgggtccccacctctcattctccaggaagaattttctagcaagagaaaggccagagtttatatactggtggcctctgggccacatccagtacacacgcagtttccgtttggcccaggcaataggtattttaacactttattttggttcattgaagtcaaccaaatttgaaaaatcagatttttttggcttttcctgaaaatcagagtagctggtaaccgtgggctggaatttccacagagcagcagcgtggtgcttgctacatagctttcgttcagggtgcacgccacaggccccaccgctccccgtcacctccccgagcactgaagccgactcttttcatggctttcatgctgttggttctttcataaatgagaaagccttctcataccagcatctctatcaaaagagaaaaaaaagatagtcgaaagggtcatgtatttcaagaaaaataggagagctctggggaaaaaaaaagacttttttttctgttttgcatgccactacctggccagcttcactcctgtgggtgcctccaggcctctggagctggtcccccactctaaaggagcctttcctgttcttccatgccggaaggagcccgtggtagatgggagggtgtttagctgggcaggtggaccagacgcccacctcggaggtggctgtgtcctgtctggttctgcccgtgagaaggcgtggctccaagtcctgggcgcatctagtgaggagcagccccgcaggagcagttattgaggtttggctcccagaacaggcaggcagtagtgattatgctgtgaggtttggtgccggtttttagaaaatcctcatccagacctatcacctgctggtgcgaaagacgctccctgcgggagtaattattccgggccgtgagtttttctcctcctagctctgagttctgtggatgacatgaatggtttcatccaggaagggctgtctccatacctgccggcaggcatgtctgctcttgaagcctggaggtaatttatgataaaaccaaagttgaggctcctccccatccctgttagatactccgacagcaggctctgtgttccggggctgtgaagctgagtttgcgtcctcaggaacctcccgcacaaggccatcctctgcctttgtggttcaggctgagggtttggactctgtctgtggcatggaggatgggcagtgtgggtcttcgtgcttcctctggcagctgtccaggagggagccatgggcctggccacagctgccttcttcagctgccccagagtagggtgaggaagcatcttgggggtggctgagcaggagggaaactggcctggccccacccactcagccaccgtcctctcgcagctccctctggctgtggatttctgttggcttccgtgttacaggttttgaacaggcctagatgcccaggagccaggctgctggtgggcacaggctccatcccatgtcagtgacaggcctcagacttggcctgggctagcacgcccctgccctgcctgcacaaatgctattgtcactgccatgcatcccgggctcctgcacctgcaggaacttggcagggggacagcgggaaatggatctggggtcattgtcactgctgcccacagaaccagccagcttccttcatgtgaattccaccctcttgttagaaaagcccgttttgtggaggcagagccccagggtccatgagtctgtgtccctcctcacccacagtcatccggcactggtgcagcagtgttcccctggggccaccctccatgagtgtgccacaagccttgtggatgcacctgtgacagcacttggggtcccctcattggtgagtggtgattgctgacctccatgtctgcacctggggatagaactcttcccatgtcacaaccttcagaagcagcacggtggcacaggtggccctcctgggcatcccagctagggcgaagtgcaccatagctacttctccagcccaaggtgaccgcagttcattgctggagggccctggcggtctagtcccccacacagccaatgtctgggtggctggttgagtcggagcctggctgggctttgctggtgctgttttactttcttactgtccatcccagcaagataagaggggctagatgcccttcgtggggcctgctgatggctgtggagactggcgcatagactggacagtgggaggcacatcggaaagccgtggtcctgggaccctatcagcagaggtggcagaaaggcctcaccaccctcggtgcggggtcctgatgcccgctgggccctcccctctgggtggtgagcagccgtggctgagagcatgctgcttttgcaaaaggggtcccagcttcaaggctggggaccgaagttcctcctggatgcactgtgcaaacaggggacccctcacttctgctaggccagcatgtgactgtggggctctcggccaccctgtgctgagaggtcgcagaggcttggggatggcatgggcacctggtgctggttgaagctgggcaagtgtcatgatcccacgggtgaaaagactccagagagtgtccacgtgcccgggtgggtctaggtcttagcagccaggatgacccgtccggtgaggatgcagccagtgcgtctctccccagtgttggctgattcataataggctttaagcagtccatatattttcagcatgagctggagtctttgaatcatttatcttggcagctcttcttaaagctggagaaaggtagaaattcatctaggtgctgagaaaggagcccagaagaaaaaagtgtctggcggctgccgtgatgggtggcgtgcctggagatagtgctggtggctccgagatcaaacagatgagaaatggcttcccaggaagaactcggggaattctaagtaggtaatgagtagtgactgtcttttgatttacggcaagacttggcaatcaatctgtaatgctttgaagaggaaagaaatgaatcccgaacaggctgcggggtccaggtggtttggacaggcggcccttccttggtggtgggggcaggggcaggcaggctagaggtcgtggatttctctcttctgccacggggaataattcaggccgctcctggtgggcagcaggctgtggccagagctggcttgggggaagggactcatcacacctgtctgatgtcctctgaggtcctggctttgagcctggtgggactcgagttcagagctcaggtcatgggcagtgcaggccctggtggttcacacactcactggtggatctggggtcctttcttccaccctctggcctgaaggtgcctgtgtgagtgtgctagggctgccccacaaaagaccacagccttggtggcctaagcaacagaaatgtgttttctcacccttctggtggctggaagtccaagatcaaggcatcggcagggctgctactctctgaggcctctctcctgggcttgccgccttcttgccatgtcctcatgcggcctttcctctgtgtgcacgcatccctggggtctctctcatatgctcagatgtcctcatatcaggacaacagtcagagtggattaggcctgccctaatgtcctcagtttagcctaatcacctgtttaaagcaccgtctccaaatagtcacattctgaggcactgtaaattggggctttgatgtataaatttgggggaacactgttgagctgattaaaatagtgcatttggtctctggagaaacgaggcctggtgccttatctgtaggttcatacatgctgattcagcagcgaggcagcaggcagcccagtggacatttcctgagccctgaccatgtgtcagcctctggtctgggccctctgcatgtgtgtagttaaatgagggacaagatccatttaatcctcgaagcaaccctctgtgtatgggaccattgaggaggctgagtaatccatccagcatcacactgtgggctaaagggggaggcaggatttgaaccttggcgttggtcctggagcctgcgttgcacttcactgtggtgacctccagctttctgaagggctgggctggcctcagcctggacacacagccaacatcccaaagtaggagacagacaagtgggaggattacacactgtgataaaatgttgtccaggaaaatggggtgacccttgagctgaggccgagaggggtgaggatctccggcacttgccacgtggagagagacatggtggatggggtgtggcgggtaagagaggagtgggccacacagccaggtctccatgagacactaagtggtttctgggagctggggagtgcctggcccagctggggcttggctttggggggtgagtggacggaggtggctgtggggaggacagtgaggaggctaccatgggggcagactggtaggcttggccatgggagggagggggctggagggtgagtttggaggtgaagctgagagcgctcacctgtggattggatgcagggggtggaaggggaggaggaggggccctgagtccccaccacccagtggcattgagccagtgtctagactaagtcaggccccacatggcatgcatccgctgcctggccccttactgggacacagccggggctgtatcagtcgctgccttttccatcccagcctcacagtcgctgtttcctgcttaaacctctgaggctctgcccacagcctatgcttttatgaagtccatgattttgaatggagagagatccccagggtgctggcgctgcgctttctgtcccagcctggctgggttccatgtcccagccttgagagcatgcatgcatgtatgtggtgtatgcgcttattgcacgcacccctctccctgcctgccagaggacatacagcgtgtgtgtgtgcatgtgcgtgtgatatgtacatgcattacactcttctcgccctacccgcctgaggacacactttgtatgtgtgcgcgcacccatgtacgaacgtaagtgcgtgtgatatatacacccattacacactcttctcaccctccctgcctgaggacacactgtgtgtgtgtgtgcgcgcgcacgcgcgtgcacttgtatgcatgcaagtgcatgtggtacgtacacccattacacactcttctcaccctgcctgaggatactgtgtgtgtgtgtgcacgcgcatgttcgcaagtgtgtgatatgtacacccattacacactcttctcaccctccctgcctgaggacacactgtgtgcttgtgtgcatgcgcatgtgcgtatggtacacccattacgcgcaccccctcaccctgcacctgcctgtcagatcactcctctttcagcccattcatttgttcagcaaactttttttttttttggaataagagtttaaaaggcttttctttatttgggttttcaaaaaatttcctatctttgacttgtttttatgtcgttttctttttaaatttaaatccttaaagaaatttgccatttatcatggcacatggtattgtgtacatggcaattatgttcatacctataaacagcaattatgtaggaaatagaatcataaataagcatataatcttatgaataaatttaaatgaataataatttttggttttctatttaaatatctttttattaacttgttcagtcatgtatcaagagtggcaaattacaatctcacattctccccaaagtggaaaagaatccaaatgtccaccaactcctacacggataaataaagtgtggtgtgcagtctagccatacgagggaatagtattcagtaatttttaaaatgaagcacagggacatatgacagaatcgatagatcttgaaaacatggtgttcagtgacagaagtcagagagccacacgctgtgtgattccatttgtgcaaaatgtcaagaacaggcaagtccacagagatggggcaatgagcttccaggaccgtgggggagaaagcagggaggagtgactgcagatgggtaccgagtttctttggtgggtaataaaaatgttaggaaattggttttgtcagcaaacatttatgatgcacctactgtgtgccagatgctgttctgggccctggggaggcagcggtggaggaaaggcccagcccccgtggagcacagttctgtggggagagccagtggacagccccggtggacgttccccgaggcctgaccacataccagcctctggtgtgggccctgcacgtgtctataattaagtgacaggtaagatcggtttaattctcagagcaaccctctgagtaaggggaccattattttatttatttatttttaaatttttatttatttaattaatttatttatttattgagatggagtctcgctctgttgcccaggctggagtgcagtggcacaatctcggctcactgcaacctctgcatcccaggttcaagctattctcctgcctcagcctcccgagtagctgggactacaggtgtgtgccaccacgcccggctaattttttttttttattttatttttagtagagatgggttttcactgtgttagccaggatggtcttgatctcctgacctcatgatctacccgcctcagcctcccaaagtgctgagattataggcgtgagccaccgcgcccaggcttttttttttttgagacagagtctcactctgtcacccagcctgaagtgcaatggagcaatctcagctcactgcaacctccgcctcccgggttcaagcaattcttctgcctcagcctcccaagtagctgggattacaggtgccccccaccctccaccatgcccggctaatttttcatatttttagtagagatggggtttcaccatgttggtcaggctggtctcgaactcctgacctcaggtaatccacccacctcggcctcctaaagtgctgggattacaggcatgagccactgtgccaggcccagggactattattaagccccttttacaggtgaggaacaaagaggctcagtaacctgtccaagatcacaccacaagctagtgggggaggccaactttgaaccctgatctttggccccagggcctgtgctccacttttccatggtgatctctgccccacagaaggagacctgcttcttccaacccggtagttactgtctcagtgcagggcactggaaaggcacagttgtcttgcagagaagttctagttttaaaatacccataaaaaggacaaatacctattgcattatgaattatgatgacaaatgacatgttaccagagtcaggccagctctagtgaggaagaagtttctgcctgatgaagtggaaagagactgcctgggaaggggctcagatcccccagccacctctgggtcaaggtcggcctcagccaggaagccaggggccattgctgcagccccaacactgttttctctgtggcagagtcaggcatacagcaggcgctcataaatgctcctgagtgaagggaaggaacagggctgcctcctaccctggtggtggggaaggaggactgggtgggctcctcactcagccctccagggattcagcctggctgggcgcaaagacgtgcaggtctgagcaaggtggcggcctccccgggactgtgcactcttgcaggcggccgtatttcctggggatgtggtcaccaaccccagtgagcctgatagcccagtggttatcgaggaatcaggtctgcactactgggctggctgataaggggcacgtgttggtgttgtaatgaggtgcatgtggcaaccgttcccaggtggtcccagggccaaaggccagcctcacccgaaagatgttaaatgccagggcgtgtttctgaaggtgccatctcaggaggccttggagagccagggctgagctccctgggcttggtggagatagtagaaccaggctcatcatcccttcaggatcagacatcgtttccagatgccataggtggggccagaaccatctaaacattacctgtagggttgtccatttcagacaactccaatttgaccattcagagggtttgcctggagtacagcttgggtctcccgatcctctccctgctcccggccaagcaggctgatgggtgcccatcatgcaccacccatcctgggaagtcaggctgcccatggacctgccctgtcacctggctggtgagtgttcgtcatttccagcctgccagtgcccctcaccggattacacacgtgctgagtaacaacaggtgccaggcactcttctaggagctggggagacacaacagaaggaatcccatctgtgaagctctagaggggaaatcagtcaaataaagaagtaaaatacatagtgcattcaatagtgaccaggactgtggaaaaataaaagcggggacggcagtagagggagtcctgggagtgattgacagtgttgagtaggatgatgttgaaagccttgcacagagcggacagtcaagtgagacccaaagtgggcgagggactgagctctggggtgtcagggaacagaaacagccaggagactcgggcagaggagaggactgaaggtgggaggtggggccagagaggtgaggggccgagcagaggagggccacggtccagctgtttggctactgtccaaagcagagatggaggggccaggtcaggagcagcgagcccaggaggaggctcctgtagccctggggttggagtggatggggaaggagcaggcaggccctgggtaggttgtgaaggcagagccagcaggactcagcagcccatcagggctgggtgttgtgggaagagtccaggatgactccaggggtctgaatttgagcagccagaaggatggagctgctattgagtgaggtggggaagacagggagaagagtccagaccccttgtgcctggggaagttgaggcagcagagggatgaacagaagagcatctggggagaggttcagaggttcatttccagccaggatcactcgtcttgcgcaggtcccagtggttgtcatttagaaggtttagaaacgcttgaggaaaagccagtgtcaaatcatttaagaacctctctggcagacacttggctcacacctgtaatcccagtactttggtagtccacggcagggagatcacttgaggccgggggttcgagcccagcctgggcaacacaggaagaccccatctctacaaaaacaagaacctttcttggaaccccaccttggaaagtttggcatttgctccagggagtttataaatggcatttatcagccttaagggtggcagcaccctgtaggttgtgatctcatttaatcacaggacaggctgacagtcgggggtgccagccaccccacacgagctggggacagcctcttcaggacggtgctgggctgtgtgacccacagacactagaggaaacccctgtggtgggcatccctcagccggatccttcccacctggggtgtctcctttgctgagagctcccaaggagctaaagcaaatgacctgggccccagaggcattgccgggcagccctgctagtgagagcagctggggaggctcaatgaacctcacagccagcccacaccagaggccagcccgccctggcctaggcccacgcactcccaggcccatgtgcacaaaggggaggagtctttactcggacccgcctatgcctgaggtctggcccctctgggacaggatctgcaggctctggtgctgctcctcagggtcctgccagaagtcagggccaccaacagccaggacccctcggctcaggtgcccagcccagagggaggcagggggcaggaaggccaggaggcacaggactaaggtgctagtggggcaccctcagggctgtgatgcatgtgagatgtgcccaggttatgggagccctgtccacgtcgcacttttccctcctcaggggaagcacgtggggtaaacagtccatgacgtctcaagcagcccctccaacctcgactccatgtcctgtccttgggcagccacttctgcactgccagggaggagaactgtgccactggcctggccttgagcataggcccctgtttgactagaaggcacgccacctgtctcttatgtcccagcactttgggaggccaaggcaggtggatcacttgagcttaggagttcgagaccaacctggccaacatggcaaaaccccatctctactaaaaatacaaaaattaactgggcatggtggtgcgtgcctgtaatcccagctactcaggaggctgaggcaggagaatctcttgaatgaacccgggaggcagaggttgcagtgagctgagatcgtgccactgcactccagcctgggcgacagaatgagactccgtctcaaaagggcaggaagcactcctttgtcccagggttgccattggttggtactgaggtgtcacagttcagctccgaggaggagaaagcttggggagaatattttcctcctggacagctgcccctgccagggttgggctgtcggcttccagcagaaccctgcccgccccccatcacctcagggccactccagtcctgggtagtggaaacactcaccgttggcaagactgggggcatagagtgccctgacgtaggtcttggcatcagacctcataaggcaaagggcaggggagagagacccttggacctgcctcttctcttgatgtcccgcagttggcattttctggcaaccacaagagtcaccctggtctggctcagagaagagatagccagctgtgttggtctggggccccctgcagggcaggattgtaagatgggcattgttttccctgcagagtgggcacagcctgtaccctgggagaactgtggggagtcgttctgggcccagcaagcaggtggctctcttctctctgtgcccagctgagggtccatgctagaaacccagcaccctgggtctgccctctgagatcccagctgggttcctggacatccctgcagcctgtgtctgggcagggagccagctggtgtgattggagggctacttccaggagcccaggagaattgcccgtggctctcatgcaccggctcctgtttcacggttagacatttcaccacattgtccttcctgcattgttttttctgtccctttctctggctctgctgtgacttcattgttgctgaggggagagccagggtgtcagactccatgtgttattcagagtttggaccctgcctcttccaacaatgagattatgtgccagaaactggcgagggttgagaaaaatggcctgaactgcacggtcggggcgtgcctttggaaatcactgcctgaggcatttctgacaccaccgcccccccaagtctcctcctaatgacaccacctacttacctgtggtgggcagtttggttggatttattccaacgggctctctgcacttagcagttgagaaagatatttgtcatcttgctataaaacatcaaacgcatcatgatctaaacgattgtgacagcagagagttcaaccacagtctaaaattttagcattatttatgatgcttagaggcttggtgcctacagtatcttcttaatctagtctgattctggagtgctgtctcccaggcctgcccccgtgtctcctctggctgttaataacagctcctccaggcgccctgtctgccgacacaaaatccatctgaacccctgcatctcgtgtggctgttgaaaattggcatttctttattgatgcaactggttcctgccaaatacttggggacaaataaaagtagttgaacttcgagacaagcagagaaccatttgttcgtggaattgccagccaattgatggaggtagttaaactatcgtttagaagactcttgaaaggaaaaagttgactgttttgagacactaacattcagagtagtgtgcagagccaggcaacacagcttttccgagggccggagcccggtggttgggggtggtgtgtctcttctttaggctcctgggccgtgttctcagagacccccacttgttttgcttctcccgtggcccctggagcactggctgctctgcctggttgctgctcctcttccgtgccagcttctctggatttcccactttttctttcctcctcctccaggaagtcttccatcaaaccctgtggcttctgcctcatcggactttaacgctcttgtagttaagcaagatctccctcctccctgtggactaggggcctgccttgctagtgctgtgagcgaggcatcacatggctggtgctcggacccaatgaaccggccccaggggcctctcttcgcacccagagagctaggcatgctgactctctccaaccaattcccttcctggccctcccggaaggcaggggtgggcaggccagtgaccccagagcgctggctcagttctggctcagtgcccatgaggtgattgctttagaccagcagcaagtgtgggaagatggaggaggtaataacattgattttcccataaaggtggaatttgtggtgagaggaccttcctggcaggacctaaacatcttcttctcccagcccctctgcccctgcaggggagtggggtgggtctctcgagtgcggcctgccaggcaggaacttggctcatagcccatgcagccatgcagccttgcagcccaggcaggactggagccctcagaccaggcccatcatgatgaggcagaagcacccctgtactcggccattgggagatgctgaggacggctcccgcctgcctcttaggcagggcatggggcctgctgggaaggctgcctggtgagtaccctcattccttctcttcctcccatgcttctttctcttctcactcctcctcttcttcctgctcgcctctccttctctccctcctctccctctccctctccctcttctctttcctcttccttctcctcttcctcctctttctccctctccttcctcttcctccatcttccttctcctcccttctcccttcttttctccccgctctcctcctcccactcctctgcttctttctcctctgctcttctaggccaaaagcagtgccctgaaaccaagatgggggcagagatgtcagagggagccctgggctgcgctaacctcagacccatattctcctccagcagctgcccacacccttccctgctcaccgcttcttggaggccagtatgcctctcccatgcccccaccttccaccagtgtttacagccctgggaaggccgaggacctgctgagagcctggagggcaccccctggcctcagactcacctgagcatcccagtgaccaatccagggacgccatgggagcgtgggttgggctgcacggcctctgcccatggccctgggaggttctgacacccagtcctgtcgtgattgagaactaacggccatacgagcatcagcagattctcacacagtgcccagaggacaacagccaaagcgtggctgtcactcccactttacaagcgcagcacctgaggccagagaggcgtgctgcagggcccagggaccccagcaccagggcaggccctgctgggaccgaacgaggggggttggttctggaggggctgttgtccccagccagacctgccccagttgtccttcgtctgggctcggcgcccctcacctcctggcacctgtccctgccgaggggcccgggcagccggaagtgacagggaggcagctgatgagtcactctctggggcctcagccgggcctccagcttctgttttccatcatgttaattacatttattattcatcaactgctaaaactggctctgggtcctccattttccaagccctcaggttgcgtcccagctgaggctccctgtggctttgagtcgggatcagacgccggcccagccgaggggcctttgggtttggaaatgaaaacaaaggatcccatcctggtggctttcgggcagccgcgggtggccaggcctttgctctcctctgcctggagatgccggatggatgagggagctaccgtctcggccacctcatttggcctccccagcgcccaaggttctctgcctcttccatccctcgtcttcctctggcatcgcattccggctcacactttgatctttcccgagtccctgggcatggaggctgctgtctacccagctgccttccctccaggccgtcctcaggggtttgtacctgccccctccaccccaccaccccccaaccttaacacctgagtgccctgtctcagtccttcactcccagaacagggagggtcagggaccgaggagggctggaccgtatgtgtgatgtgccaggcttctgctgctccacctggctgggttctggccccgttcccaaggcccagtgaccacccaaagggcgtgacctttcccagctgatttggacaccctgggtggcagctttctccccacccagtaaatggggttgggttttactgccctttcctcattcacgataaactttccatttctgtgaagttcacccccgagaccaagggaggccagatgcgccctcgtcctgcggggaatcctgacattaggagaaccccattcccgcctgccctgccagggatggtgcagtggaggaatgcccagtagcccctgggcctactgaggtgccccgatgcctccagcctaggcccacaaagtgatgagcttcaaagtttcttctctgccaggggggataaaaaagcagaaaacagagatgctagaaccatcgccgttacacagctggcagcgtccacacaaaaccaagcattccatgcctggcgccccacactccccctttgcctgccccatgtgcaccggagacacatgaggtgggggaggagtctagagctggggagatgccaagcctgtgtatggcgggtgggtaaactgtgggtgtccatacagggagaactgtcgggcagtgaaaacgagcagattgttgccacagtcagggacacgaacagcgctgaaagtgatgtctagcaaaagaagccaggctcagaaaggcacgtaccatcccactgacataaagttcccagcaagcaaaactggtgacagaggaggagaggggaagagaaggggtggtgagcgaaccctctaggagacaagaaatgtcctgggtcttcacccacggggcacgtttgtgagatgtcatcaatctgggtatttaagatgggtgtggtttactggcatatattttgataaataggcttgcacacacacaccaaaatggccaagcattgctcctgcggccagactccgggcagaaacgctgtgcatctcttgacctgagtggtcctcctaacttgcagatttacagacatctccagagctacagaccgacacggtaaaatgaccatttgtgcacttgcagaattattcggttggccgatgacagaaagaaaatgaaaagttaaatgcaatttaaggaagtatcgcctgggctctctgttcaggccaggacctgaatatcgagtctattagaagcaattataaaagggacagcgcttcttaatgtttctcatttgacaagaaggtttttaaatatggggcattagttaataaaaagaccccaggagcccattgtaatatattacctaattcctaacagttcatagccactgaaataggtaaaaaaggggatgtaaaattaatatatggttattattaaaattgccttataaattagttaagtcccctggaggtacagagtgggcatcattattccaagagtgtctcaagggctttggtgtaccttgtgtgtttgtggagtgggcgtgcccccttggcagggagaagagagctctggctctgcagtttaaggagaaaacagcagctcacactgaaagagaggagagccagccatcagactgcagacattttataaagaaacctcttccttagtgaagttgctggggaggctggcactttgaggcatcacccagcatgttctgtgcccgagaccagtaaggccctgattgacatggattgcagttgattagggacaacatgcaaatgggtgtgtagctcctggggccctggggaccactggcttgttcaggaatggagggatagaaacaattcccttaaagtgttttcactcaagggaacccagctgcaggcagcatggcagtgagggagcctgtcgctccaggccagccacacccgctagctgctatagccgaggaggccgaggtgcctctggaaggcgtgtgcatgtgacccaggccatgtcactgccaccatctccatccaggctgtgggtactgggagcccggaagcgccaaagcttccaactttgccatgcgcttgtgcctttaattgggggatttcaaagctgtgagtggaaatccattcagatctgagctgtttgctgaatccgagatttctgtccagggggatttggcgaacgtaatgttttatgcattctaggtgatttgcccatacctgctggatctgttcatggcagcaggctcgtttccaaggaacagcacagtcctcctggacaaagaggcttcctcctgctcccaggggagagagctatcatgtttttttccagtgagagcaccagagggaaatttgctttttcaatcggctcttcagagctgcgggttctgccccatcctgtctgcagtggaaacctgagctgtcggtgttcccctggggtggggtgggctccttttgcttgggtgggtggtccccagggtggggtgccccgtgtggggagtgtttagccagaggagacaagcaaggctgttttccaaccagtctctgacttctctagctccctgtgcaaaagggatacctccgtgtgcagacagaggttttgccaaagaatctgattccagagaagaaggctaagtgggctcctgaagcaggacttggcaggccttctaggggcttggattctccaggctgcataccagagagccttgccgacagagcttgcttccaaacctgccggtgcagtggagcagctcaggagctctgggtggaggaagggatagggctgcactttcttcccagagtggcccttacctgggaagacttcttagcttcagcctatgactcttagactcgtaatggtcactctgggtttaatcttcccttttttttttttttttttgaggtggtgtcttgctctgttacccaggctggagtgcagtgtcgccatctcagctcactgcagcctccgcctcccaggttcaagcgattctcctgcctcagcctcccgagaagctggaattacaggcatttgccaccacacctgcctaatttttgtatttttagtagagacagggttttgccatactggccaggctggtcttgaactcctgacctcaggtgatccacctgcctcagcctcctaaagtgctgggattacaggcttgagccaccacgacctgcctaatcttcccattttgatcatgaggccaggaagcaggaaagagtggtccctccactagcatttgctacccatcttcaggcagaggtgctgccagatgggtgttaattgggaggggagtgtctccgaggatgtccttcccaggaagaatttttccccctgtggcaaaaaggagaggtagaaagtgggagataatgaaggaaacatcgagagtggaatttcagatgctttgtcttgggcggaatgaagagaggaaatctttgctttgttttctgtctcctcttggggaaatttcccacatgagttttgggatgatgaagatgggcccccagccctggcctccggcggggacctggacattcagattttgggtgatttcaacccatggtagagtttcctgatagagtcagggaggaattgggcttgaattgcttttctttcttttcgtccctctcttccttccttcgggaaggaattgggcttgaattgccctccttccctccctccctctctccctccctccctccctcccttccttccttccttccttctttccttccttcctctctccctttctctgttcctctctcccttcctcccttccttcataggatcttgctctgttgcccaggctggggtgcagtggtgcgatcatagctcactgcctcgacctcctgggctcaagcagtcctcctgcctcagcctcccaaagtgctgagccacagcacctggctggattgcttattttttactttgtccacaacaatggtatcaaaacagagatacactgtggttccttcagccaggctgaaggtttttcaaggagctctgtgtgcgtggcagacggcgtgcacttgcgacctctggtggcagcttcccagtgtcgtcctcggtggcagctgtgcttggggagtgtgcgctgtgtccactgggcagaacacatcaggacaagaagccccctggggccagtggggcgaggctggggcgaggggagcaggtctttgacaggtagcttttatttcttcccaaaagtgttttcaaaatgaaaatagctttactctgataaaaagatacatatgccagtaggaaatccagtcagtacagaacattataaacaagataggaaaaaaaccctttgatgcagaggcacacaaaaccttattgctgtagcaaacaggcttccggtctctctggggcacagacagacgggctttgatctgctgggctcacactgggcagagtttttgcagcggaagtctcttcctggcagtgaactggggcacactggggctgcatcataatccacttacccagactgcccccggaagccaggtggttcccagtgtgaacgacacttcgaccgtcaaccctacctcgccgtctctcgggtgtcaaactgaccgtgtccttggggtaaactcctgcaaatggaattgctggaaaaatgttgatgcccaaagcccagtgccatctagaaaagttgttctcccttcacggctggggctgggttagtgtctggtgagcagataccatgtccttcccggggatgttctcatttaatcccgtgagggggagcggagaggagtgtggcatcctctctgcattatagagaccccacagtagacagatgggtcttagaggagccaggtggcctctctccagaagccatgttctcagccagcgtgcaggacacccctcctcccaaaccatgagtgccggtgtgcccacccaggcctcaagattaattgtgttatttccattattcacctttatcattctgattagggaaaagtaataccccgtctttatttttgctgatttgattactgacgagcttaaacttctcttgtaagtatttcttgggcatttatctttgtgggttttcagtcctttgcccatttgcaatcgggacatttgtgggtgacttattgctctgtaattgggctctttgtactattgttctgtgtgttggaaatatttttcccaatttgatgtacagaaattgtaaatatcagttgtcatgttggtcctttcctgtatagtttatgcctttgcgaaattgctttttctactacctcaatataatccagttatcagcatgttttttctatctttatagtctgatgactttcttttaaataacagtttttgcataattatgaaatatttcaaacactgctgtgtatagtttaatagatatctgtgtatccacatggtttcgtcttttatatttaatacgttaattgagctaaactgcatttaagaataatatataaacaaggattctggcttttctgcccccgcgtaattactaagtgacctgttgtctttggagtaatgtctttgccccccattgtaaaattccatttttgctgtattctaaattcccaggtgtattagtcagtatagggtagcctttggggtggtaacaacagaaacccagatctcggtggcttagcacggtaaaggctcatttcttgctcatgctgccatctgtggctggcccagtggctctcctccagcagggatgcagggctgcttccactgcccaactctgccccctctgagaaggaagagagagaacatgaagaattcacacccactcttaaaagccatggcctggaagcagcacatgtcatttcatattcctcttgggatgagagtcagtcctatggtcccagcctagctgcagggaggctaagatatgtgcccagaaagaggaagcagagtgaacacagggctagatctccactcggggctgcctgggcagacagggtttcggctgcctgtggatgtgtgcgtatatgcatatgtgcatgtatgtgtgaatgttctttggattgttgggcatgttcaggcctgctgttcctgccatccgttaccctttcttcacatgtttactgaggacctactgtgtgctcatcactgtggccagccttgggtatgggtgacatgggcctgcctctaggagtgcccttcaagactgggagggaacgggagggtgccaggctgaaagttctgcagtgtagaagtgtggggagggacttgcctacagagggcttttggtggtgagaggtgggagaagccccttggggaacccagggagatttctggagaggggcgtcagcctggcgcacggtggttttggatggtaactggcggtgagcaggaggtggagcgtggacatcctcccagctcctgaagggcagcagctgccaggagtccactgagacccctctagccatgacctcctggtgggaaggtgggccaggaggggacctgttaaagactggcaggtggttgagggtcagtgtggaaggtgtccgatagaaggtgctagaagtgggtgggcttgggataggtgttgctgtgggtcctggaagagggagctcggggtatgctggacaggtgtgtgatgcctgggctccctgcggggacccagcaaagcacatcaggaaacccggcatccacgggcgtgactccctcttctgcatcctccaagccctccttggcactgtgcgaattttctaaatttcagtgggtggcgctggcgagatgcttcagagtgtgtgcaggctggcgagtaaagtcaaggaacttcctggctcctggctatgcaggaggggggcccagaccctcatcacataacgaccacttctgtcttcaagcgtgtctcttacaaggtgggggccaggagagtgctgcccagagccagtgctttgccatgatcagattgccgcctgccaggacgggggtatgggttgcctacaggcaccgtcactgctgcacggatctccgggagcaggcttcacacacacaattcctgctagcaatctactggctttggggagtagtgttggtgtcataaagaaaggatatttaactttgcatcgataggcaaagaataattaagatataattaaaagcacaaattcttctaattattggcttcgtataatgtatatttaaaaacaagatctgttaaggcttccttttgaatatatccagaagccaaaagagggtagcattttaattaaaaatggattatttaaaaaccagtttaatcatcctgtcatccaaagacttagactttattaattagctattgataaataggtttaagctaccccaaagttgaatttgcaagagttattcctggcatcctccgattggaggattttttggaacttgccctgtgtctctgggatgtcagcagcaaaggtttaggacatgtgagttggttcttaaatcgcccctcccatcctctgtggagccaaagtggacatcctgctgcaggtggggaccgatggggggctcctggggctgtcccacttcccccatctcctacctctgtgctctgtggcacgagagggtgctgaggacctggatggtggcatccgcactgagaggtccccgatggggcacaggtgcagaacatgctagagatgccatgagccacgacagcctccgcctccccagctccatgcttggagtgcatccctggccaaggcactcctcttctcaaggctgctctctgtaggggcggcgtgactgccacccccattcatcatcttaagtagataaagactttcaaagtgataaatagcgttcctgttgttccttcagccaagtgtgactaaaataacgtttggagtcgtgagtgaggatggaaaggctcattagaagaggggttgtcggcagttcacgcctaacagccggttcgctgccataaaacacagccgcacgcggtggaggggccctgcccacctagggcctgtccaggctggccctgacagatggtgtctgggcctccctccatggcacatttcgctgcgtcctgggccttgtggttcctggatgcttggaagaaccttctcagagaggagacgtctttcacaggcatctgtggtcctcgcttcctgcaggtgctggggatctggggctgcagtgacccagctcctcctgtttcctcagtgacccagctcctcctggttccctccagcctaatggggtagccaaggccacctgctgcgcagtgaccactggcttggcgctgcctcccgggtgaccaggtccctgtatccagtgtcctgtgctcacagtaccgagagtggctgtgagtccatgtggacagactgcttctcctctcttctccagagccctcagcagaggacgatagggagggaactgggtactagaccctcaggatgaactgagtgagttgcaggggctgcccagagctgggcccaggtgcgacagtgctttagaaagacattgataggaaacagcactttccagagaaagttagatctgaaacgacacatttgtgaagtattttcagattgtaaggctgaaaaagcaatttgatgtttagaaataaagtagtgctggactctttcaagacaaaacagaaaaatgccctagagggaatccaaagcaaagcacttgctttttctagaaggggtgacttggggattctgtcctcactctacaaggtgggatctgggtgactcccactgttgcccaggctggagtgcagtgacatgagacctgagatcctctgccaaacatgtgttccctaaatattgaacctgggcctggcacagtggctcacacctgtaatcccagcattttgggaggccgaggtgggaggatcacttgaggccaggagttcgagagcagcctgggcaacatagcaagatgctgtctctacaaatataaaataaaataaaataaattagccaggtgtggttgtgcacgccagtagtcctagctactcaggaggctgaggcaggaggattgcttgagcccaggagtttgaggctgccatctggggacttggggagcttctgaaccaaaggccttgcccaagaacgaaaaaccaggcttttcctcaaagaagccttaaggcgggatctcccagagttagtcattccatgagacaccctggcagttttggtcaagttcttgtctcacctctactattatctgcttaatcgttttctttcaattgactcattttttttcctttaaatatatgttttaagatgctttttatcctcgtcatgaatgaaacccaatctaatttgccattaacagacattagcgcttcaagataaatacctagtgcatgaaggaaatatgctagtggggtactacataatgtcatcccgtggactcgtattgtgctttgggaaatgtgaacttaaaagcagccccttccctccccttgcccctgctcgcccctccagaaagctccctgcatacctggcttgcttcccccacaccttcctggggaggatggagacagggtgccagcgttccttagagggacaatgtggcctctgggttgtgttgaactaggatcatctgccactctggcaagcctttttgtttgtttgtttgtttgtttgttttgagactgaatctcactctgtcgcccaggctggagtgcagtggcgcattacagatgtgtgccaccacgactggctaatttttatattttgagtagagacagggtttcactatgttggtcatgctggccttgaactcctgacctcaagtgatccacccgcctcggcctcccaaagtgctgggattacaggtgtgagccactgcacctggcctctggcaattctttttgtttcctggtcatgtggtttgagcctctctggatgtatctgagggtaacctggtttttattgttgttgttgtttgtttttttgtttttttaaagagctggggtctgatatggtttggctgtgtggatattgaatcatgggggtgctttcccccatactgttctcatggtagtaaataagtcttatgagatctgatggttttataaggggaaaccccttccactggttcgcattttctctcttccctgccaccatgtaagatgtgacttgctccttcttgtcttccaccatgattgtgaggcctcccaagccacatggaactgtgagtccattaaacctcttttcctttataattactcagtctcgggtatgtcttcatcagcagcttgaaaatggacgaataccgggtctcactagattgtccaggctgggcttaaactcctggactccagcgatcctcccgcctcatcctcctgagtacaccatcacacatgcaccaccacactggccttctggtcctttttaaaagggggagtttttgttctagggccaagaaaggtgtcatctctacagtcagcatggattagtgagattgggtcagacgcgaacaggtgtggatcccagaataagtcagagaacagttggccaatggtgcttgtgtttacacagctcttcccaggccttccaaagccggagctccctcgctggctcaaggtgccaaacacaggtctagagtcacagcattgcgaatttccctcaaggcgggtactgcgagctttgaatttctttcggttctgtgttgtcagcctcccaggcaccagtcaagttctgcctctggtgtcctgtccttcttcctgggaatcagtagagaaggtacttactggagggggtcactgcagggccagctgcttggggagggggtggacttgccctgaaagccccagtgagggcagtgggaagtcccagcacaggagcaggtgacaggcgcagcccccaaccacccttattatgtaaaggatttatctttcaacaagacggtgctccaagccagcgcacaaggggcagttagtgaaagcaaagaaaataatcaaatggcattctgcctcatgacctacatcacaataaattctaggttcattgattaagtaaatgtgcaaacaggaagcccacaaaagatgatagagtttatataatcataggggtagggaacgacttcttaaaggaagaagccataaagaaaaaaatgtaacagatctagccaataaaaatgtaaattatctgtccagaaatgccataaagaaaattaaggagcaaaggggaaacttgttacataaatgatagtcagatccactgcctgtgttcttcctgtataaatcccttaaggatcaataagaaaatgatgaacattcgcagtttttaaaaaaggaacaagccattcagaaaggaagaaatgtgaggaagtagacatataagcatattaaaatttgtcagttcatcagtgaaacagtgaaatacttttgtgttttacccaccaggttcccattcctgtgggcagacgagccttgcagtgtgctgctcaggaccccaaaatccttatgagtgttcaggggtcctttttgcagaacatgccctgagaattggaaatgtgcatttggtcaataatctcccttctaggaatttagcccgaggacagtgaagaggcacaaggccatgcgtggccatcatacagagaggcagaagaagcctccatctctaacagcaggaagttggttaagtaaattagaggctgtggtgctgctcatacagccattcacttattcagtcactcaacagaggtataccaaagacttctgatgtgccaagcactgttctggtctcttgagggatactacagtgaacaaaaagataaagctcaagcctaatgggaggctagagatggttggatagatggatggatggatggatggatggatggatgataagtaggtaagtatgtaggctgatatagatgatcatcaccttgatagatgatggatggatagataggatgatggctggatggatagacgataggtaggtaggtagacatagaaacagataattgacagagtattggatgagtagatagagtgataaatggatagatgatacgtaggtagatacagaaatagatgattgatagaggaatagatggatgggtggatagatatagagagatggatggatggatagatggatagatagatagatagatatagaaggatggatggatggatagatagagggagggagggatggatcaatgataagtaggtaggttgacagaaatagatgattgatagagggatggatggatagatgggtagatggatggtagatggaatggatggatgggtggatggatgggtagatggatgataggtacgtaggaggtaggtagatagatgatagagggatggatggatggatgggtagttggattgcacttaggtagataggtagatatagagtgatggatggatggatgggtagatggatgataggtaagtaaatagatgatagatggataggtggatgggtagatggatgataggtagatgatagagtgatagatggatgggtagatagattataggtaggtagatgataggtaggtagatctagagtgatggatagatggatggatgggtagatggatgataagtaggtagatataggcagatgattgattgattgattgatgggatagctagataaacatgtcagatggtggtgagggttacaggggagggagctacctttatccagggactcaggatgcctccctgtgaaggggaggagagacctgaagggggagagagagcatgctgtggctttctggggtggacattccaggcagagagaaaaagctgttccagtggcctggtgggaacttgcctggcagttccaggagcagcgcggagttcgactaagaagacaagacaagacaggggagtaagggggaggtgggctgccgatgggaagccggggttggtgtgagcagaggagtcctgtgattctacttaagttgtggaaggatccgtttgtggagcacactctgtaggggacaagggctgaagcaggggggccagccagaccaccatcaccattcaccatccccagccaccatcgccatctcccaggggagagagaaccttggcctgcaccagggagggagtcgtggtggtgcggagaagtggtcagattctggacatagtgacagcactcactataaaaactcggccaggcacagtggctcacacctgtaataccagtactttgggaagctaaggtgggaggatcgcatgaggtcaggagtttgagaccagcctggccaacatggtgagacccccatctctactaaagatacaaaaattagctgggtgtggtggtgcgtgcctgtaatcccagctacttgggaggctgaggcaggagaatcgcttgaacccgggaggcggaggttgcagtaagccgagatcgcgccactgcactccagcctgggtgatagagcaagactctgttgtccccccgttccccccgagcccccacaaaaaaagagctggttacaggcagcagcaattagaccgcgtttgttggatcatttggtgatcacccatctgcattattcatctctgagttccctagaggcgaggctggtgtgtggcttgctcctggcccctggaacacagcaggcacttggtaaataatcgatgagtgatccattacggagggcaatctctcctttgtcatctnnnnnnnnnnnnnnnnnnnnaaacatataaaaaaaattagctgggcatggtggtgcatgtctgtagtcccagctactcaggaaactgaagggggagaatcacttgagcccaggactttgagcctgcagtgagctgtgattgcaccacttcactccagcctgagcaacagagtgaaaccctttctctaaaaataaaaatgaaaaacaaaaataaaaagtacatacatgtatctgttgataaggaaaatgttctttgctttaacaagaaccttcagtgggtcagcccagcccctgcgctggaccgggctaggctgtttgtccttgcagacttgtttcagcccagtttgggccccattcacaggtatggagaggaggaagtttcaggacagtgaccacaaagatgtgactactcagaaaacctgttgggctttgtctactaaagctgaccccccaaaaaccctgtgacacagcatttccactcctggctgtttgctcaaccagagatgcatgcatgggccccaaaagactgtacaagaactcatggctgtactacccataatagctgtgatctggaaacaacccgaacgctcacccacagaagaatggagaaacacacgggggcccacccccgcagtagaacaccggccagcagtgagaaccaaccagggactgctgcccacctagacgggtccacaaacattgtggcagcggaagcagccaacgcaagagaccatattgtttgattccatttacatgaagttaaaaaataggcaaactaatctatggtgataggagtcaggctgcccctggggaagagagactgaccaggaggggggccaggcacacaggcgtgcccaagttgtgctgggccattgtgctgtgtctgtaggatttgagttcttttctgtatgtatgtcccacttctgtaaaaaggtgagttttttttttaattacagctaatcatttttatttatttatttatttatttattttgagacagagtctggctttgtcgcccaggctggagtgcactggtgcgatctcggctcactacaacctccgcctcccaggttcaagcaattctcctgtctcagcctcccaagtagctgggattacaggcacctgccaccatgcctggctaatttttgtgtttttagtagagacgggttttaccatgttggccaggctggtctcgaactcctgacctcaggtgattcacgcaccttggcctcccaaagtgttgggattacaggcgtcagccaccacgcccggccacagctaattatttttaaaataattattaaatattaatctgtgtttatacctttaaaaaaaatgcctggaagaatgttcaacaaaatattggatagagaagacctctgggtgttaacacgatcagtgactttttttctttgtgcagagaatttctaagacttctccatgtacatataaaacataagtatattacagtctgatgagccagggctttggggacggagaaggagatagaatgttttatccgtaactgatccgaggaactccgaaactcaacctaatcaagcacgttgaaaataaaggggaagatttgttaattgaatgtcatgttatgtcctcagttatgcttaatacaagataggcaatttagaattcccaattatccaattaaaatgctaattatcttgtgccttgataaggcagctctcagagagagagtgagctgctcctgtctgttgtgtctcttcctcctgctgtgaccgctgctgtcttggccgctgcccttgcctgtgattggcggatccccccttctgggcggggcctcagcatcccaggcctctctcagaccccagctcctgctttccaccggctggcctggggctccttcgcccaggacttggtgggccagttgtccttgcagacccttttctgctcagttctggccttgtgcatgggtgcaaggtcagggctccggaaggcgttagccatggcatcacccactgccagtgtttatggagttgaagcttttccctgcatcttcttcagccttcacagcaagccccgaggtcagcactgttccagcccccacctactgacagacctgaggtttcagaggcatccgggtcaaaaccataagctttgcagtcggagaccctgcgtggactccgagcccgaacacggattcagtgggtttcctgaccccagcccgtcattgttctgactgcagcatcctctgtgcagtgggaagatccctcagcccccaaagggttgttatcatgctaaatgctgcagttgactgttcagtttttcttactggagcagctacacaacctgcctcaagcctcagactgagtgggcagcagggcctggattgaatcagtctgcccacccatccccacagtgcagtgccttgtggggctccctggcaggagctgagtagtcagggagagtgatctgggcagcagtggggctccaggagtgtgacttcatctgcttgcccacatggagatggtccatgcaagcccaagaagcctggccccatataccctgtgaccatgctggctggccttctggaagccctggtgggaaggtgttgccccaggtcaaacagtctctgtctgtgggccaggactggtgtaggagcggcaggaagagggagtgaggagctccgggcagcagagcaagctgctgaagccgagcaccgcatctgctgcagacggcctgtgtctgacgctgccatgttggtgccggctacacggtgatgctgaccagctctccgctagcaccagttttattaatcatgcatttctggctttagtccgaggcttcaggtcagtcccttcttggtgacacatcacgtgaatgcctcttgctcatttcaggcactcggagcctcagagggtgctcattcctagctttgtctgtgtttgtcgtcatgctggggcctggggaaggggaggcacgcagcagtcccccagttcactgccaagtcccagtacctgctctttggaagacctacggggaacagtgctaaaagagccaggacctgcctgggagttggggtcctggataggtcgctggtgccacccaggcggcgattccaagggtagggcttgggcgccttcgcctgtgccttctgatgacccactggtcaccccagaagaagggcgtggagcagctcccctccttccatgggaattcaagaagaatgtagtacgtgcttctggttccatgcaaaaggagctatgccagggctccactggtagaaacatccggttttggctccaagtcctccatagtagctgctcccactttggggaccataaggcacgctctgctcggcctgaggtgtctcagggcatcccctgcaggactgtatggcccttactctgaaaaggattttcccttagtaagtggtgtatcacgttaatgacacaattatggtcatgtgtacccagaaaatatcgcagcaattacttaaaataaatgtgaattataagcaacttagtgctgagacgactatacacagcacaactgcttggccccaaacatcatgaggtacttctcactctctgtggctctctccctcttatgtgccccagtcctgggcgcaccccgggaaggcggggaccctgggtcagctccgtgagggcgaggggcagctgtgaagggatggtgggcacaggccccctctgtccagccagaagcctgtctgtgcgcacgtgtcccggtagctggtgcagaggacacacctccgcgtttttgctggtgaacatcctggagatgctgggagtgtgtgggcccaggaaggacttctgtagagaacttggctgcctggagggtgcgggagtgggtgtccgggccgtggacctatgcagattctgtttggttttaaaggaatagtcaagaggctgtttctcaaagcctggcacaggatgcccacgacctcctctcctgctgcctgaggagggatccccattctccagcctccctccaggcctctgaacagtgaccacgatggctaggtcactgtacacagagctccttgggtaccaggcaccattgtgtatactccatgtatgttaaatcattcgactggcatagcagccctgggagggaggcaccgctatcatccccattttacagatgaggaaactgaggcacggagaggccattcagctggccagcagcagagccaagatttgcccttgaggttggtgttgagtcccagaaggctgggtatgtggggcccagagcagggagcccagcacagggaccggggtgcggaacacaccctccccacctcaggtttgtaaccccatgtcccaactacctgctttcctaagccctctgcccagctgagggggctccaccagctctgcgcattttcactcccaagcttctgtttccggcccagcctcccctctccacctcttgagtacctgagatccattgaggcccagccggggaaagggaatgatgtggccagggccaccccttacactgcctcactaacctcttcggcgctaccccacccatgctcgaggcacatagcttggccgacacttgctgccaggcagcccttctaccgctgtctgggcagctgcagcatttttataggactgtgactcgtcttcatgttaggtgataaacttctgagggcaggagctgggccgtgtgcccgggagcgctccacgggctggatttgtgggtcccagtgggaggcccagcgacgccgtctctggggaccccattcctgcagatctgggtctgggaacttgctgctcctgccccatttgtcatctcctggcactgacagatgtgcctgccccactgacactgcagtaactccatccacctcgttattcaccactcatgcagttcccccaggttgcttaagggctctctcacttatgcctggatacaagcctcttctacccgagtcttgcctgggagaaatttataggtgagggtgttagaggaatggccacataaggaaaaacaacggggcccacacagcagccgggatgtcgttggctgggacttaggcagaccacggcctcctctcagccaatcaggaagcccctccctgctgctggggaggaggtgcgcgctgggcttgagcctggctggggtgtgtgtaccaccccatccgccttccaggtgagcaggagggagcaggggctgttagacccagctggtccggggctgcacgatgtgagtcataaatttatggaaggagcctatggagatggtcgcagtggggcggtgacactcctgcctgtcttgctggctgctgccctctgctggagagcctgttccaggtgttaattattttgggtgggtagtagctagcctgctccagggatgacttggctggacccctcctgcctcgcacttggaggagttgtgatgctgccactgccatggcatgtcggtcatccacgggacaggctgttagcctgtcctcatagcccacacttgctcctggtcatcccagcaccacttgccaagctctggcccagctgtgcgggggcacacgttgcgtccacatcaagcatgggccccagtttggaatgtccacccctcagtgctcaccgcttgaagatcagaactgtgccgcgccgggctcacacgcttccacaggccccctgtgccgccacagctgcccagaacttgggtgcccttgtgcgtccacaccccaagcctaaagtctgcagaaaacgtgggctcgttttgcccacctgttattgccaccaaagcaccagtgtgtcctcaagttgcgtcagaaaaggtcatttaaaacaaaattcaggactgaagtccactgtgaagcatttcagctttttttaggcgggcgtgaatatccagcacgtggtgctcctcctcttttcaactccttcctatggaacagtgtgtggagttgtcaacgtggccggcaaaggtgaccagtgtcgggctgcactttgcaggtgaaaactgggtcagcctttctttagtttgatgcttctgtgagctgtgccttcttgaaggcactatttttttcttaaaaagcagcaaaggcattcaaagacagttgtctccactgagtgggttatgcagggggaagcttgctgcaggcgagagagccaagtttcctcactgcctcccctttctgatgtttttttcttgtattgattgattgattgattttttgagagctggggtcttgctgtgttgcccaggctggtcttgaactcccggcctcaagcagtcctccaaccttggcctcccaaagtgctgggatgacaagtgtgagccactgcgcccggcctgccgctcctttcttgtagaatatgtgagttcctctgcacatgcggatggcatctctgtccctctgcctgtcttttctgaagccggccagtcccagcgcagcccgtggttgtctgcaggtcacttgtcccacagaggtccgctgtcgccatcacgtcgagaatgaccatgtgacctctgaggttcgcttctgttggtgcaggaccacatctcacaaagccaagggagcacccctgttccacggcgtgggtcaggcctcttctcgggctttctgggagggcgccacagaggtgtgaagtggcttctgaggccgcctgtctggcctggcgcacagggcttgccatgtggggcactgcccttgcctgccttggtaggaacgtgcctggactgtggcgaaactcagcgctgagactcccaggagcgaggtggaagcggcctcctgagcgcttgcaccacgaatacgggggcggctgaggagaggagcatgtggctttcttgcttccctggcagctcctgaaatcctttcttttcaggaaatatttcactcgcagatacccaattatcctgtgaggtttggaaggcaagtctgaaagcccattgaatctaccacagccgttcctgcataacaactgcttaatatccaatcatgacaattatacataatttgtgttgacagtgcctagaagatgaaactccctcgtatggacgttctctaaggcaggcctggaacgtgcagggcaggaccgccatgtggcgtgcccttgggcggccgcaacgactgccctggtcgggggtgggcgggtgggggccacctgggcctgtctcacgtggtggcaggtggaccagctgtggtccggcaggaaagctgttgccgaggcctcagggagggggtgagggcagctccccacgaccacacccctcaccagctgggttcagtagaggaagaccaaggcagaatggctcagtcccttggagctcaaagatccatgcagtgactgtgctaccatccgccatcctagaggcctccccggtgcaggttctgggcttagcctggggccagggcttgtctttctctccagacttggctgtggccctacccgctcagggtgggagcttgtagagtgggcccagccagcaggcagctcgttccaaggagggagaagcaggatgtgtgccccaggccttgcctctcccacatccctggagaccaccctgccctgccccacctgcaggaggcctgtcccttgccccttctgcccatagctcctgtgccctctccccgggtgagcgcaggccgtagatccagcccctcctggcagggtgggtggtggcctctgggcacggagtcacagggaatcacttcctccagctctgcagaaatgtgtggcctctgccccagcccggcttcccacagggcgcaggctccaggagtcccatctgtcctgatgtgcctgggaagccactcgccatggcagtcagtggaggctggcgagctcctctggcaggtggctgcgccctgctgggcccccagcttctctgtcactccacactggcctctgagattctgcagcctatgactgacccccaggctgtaagcctcacagactcacactgagagtttggaccattgtggggccacggcaggggagaccatgggccgagggccttcccttggggttcatggggctcgtggagtggggtgtgcctgctctagtgccccaaccctgacgcgtctctccccctgcagcctcttcgagcactactgctactcccggggcggcatgcgccacagctcctacacctgcatctgcggcaggtaagcggggcaccctggctcccctgggggtgaccagtgggaggaggtagggcagttagtgagtggggggctccaccatcccccagctcagccacacttgctcactcacacgcccacaccagcgcccggcccaagcttggaagtcgctcctccctcccaagactcccggagctgaggtggcctctgcctgcaggacctggcactgggtgaaggagggagcatggcctgcccactgcagaggggctgcttggcgtcccctccctcctgtccccagctggtcagcacagcagctaagcacaggaaggccactcctccacacgggcacacacacagcatgtggggaccgggctgtgagctcaggctgggcagcttctgtgtgcagcaggggtggagtgtggaagggtcagtgcagaaagtggtggtggtgtgtctatgtgggtgtggctgcgtggggaccagtgctgctgtatgtgggtgtgcatgtcactgttggtgtgcctgctcgtggcacatggtgccgaggggcagggctctgtgtgggtgtgtgcgcttgggtgtgtgccatcaacacctggctgggtgtgcttggaggcacacacatggtagaaatgacagtgatatgggatcattgccatgctgtgtgggccatgcacagcggcatgtgtcccttggggtgtgtctgcccccacatgcgtcctggctgtgggcgtggccccctcgtctcctgcgctctcccagccagtctccctgctctctgcccctcgggtctggcccctgcccggccaggatggagccaggcagctctgccaatgtgcacgtccccggcacatgaataatacatgtgaaatctcagtccttggaaatgttcttctctggtggatggagagaaaaccattatttctacttttatgattcccaagactcctgagcagggccataaatattacacccaggtgggggtttccttcccccctttggacagacttaaaagtcctttttttcttaaaggcatcgctcattagggaagccttctcaggcagaggagcgaggatcctcttggtttcctctctctccagcctggtcaggacgccagggcagctccaggacagccggggccctttccatagaggccctctcccctttggccaccaggaaaggaggggttccgtagggcccttctccaggcccaggaactgctgttccccttttttgctctttttttaatttaaagacagggtctccctcttttgcccaggctggagtgcggtggcatgatcatagctcattgcagtctccacttcccaggctcaggtgatcctcctagctcagcctcctgagtaactgggattacagctgtgagccacctaacccagctaattttttttgcattttctgtagaggtagggtttcgccatgttgcccaggctggtctcgaacttgtgggctcaagtgatctgcctttcttggcctcccaaagtgctggcatgacaggcgtgagccaccacacccggcccattgctaagttttacatgtgttccacatgatgcccacatcccagcccagagggcagccgcctaacgacgccttcagccaggaggctctgcctgcagactgaggctggttgccagccatgtgactgcggggtgacagggccaccatgtcccccggccttacctctggctgtggacctggtccagccacgcctgggcctgtgctggaggtggggacagtgctgctcatgggcaggggatcgagcatccaccccctccttcagagcctgctgcagaagaatgggctttgatcaccctcccccggctctttgcagtggtgagaactcagccgtgctacactacggacacgccggagctcccaacgaccgaacgatccagaatggggatatgtggtaagtagggccagcggccctggctctgtgtgtgaacagccaggccaaggttggactcaacttcaagatggcccagaagcctctgggtccctgtcctgagagggctgaccacagcaagtccctgggcttcttggcccagacttctctgccaaggctatcggcctgcgtggtgccttctccagggccaaaagcctgcaccccccagggagcactgagagagagggtgcaggagaggggcccccgatggtttcctgtgggccatgggattgtgggctctctgagggggcctgaaccatccccagcctctgtccaggctgtcctctccgttcagggggcaccacgctcgcatctttctgtcttggtgccaggagggcaggcctcttggtctggagctgggaagaccgcagggagcctcccacgctctgaaacctgccatcctcctgctgcaggagcccgtggcctctgcggccctgcgttcagcaagtcagcagtgctgacccgtggctgcgtgcagggctttcctgagcacgatgtgccgtgctcacagttcttcatagaagccacgacaaggagatgtgggcaggccctgcggcctccgcccctcgggtagtcttttctctcattggaggacttgcagtcctacccacagcccctcggtgtgcagggcagagcagctgggccgctgccccggggcagggaggaggtgtgtgagtacttgcagcctggcctctgctcagtccctccgcgttctttgcctgtgccctgcacgtcagatgtcagccagggccagcccaggcagtgcagagctcctgagagctaccccagtgctggagccctggggctcagccacagccacgcaggccctgtcttggcctccagacatttcactgtggtcactgactagcagaggatgtgccttgtccctcccagttctttggtgccctttcttctatggcagatgcacccgaacaagcctcctgcagagccctctgccccccagcagcatggcatgtcctctgaggcctgcgtggcgcccagctgggctgcctccgccttcccatcgaggagccaccccaatgtgccagctcctccagcgggagttcccatgatggctgctcaccggcctggaccccgcctcaccctacagcaggtagtcgtgggagcccaccccccagagtccccagccatgcccactgaaggacaggaacacacatgcccagacctatggacagacaaccagctgcccagagagctgccgagcgttgagctgtcagggccgagtatttgcaggaacacactcagtctcggggtcctccctgcccttgggcacatggcctactgagactgcccgggctccccgctcacccaggtccatagctgatgagctgttccagctcaggccatgctggcaggagctcagctcagaccttgggtggggccagcatatgccgccacagtagggctgtgttaggaacacggcaggttgagggtgcaagcggaggcaggccagtggaaccgccacccactgcgcgctgggccttagtggactccctggcctacccgacagcactggctccacggatcctggttcactctggcaccacagtgagccccacaaatggtgggcgagtccccagtcccccctgcgtagccaccgtgctcggggctgggagggtcagagcggagctcagctttcctcctacatgcctggggccacaaggtgactgggcccttcttctgggtctctgtggattttctcacccactcctcgccctgatcctgcgatgtaggcacctcaccccatgtgtgggccaaggaactcagacacaaggagggcaccaggcccaggtgtgaggccagaggcacttggggaaagaattggcaaactcagacttggctcagcaggggactagagcaggagagggggtggcagccctgcccccacaccgtggacccaccagtggctccagacaccacctggtgtcctgaaactttttaagagacggtcttgctctgtctcccaggctagagtgcagtggcacaatcatagctcactgcagcctcaaactcctaggcttaagagatcctcccacctcagcctcccgagtagctgagactacaggtacaagccaccatgcccagctaatttttttatttttaatattaaaaagacagggtctcaccatgttgcccaggctggtctggaattcctggacttaagtgatcctcttgcctcggcctcccaaaagtgctgggattacagatgtgagccacggtgcccagccctgaaaccttttctaaagctctttaaccctgtagcgcattctggctgggcctggaggacaggacatgggaacccagtctcacggcagaggccacatcagtgggtccccacagtccagggggcacttctgggtggctggagagccctgtgccagagccacgtggccatgagcttttctcctctgtgggctcagcacaccccagaagaagtgactgctcctttatgaccctctttatctgccccggagagggtcctggcataatcccagatgctgtggcctcggccctccgggacagcacatggcacctgcatctcccagctgcagctgtagaggcaggagtgatccgaggatgttaatgccaagtccaaattggtgatttgatttttctagtgctaactttgaaatgtagccagtagagtaattatgagtttattgtagtcaatttattatgcagcatttagaacaacatgttttgttgattactgctactgccagattgctggtggcatttatagtccattgttgtattgaaattgatctgccgagcgcctactgcgttcggtaaataataaatcagtctgttatcccaacatgaaagccacgatgcttcatcctaaggtatgaaactaaagcatgagcccagcgtagaattcccccgaagccgagcgcctcccagagcagtgcgcctgctgcaatggcctgctctgggttttagtcctttgactgggggaagacaccccagagatattttagcttctaggaatgggattttgtggggaatcagagctggtccagggcagccagattatacagctgtactgcagaagggtggggggtactaagaggaggccagccttttccatccctctctccacagtcccagatatgagcactcccccaacacgcacacacatggatacacacacagggaactgaccgaggctgtgctgcgttgcaatgatcacagtgtaagcccctgcctccctctctcgcagtggccacctggcacagcgtgggccctcttcgggcaagagcagcaggcccggtgtcctcaccgagctgggcaggccaggccctgatgcccacttccagcagctggttctgcagcacaggctggaggtgggagccacaggcagagctcaggccaggcctggtttattctcagacagctcccgtcccctggttgtcctgttccgtgtcttcgacccaaaagtgtcctccatgatgcgtacatcaagcggggtttggggctggctaggcccccctcctactgctccgtccttacccttccagcagcttccctggagctaggctgagtccactgttggccacagtcatggtccaagagggcctatgaaccagacaccctggttcctgcttcaggtcaggcttgtcagccaaggactgagacagacttcctgagggccgtccctcacccccagccagccacccccgggccccttcccgcttctctgggtgtgatgccaccacacccactcgcatgcacgcaggggtgagggacgggactttgtggtggctgcatacaccctcagcctggttcagagccaagcggccccatgtggggcctgtagccgtcaagcctccgggggttttgctgttgttctcagagtcttttcccgctgtgatcctggggttcgccatgaaccccatctccaagtcactgtaccagaggggccattcgctgctttttttgttttcctttttaaacccctcaggcagaccttcaagaacagggttacaaaagcgcagcacacttgctaattaacactttcaacatgttcacacagattgaggtgcctgagatcactggaggccattcctaagtgggaggccccagaagacccctccccactcactccagccccgaacaggtttgtgtgagcacagaggtggccaggactcatccccctgcttctcctggtcgtcttctgagcccccatgtgctgccccctccttccacaaacagcctgggctgtgggcaccagagccactgcaggccagcaagcttcgcagctagggcagggggcgcatggtccacgattctgggaagcagtgcgcccagagagggaccatcccttgcagcactccgggcctgaggccgccccaggtcctggagaggctcaccccacagggcagaggtggagggctctggttgggaaagcagctgggacactcctcctgcctccctcacttcccgatcaggtggtgggggttggaggggggccttaatctactgtggcccctcgcagagtttctagagcacgtgtcccaggatgccccaggccttggttgtcccagtcgggatgcagctggtgggcagcaagcctgtccttccagaactggccagaagagggcagtgttgtctcaggacgatgggccaggcctcacccctgctgggcctggtcttttgtgttgctcctgggcatggggggtgggtggccagcctggctaggaggagagacctgtcccagccctcacactcagcagccaccagtgccctcttcccctccttccctggctagataatggcgagacctcgaccctgcaggccatggggtgcccgctcacccaggacctcagcagccaccttggcctcacatgggccctgcagcctgggatgcggccagcctactcctgctgtctactcagcctgagtctgtctgccaccatcgcgctgcggaccccatgggtgacaagctcctggggacccccttgccccactccacctggggcccaatgctttggtgagctccagggtagagcgttgcccccaggcctgctctctgctgcctgtcccagcccagctctcccccaccaccttgctgtttcctccgagggagacttgttgtcaccagccagccctgccctgagcactctgcggtcttaaagacatgctcttggggccacagaacgccctcaggagggtccagacccacaggcatggccgtcccatcccatcccagttaggagcgtgctctccattctcacccgtcctcatacacatggacaggcctggttatgagcagacacctgcccacgcgttttcggtttgtctcttgtttgtgcttcgtggctgcaccctcctcagctgatgtcatgacccacagtttgaacagcacttgtccagacatcctgggtgctcccagacatcatgagacactggtcaccaaaaaaagcaaaatacagcatgtgctgcgcgtgtgactctccctcccgcctgccaaggccactgccctgacgcccgggcctcaccccactgtgctttcctggcagctgtccttgtgtctcacccacctctggacgaggcaccccacagtgctcttctgggacccggggcccctcactggtgccgtgcctctgtccatgtcatgcataaaatggcaatgccagttccctccagacacccaggaggcccacaggacgcagctgctcccgtcacccaccgcgtgcaccagggattgctggctctggggaccagaagctgctgctgtcatgggctggcggcatgggcagctttcctgtctgccgaggccctggaggagtggccgtcacacgaaaagggggcagagatgcccaggaacgcactggagagaggtccccttggtgggttaggccatggcacggggagcctcagggactccgagtggtggcctttgtccctgctggccacgcttggagcttggcactccacggaaggcctggctgggagcaggcagccggcccatgcaccctggagaccacagctcgccaccgtgtctgcaggggccgcccactggggcagatgaagggaagagtgacccatacgcctccctttcggtctcacactgaggagaagcaagtgcttcctgctgctcagcaatcccccagcctggcctgggacactgaccagggcagctgcacatcggagtctgcagtgcttctgcagccccgaatatgagcgcgtgtaaactgttggattgaacagctaagagccgtgccactactcaggagattcaaatgaaactgcaaaccaagtccaaagtggctctcatataaacattgcagcatttcccccagaaaactgttcccaagccttccgtcactggccgacccatcttggaggccttctgcctctgggctggcgggtccctgccatggggcccagggagggtctgggtgggccagtggtggcaggtagcccaggcccaaagctacccagaaggagccagaaacagagccctcagaacacatgtggggagtgagacgccagcacgttgtttggagatgcatcctgtctcccagatgtcttgtattatcatcgactcactcggccaaagatggtagggtccccagacagccaggaaggagggatcctgcgtgcctgttctcgattgagccaacgtatgaccgaattctccattgtcggtttgcattcagaggatggatgaagtggacgcagaggagcgggagggagatgatttatcaaagccatggctttcgtccctggattccagaaaagcttgcatctgaataacttatgtgtgtagaaactctagggggatttttttaaggcagaaaaagatagggaactgagaggagcacgaaaatagacttcagctccatacccgagcctcgctgggcaggatggagctggctggctgggtgtatacttccccctccagaaagcagatcattttcaaacaagaaatgcagttacagtcttctacaagctggaagataaagtcaggctggcggatgatatccaggcacccaccatcccatggtctttctgctttgctggcgggagtttggggaactgggatctgagtctggtctgcactggagaacagtcttgtttttacattcctagatgatttcattgttcggggtattcttgtgggcttcctggttgttgttgttgttgttgttttttaaacgatagttcagtttctgctttttcttttgtgtcagcacagtccggtaggactttctgccccggctgctgttgcaggtcaccttctgatttggcgcctcctaggaatccgtgtcccccatactcctggccctgtcctctctgcccaggctattcttgcatgttctaaaaccaacaaaccacaaaccatttttcttggttgactctggggaacctaaatgaaaatgcttagctgtccccaggcaaaactgggctgtgttccatatggctccactccccagagctacagcagtgggagggtcccattttacagatggaaaaactgaggccgtgaaggttgagcactgccgccaggacctaagaacccattgctgggcttcgagttgtttaccctcctgactcagggctttcctggacccgtgatctgagcctcagtttcccttcagtttagagcttccatgtgccccgccttcccggccagccgtggggaagcctaggccctgtgcaggagtagacttccaggcagttgttggcctaagcagcccactgcatccagagatcctgtgactctgacccaccccaaagctccctgtcatgcaggcggggctcctccccccagcctgagagtcacctgaggtgttatctggacctttctgccctgttgacactgcttatggtgttttgcaatcagaaaagacaggagattaaaaagtgcccggctggggactttggatttcagcaaagcgtcctggccgtgcattcaagtttttcctttagaaatctgcctccatggggcggctgacgctgcctgtccagccacgtggccctgctccttgctccacatgaggccagggtcctccaccccctggctccctcccatgggacaggaccccccacaggcaggcgcacaggcagcttctggaatgtttgtggagtggttgtgtttaccgtgagagctgggatttgggtgagaggccctcgtgacggaagccgcggctgtgcccctggcctcagacttgtcaggactcacccagctacagatggaccccatgggaagcccagggtggagccaaagaggggcagctgcacttcctcagccctcctggctctggttctggaccctgcagacgtggtgggctctggtcctagggctagaccagcctccgccagccagggtcatcaccatcagtgtcgtgacttggccatgacctgtgaaggggctggtggacccgagggttccgctctgtgtctgctgcctgcagcctcccgaggtgcctaggtgggatggatggaaaggggcaccacctgcgcccctccgccccctcagccaggcccagccttgtccacctgggctgcttccggggagtcctgagagccaggtttggatccagcagcccttcccgtatcctgtcccttccacaccacaggatgagcgggaggctgcttctctgccgttgcccagagagggccctgaggtcctttgcacagcaaggacaggccctactccttccgggccctgctgtgccaagggtccctcttacagggcatccagagggcagccccagccaccatcctcctgcctcagcaggcctcctgtcatctgtcccacactgtctgtcccacgccatctgtcccatgccatcctgcctctctgctggcccccaggcccctcccgtcctggacagctggcacctctgccccattctccacgcccctgcctgtgtcctgctggtctctgcctgccaccggagggtgccagggtgcaggtggacagggtgagggggcccacctggcttcggggacatgtggccagcaggccctgggaaagccttgctggacatgaggctgtctggcacttcctccctgccctccccttgggccctggcagaatatgtccgtcccatccccatgggcagaggggtagtgtcgggcacacccctccagctagggggccccagagctgcagcagagccagaggccctagccgccgactgagtgtctgcccagatgctctgggtcctggaagaagcaggtggtgtgattcaggcccggagttctaggccgtgcatcccatccggggtccctgcccagccccctcctcctctgcttcccacaagcacggcctcagcctgtgctctgtgctgggtgcagggagacctgggagagcctgttggggtgccgggtggaggccaggcagcgggcggggtcctggggcatctctgcctctccttagttctccaaacaattctccatggctctgagctcttggaggccaggccacaggggtgggtgtcatctgcataggacagccccactcccctcagccttccctgcctgggctgagccctgagtccctttttccctggaagacacaggtcttccaggatggcttcgggtttccttgctgcccacgcacccgtgggagacaccaggtggcagttccccacaccggtctcattgtgagggggagttgcatccaggacccgggccagctgccctcgagtccagggcaggtggggagcggtaagggtaagggggcggtggcaccccagtacccacttgccctgccttcctctctccgcagcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgagcagcgggtcggtggggggaggcgcatctgacgtggcgttgggggcgctgctatgtggcaggtgcctgcagggaacgggtctgcattgtgtgacttgaatctgccacactccagatgcttagtccctgagattccagtggcgtcaggtctccagggtcactcctaggaaacaaggctgaccaccaggcagggacagacagaaccaggaattgcggggctcaggccaaggctccccggtctgctggcctccacctgcgcatctccactggccactagcacgccagcctgtctcctgctttgtccttaagcggtgtctactccagggagggctcaacccactctggacactggcatggggtcagagcaggttcacgtgccgctcagcgctctgtgaccttggatggaaagccctcctctgggtggccgtttccacatctgtaaatggggaagcagccgactcatggagactgagttaagctgtgtaaagcacctgcaaggccgcctggcctgtggtagtgccctgcaggggtcacagtcaccaccatgatggccatgttgaggccaggatgggcctggtgtttctcccagcggccagcgtaggccaacctgtcctgccctcagccctcccaaccccaggcagcctgcacaggccccactggtacctcttgacctcccaccgcgcgccgttgatgtctgtcagggcaggcagaggaggtcccctggaggggagccagcatcctcccaacaaggccagctttcaggagttccccctgggcacctcccgctgttctcccatgcccgttgcagaccagcactcgctttccgagtgaaactccctgtggtcactccactacgacactgggcaaggcggttggagtacttagcacctctactaggtatcgtaaccccgtagctgctcgtgccactggcatacacattagacaaccagttgtgcctcacgcagtaggattggagaggtgctctgggcatttgtctacgctcttcgcaccacgaaggtagacgaaatttgatggaatagtgggtgcttgctgcatggttgcttgccattgcatagcacttgctcagggccttgcttactaccagcaacaccctcaccagtgaatgcctgttggattgcaaccacgagcactcgggcacggttctcttatcgggatgcaccaatttcgctcgacctaaccgctctagggcctggtcccttcctaacagcgcactatgggctcccacgactctgactgagatctgttcggcagctgccagggtccagcctgcagcgcagaggggctttccctgcccacaccggcccaggcacagctggccccccaaggcacgcaggttctgcatctttggttataagcaacagaacagtctccagccaattcggtcatttggggctgccacaaattcacagaggtggaaaatcaggtctgggctggggccagggctgcagtggcacaggacaatggccctgtactcacagctggatcgtctggccagggcccgccctcagcacacaggccccagccaccttctgcagcctggagtccctccatctgggtcgaggtcagagatcacctcgtgttggccatgcccaggtcatagtccagcccccccagcttgcccccaccctcgcccactgcctctcacccacagctatacagacctccagagagacaggcaggcccaaggcagccccctgtgtaggggagctcaggcgtcctccaggagccaggtgggcttaccgcgggcagaggggatagcccagtagcgcaaggcttcagagtccaggatgcaggccccagacccagagtgccccgagcccagccccagctctgccgcctgctggccaggtaccttacttaagccccaaacaggcgaaggatagacccctgctctcccaaggcagagtccacttcagagcgggcctggccagctctggaccgtggcatctagttagacatggagtgccctctgttaaggacccacagagagctggcagctgccaagtgcgccctcagtgttcaaggaaaaaagaagaaagaaagatctggagcctccagaatgcggcctcagaacttgatggctcggcggtcgactgagcagtccctgcggccccacagcccgttgctgggatgagttgcagcctcgatcgccggcccaagtgtgcttcagaggggccctcagccaccgtcgctttcagaggaggcagactgtgggcaggcctttgcagatggtgcccagtccagcctccagagcccccaccagaggctgaggagccgcggagggacgctgggggcagtgccaggccccagccccacaccttcacgcatccaacaggaacagagcttgacaaacgcatgagtgcaagcagggggaccccagatgtgccccaaaaggaagacaggacagaaaatccaaaagtcaataagcttgtgatggggtgacagcgctgatcggactcacctggtttagcagctgccgaggaaaacagcattttctgcggaattgctttgcttaaaaagcagcaggccgggctctgtggctcacacttataatcccagcacttgggaggcgggcggatcacttgaggtcaggagttgaagaccagcatgggcaacatggagaaaccctgtctctactaaaattacacaaattagctgggcgtgatggttcatgcctgtaatcccagctactcgggaggccaaggcacgagaatcgaatcgcttgaacctaggaggcggaggttgcagtgagccaagatcacaccactgcactccagcctgggtgatggagtgagaccctgtctcaaaaaacaaacaaaaaggagctgccacccctgagtatgaatatacaggtgtctccaggcagatgggtgggtgaggacagaagagcgccagagggtatggccagcgggcccttgtgggtaaaaggaagagggagtgagagcgtgaattcccgtgcgcctgtgaaaaccataaaggaggtgcaggaagggacgggacagtttgcttgctgcgtcccttcttattctttctgactcttcagccatgggaagcatcccccgttagctgtcaaatccaatccagcctccacgaagcagtcgcccaggggcgccactccttctccttccttcattctggggatgagaatttcttgctcagttttaaataccactagtcactcgaatgaatgatcagtgtttcagatccagcaggaggatttggcaggtgagcgtggcctgtggtgtattcacctagtatctgtgagcccagctcctgtaccctccacggagagccctccgccgggcacagcctctcaggtgggccagagtctctcagacacccttcacgtacagggctggcctcccactctgtagctgtgccaaggtgggctgtgtcattgcgaactgtgtcaccatcacatcaagtggtagtgtcagacatccacgggcagtcgtgaaatccagatgtccagaaagtcagagccccaggctgcaaggggctgagcctcccagcggcgaagcagagctttgcagcctgtgaggggcgggggcccaccaagcccagcaaccctgtacacccaagcatcaggctgaggagctcagcttggtcagcaggcagtgccgggcccatcagggtgccagaggtagcaccaggccacggggagcagggcggcggattgacgcagcataggggccaaggcctggggggtgtttggtgggaaagccattgtcttacccctcagtctcctgtgctgaaaccagggatggcccagccctggctggcctcacctgcaggaaagcctgctgcggcctgggcaggacctgggtggcatctccacagctggcatcctggccagctccctggcccaactcagcagccccaattctgtccagaaagtggccagacctcggggcaagtccccaggccccatgtggcactgagaaaggcctgagctgggtctcccatcccgtggtgctgcctggttcatgctgactcttggggcaggcacaggcctcaggcctggcaggggtgtctggggccaccaggccaaatccagctaggctcatctcagaccatgggaggcaggtcctcccccagccccgctcccacccaccactgggcttcgctgcccagacccagcctggggtctggaggatccctgtgtaagggaatggagcagccccccagcagcccccccacacctaccacccacactgagctgtgtggcattggtgtcccccaagggcagagttggactccatctggatcacacacagtgaaggcccgtggggcaggccctgggcccacagagctgccctccggatggggcaggtcgcctcccgtagcatcgaggaggccgtggccaggtcagccccctgccttgtcccagcggaaatgccctgggttcgtgggttcaattcctgggccaagacaaacaccccaccgagactgcccgactgcatcctgtgaccttccagggagagtaaataaagcaggaaaccccatagctaagcccaaaggagaggcaggaaagaatggtcaggaccctggggggttgaggaatgcaggccttggcccctgatcctagggctggtgggggagcattcctcactgtcattcacagtcggcgaggaaggaggctgcgctcgctcagacggagaccctaccctggcggctgggagtccacaggcgggtggcagggcaggcccagcagctgcaggacctcggggagtgccatgcacgggaggttgggtgggatccaagctcagcgcggctcctgtgttggggcaggctgcccaccccatgcagacccctgcatgcatggtgaggggaatggggggaggcgctgctgggacggatgggcgagcccggcagggtggccctgagtcagggtctgcattggcacagccacagcaggaaggctgttcctagaagcagcacagctgtccctgtcccgcgggctcagtccctgcagccaccctggagctccagaggaccccagcactgagggccccatgccctccgcctgcaagccccagagcctcctgtagcctcgcctcccagccccgacccagctccctctctcctcacccccccaccctccctggcctccccgcctttctctactctttcctgtgctcacccaggagcctcctgtgcccctgtcactgggggcccagctcctatcaacctggaacagcaatggtggcccacgattcatgagctcttttgtgtttcgttcccccgctcctggctctgtccctgccctcagggtcctggccacttgtgagtgacgggggtgctgccaatgtgaggtcagaggaggggaaagaagtggcaggaagtgtccccacctccaaaacagtcctgacggggcgagagaggggcactgaggcgcgggatgaccaggtggctgggagaggggcccagcagcacctgccccggcccacctggcatgtgtctcctgtggccccgtggtcagggggcacctctgccagctttgctcccctcccagccagcgccaggggcaggggcccagcagctagacttcctgtcagtcctcatcctccgagacggcgtggagtgcagggctcaggcagataggcatggcggccatgtgccaccccagtcatagataccctctgcggcaggtgccaggacggggaggactgtcttcagtgtgggcaccatgtccacccctcctgccggccgcaatggtgagccagttccttggcctcttcttactcctcggggcactctgccagggtgtgggggaggagactcgaggagcagcctgggccaacacagcaccctgctctcacgcagggtgagtgggtccccagaatttctggcagcagatggggttcttctactcacgtcccgtgcagggtggggtgagctggaggtcctcagccccgtgccagctcagccagccctcagggcctgccctgggaccccggccggagcctgctgtcctacacccctagagcctggctcacacccatccatcccgagggccatgttccacagatgaagtgcgctctttgtctggaggcagctctgaggatgctgcctttgtagctcggtcaggcccgggagccccctggggctgtcacactccgggtaggaggcctcggggctgtgatggatgctttgaggctccaaggagctggcctgggccctaggcccagcaggagcgggtgctgcctgaggagaccaagtggacccagaagaccactcaggggctacgctggccacacctggggcctgggtggcaggagcagcggggcttgttcctctgagccctgccatttcatgaggcgcatgatgggacactaacctagaggccaccctgcccgttctagggtctgagtacacagaggagtgggggatggggcacaacactggctgcaggagagccatgagagaagctggggctcctctccttccaggcgtttaccaagcatccgcagcatgccaggcacagagcagagtacgggcaccacccttgcaaggcccagaggtcataaccaggcccagctgtgctgtgtgttccgtgaattctcaaagtacaggaaggggtaatcagagagggcttcctggaggaggagcctcaccacagaggcccacaggaggaatgggagcacatctgggaaaacgggcttggaggaggtggccccagctaaggaaacagcaggtagggagggccagttcttgggacccgtggccttggtccagccaccccacccaggagtgggtgagggagaggctggagaccaggccaagctgagaacctgggcttcgtccggggccgggaatggccctgtttgccccgttcgttctaaagagatggcccaggcatccaaggggtgtgcagcggaggagggagccaggcagactccaggaggggtggggcaggtgcaggggtgcttcgggaaagccagaatgaggtttggtgcttgctgggggttggggcacgcagggcagctggtgcccaatttctgctgtgtgattctcagtgtggcatctgggtataggctggctaggggccgggggtgccttccagcctggactagagagcttgacggtgtctccaggctgccagggtgggaggagcctgagagtgggcccaggccagcaagggaaccctcaagttggtgcccaccctgccagcctagtgcaaggacagtgaccctcacacactccaggggcccccgcccaggcggtgggtgtcgtaaccaccatccgggccagaggctggggccaagttgctggaggttgaatcactgtcacaaccctaaccacacacaggcagaaactccctgctcccggccaagagagctgtgtgcaaggccttccccgagggtgcacaggcaaggaagaccagcggcgccaaggggacccccgggccggcacatctgggcggcgccgggcctgcccccgggaagggccaccgcagagcatgatttatacctgattcccgccctctgcggaggctgggccaagaacgtagcccactgctgaagttagcctggttggaaagctggctgcacttcccggggctcccctttggtgaccagagaagggcgcgtccgagaggaagcagttgagctgggcttggggcacgagccactcacaggaggcctcccagccccatgtgccaactttgcaggctgttgggagacctgaggggcactcactttatgccaggcccagcggtgccctcgggagacccccaccctcggagtgagacatgagaagcaaacgagcagatccgtccaggggacggctgcaggctggatggaccgtgcaaggagaaatcaccaggcctgggacagcaaggcaggaaggtctcctctgagaggggacagcttttatgcagagaccccttggatgaggcatcacaggtcaaggcctggcacaggccatagcaaagggcctgaggtaaaacggcctgtgtgccttggggtggtctggcctctggaggatgcagcagcagagaggaagggcgaggtgggccaggattgtccgggctgggttctcagagaagagcagcagcagaggctgggcaggcttggcgcacacccccaggaacaagtgaatgtcaagtgtggaaccagggctggctggtcatgcgcgatggaggaatggtggccaatgccactgtccggggtgctgcctccagcccccaggtgacacagaggctctgagagcaaccccccggggcctgccttgtggctgtttgtttgaccagcggcagctgaggctcacggaggtggggctgtttgaccagcggcagctgaggctcacggaggcgggggagcggccaagtgggctgcagttatccaggtgtccttttccgggatgttgtgcccctcagaaaagccaggggtgcgggctgggccagccaggggtgtgtgtgcccagggctgccccagatacagggcagctgcagccagagttgccccaggtctgcccgggctctcccccacgccagaccccgggctctcccccacgccagaccccagaccccgggccctcccccacgccagaccccagaccccagaccccgggacggcctccccgacgccagaccccagaccccgggacggcctcccccacgccagaccccagaccccgggacggccgcccccacctcagcccctaggaggctgggctgatggggagctgggctctgaggaggatccctgctctgtgtggggggtgggggcaggtctgggcatctccacccctgccacccttaggctgctgccgtggctggggcgctgtgctgtgaatggcgggcaacagccatactgcctgcccaaagccgtgcacccccagcccgcctgagaccccagcaccacagtggccaactctggcacttaaaggggtcccaacatgaaggacttgtgcccagtgtgtcgggggtgatggcctgtgtcccagtgtggactctcatccctgttcgccagccgagcccatcatctgccctccgccagccacagaggttcagaaccctgcttctcacagcccagccctcgccagctcagggtctccccggcccctcccacagcagtgatcgggaccatgcagagcaggctctggctctgcgccaaggcaagcctggcagggaggccctcgggagccaaggtcactccgcctggtggggctggacctctccaggaggtgccgcagggacttgctgggcgccctctccagccagtgagctgcacattgataggggccccccgccacgtgcctggccagagtgtcctggggccccggcctctgccagcacgtggcctgcccaaacccagcccccatggggccagggcaggaggcctcaccggcctcgagtccttatctggtgctcaagccaagtccagcagtggaagctaccatgaggagaggctgatgctgggattccacagagtccggggatgggacgggcgcacccgtgggctgctgaggctctacgtggagagctctctaagggcctccttcctagcggccatgctccagagccccacagagcctgtgtggcccccaaagctctgtgcttaggaagttctctctttggtggcctttgccccacaaacatgcggcagagatgagttggatttgaagccgggagttggacatctggctcccctggagatggtgcccctgctgttggcaggcggggccccgaacccctgccagccagctcgtggggccgtgccagccgcaccttctccccagaaacctttgctccctgcagcagctccaggggtgtttcatccccattctgggatgtgcagggacccctcttttcagcctcgggcttccccactgcaccacagcagcaaaaccccatcggagctctgagccagggtttgggtctgagcctcagggccagagcccacagagtctcctggtgtctgctactggggagacgtgcatgtttctcctggtgcccagggatttggctaggtttccctgggcccagaagcataggctgttcagggtggacacaccatgggctacagagtagacccaggctgggcccttggctacaggtgacaggaacctgcccctagaggcagaatggagggacaagaagggtcccgagggccagagcttttgctgggaaagcccagcacggggggccaccctagtccttgtccccctgggcccccgatgtagtacccttgccccctcaccccccacctcaggccctcccaccacagccagtgtgagggcttcacatctcccagcccctggccctgcggtgttggctgctgggctctgtggctcacggcagctccctctggcccacaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagaggtcagtgtggacatggcaggcggagtggcctgcccatcagctgccgctgagcctgacccccagggcagggtgggactctaggaggcagcaggcgtgtattgggatggcagggatgggccccatggctccctgtggtatacggaggccatgaggaggggggaatcgggaccctggccaagacaggggtgcatctgtgagcattccacagaactggacatagaggcggtgctgtctgcctgctgggcccaggtgtcacctgtccagaaggtggcacacagtcaggatacggtgcatggggccccacaggacagtggtgctaaggacaggtcttcgtgatggagctacgtggcacccctcacgtcctgccgcctctggcttcattcagacctggggcgtggggagttgatgaggccccacccactggcgactcaccctggcccctcacaaacccggagcagccctgctctgccgctggttcgccctctcctcccaggcccctgggccgcacacctgggaccctgcagcctcctcatccccaggcattctggggcccgttggcagataagggaggctgggggccatctccagacaaggttccccggccctcagaggaccacccagagggtaagtgaggcttggggaggcccaaccgggcaggtggctacggcctctcggctgggcggctggggcgctcccatccctgcccttggcgggctgcccaatgcagggggctgattgtgcaatcgtgcacgccctggggccccccagccagttagccaagacaaggctcagcctcttggctgcagggtgttttgaaagcactaagaatgattttttggcagggtgggggcagtggggggaattgcttaagagaagcattattattcaattatttttttcctcaagtgtaaacagttaaatttggagaaacaaaatcagttttaatttcctaatgtctattcatcccattgtgtgcagggagccaagagctgggccttccagacattgttagctgaggttcgttattcattagtcgccaaagcgctttttttccaccagcaaaaattggcagcaaactgttttcatcttttccagtaagcacctctttgtgctcagagtctattcttctgacagataaacattgtggaaaaaatatggcttttcctataaaagtcatttgttttatttcaggcctgcagacacatctggggctcctctgcttggagcccaataaaagttgaggccttgtcaagccctgtgcccaggcagaggcgagcatgggcgcggtgagggcaggacccctccccacccctgaaggctgcgcttcctgggccacaggggctcgtgccctccccacatggctctgcgctccacccggcccagcccttcccattctcttatggcgcctgcgccctgttctcagcaggtcccccgggcaggcccctagagccaacaccctgaaggggcagctgcgccactgggctgaggcaggccttgccctgtgcccgctggggatcccttctaatctcccccaccccacttcagtggtggacctcaagatttcagaggggaggaaagttcgtttctctggggaaacaaacctgcccctcaaccgtgtaccatggagcagccggggtgggcccatggggatggaggggtgactggaaggaaggaaacctgacgttggcaggcccttgcttcccccaggcccctggcttcgattgctgtgggtggagacagggacggacacttcaggaatagcatgaaggagagggatgggcggcggtggggtgggggagcccagcacaggcttcggatgacagggacgggaaggtcctggagcagagaccctgggacccccagcagcttctgggcaggagacaggccccagctcggtccacatgcacctctcacctgcgcagagggactgtcactccatacggttcctcagccacggggcatccctgccctccggcctcagctcccggtcagcggcccagaggcaagtgttgtggggccggggccacaccagccaggctgtggtgtctcctcatcgcctcccgcctggcctgctctctccaggtcagcgtggctgtccctgccctccgtggaatcagtcacagcctctctggccgtgcccagcgtggaggccgagccagcctgtttctggttaccttacgtgaactgctaattggagtctgatgttcttggcccccaaacagtcagaaatgacagctcccgctccagcagctgggcttcctggggagggagtgcagccgggcagggcaggctcatcccctgaccagaaagcatactcgtgcccactggctcagaggccctggccgccggccggatggtgccccggggacctgaggcgagcaggagctctcctgtaattcccagagcacccgctgccctcagccaagctgaggccccctcagctgtgcctgtgagtggacaaggccaggctgggtgtgcactggggcagtgtggggcgcagacaggggcccctgcagggagcggctctaccactgtccctcaggcgttctccaaggctgggggctatttcccagggccctgccgtaaggccccgagctctcctctgggagccacacctgccaagccacgcgcacacggcacatttgcactggcgcactaaggctggcagacccaccctgatgacggcacctgtcctccctggacagtcacacggaaaacctgggcctcggcctaggggagctgggaccacgacttctggggccagtttctacttgggctgcctggaaggaaagctgtggccccaaggggcttcacagccgccttaagagcttttttggcttcagtggtttggcatctgccactcctctggccagcagcggggcctggctaagggcagcccaaccctcagccagccccacaggcctgtctgggcagcttgccccgggtgtgtgcacatgggtggccacagggcttctcaagcaagccctagggtagtgtggccagggacactcaagatccaggggtatgtgcagggtggaaggtcttatcagggtgcccatggcccagcacagcaggggcgagtctaggctgaggaccccaatggtcaagagagcccacgagactggcaccggccctcacatgcccatctctcctgatgaggccacggtgagccctggagctgctcatcaggcccctcacctctgttccccacagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtgagtgcccacgggccccattcttgctcccagaacatctgccacctccactgcagctgcagactccttagtcccaagacaggggccctagtgacatcttcccttgaggtgggcttagcctgccccttcgtgtggtctgtcacaggatggagcctcacccctcagtaggaacagacagagatcctgcaaaacccctgcccgctccaggggctcccatccacctggcaaagacagggtgagcaggtgacatgggcagatggctccatgaaggagcccggaggccacccgtctcccagggagtgtcagctgctcccatcccatggtggggtgggcctggaatgggcccggccctctagcctggcacatgaggctgctctatgataatgtgtgtctgtcggcttgacccaggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtcctttgtgcgtggcttcccctttattcctttgcagatgagcatttgggaccccgtgcaccctgaaaagatggctcacctggtgtcagtatcaagtcagttccaggaagatggtgctggcagcacaggccctctaacggctgcttctgcctcagactggcctggcgggacaagggcagagtcctccccgaggagcctgctttgagcccctgggactcggggctctggtgtcaccctgtcacttgctgcaaggtttcccaagcctaacaggcatcagaaccactggggcatttggtaagagattcctgggacccccacagaccatctgacccaacgtctaggggcaatggcccaggaattgtgtatttcacaagcgcccgccagatgctcctgacagacaagtgtgagaagtactcctaggcaaggtggttttagcttgtcagtaccagcgcagcccgaggtttgaggtggggcaagcaacgctgcaggaagatcctaggcactcaggtcagactggccaagtcaccccgcgccatgcctttgcgcaagttaaagggcggactgatttaacacaagtctttctgatacggtcactgcctccaaactagatttctgaaggtggtagaatcatgtagcgcttgagctgcagatatttaaaacctgagacttgcagggatctcttgtccttgatttctttttcatgtgggacacactagccaaagccagcatctgtcggagacactgccaacgaaggcagcgccacagccaatttgcagagaccgcttgtcctccctaagtgtagtccttgaacaaattctaccaggcaggaagccagccagggcccagccatgcctggtgaagtatctgtccttgcctctgcttgtccagttctcccagggtcccgcagaacagcccacccctggagctggtttctagaattctgtacaccattccaggtttgccttctcacagagctcccatccaagagttcccaagccaaggtgaaagatgacaagtgagaaggatgccacagatgaaaccatgaggatgagggggtggaaaactgtagcttaagagacgttttcagaagtcaccaaaggccagcacagtggctcacgcctgtaattccagcactttgatcacttgaggtcaggagtttgagacctgcctggccaacatggcaaaacttcatctctattaaaaatgccaaaattagctgggcgtagtggcacacacctgtaatccgagctactccggaggctgaggcaggagaatctcttgaacccaggaggcagaggttgcggtgagccaagatcatgctactgcactccaccctgggcaacaaagcaagactgcctttttaaaaaaaaaaaagtcaccaaagagtttaatacaaactgatttcttcctatggtaataacacagaagtgcttataaagtggtcacattaaaataaaagccaatttcagttccaaatcaccatttatcttatctgcttcttagatttataacatccattctttaaggttttctgctggtacagatacattccctaagctatccatctgtgacattgagcagtagcaattatgtctttttagccaggcgcagtggctcatgccttgggaggccaaggctgaaggatcgtctgaggctgggagttcaagaccagcctgggccaacatagggagatcccgtctcttaaaaaaagtaaaaataaaaaactagctgggcgtggtggcacacgcctatagtcccacctaccctggaggctaaggtgggagaatcgcttgagcccagttcaaggctgcagtgaactatgatcgcaccactgcgctccagcctgggcaacagagcaagaccctgtctcttaaaaaaaaaaaaaaaaaaaaaaaaaaagtatcttctgagtgtaaggaaagttgaagagttcaccaagcacttctccacccctgttcccctgtgacagacacagtctggtgtacagggctttaatttcc

SEQ ID NO: 11783 - DNA, 7766 bp, Human
ctttcctttttcttttcttttttctggagatggagtctcgctcagttacccaggctggagtgcaatggtgcaatctcggctcaccacaacctccgcttccagggttcaagcgattctcctgcctcagcctcccgagtagctgggattacaggtatgtgccaccacacccagctaattttttgtatttctagtacagactgggtttctccatgttggtcaggctggtcatgacctcttgacctcaggtgatccacccgcctcggcctcccaaagtgctgggattataggcgttcttatgccatacgtttagttaacttttggagtacttccatgggactatcaatcaagacatcctgccttcccctggctaagagtgaaagacagggtggagagggaacttgaaccaagagaggtcagtcaaaatttgtatcacgagcagagtcacaaacagaaattggtggaagctcgttcactgcaacaacgttgcctggataagaacttctaattcctgttaggcagtcccaatagtattgttaagttcctgttctttcagggctggctttacttattttgtgagctactccatacacttctaataaattccgttttagtttaaattagcctgtttgtttctgttgcttgtaaccaaagatccctaagtgacaaaaatgtttaatttcctgcttgatttagttgatgctacctctcaactttgtatttttgctattcacttaagaaaagcttgtacataacagttactattaaacaagcacctaatatgtatccaggtgcttcatatggataaactatgtctagtcttaaaactctgtaaggtaaaaatcatatatcaatataatgtcttttggtagagtaaaaaacactttttataactataattaaggacaatttgtaaggttttctctcctattggaataactaaatccaaaccttgtttttgagggttctcattatgcaaaccaattatttttataacataagggcctctagggcagtaaacaataccttctattcccagctatttagcccagaggtggcacttcccagaggaagggaggagaggtggaactctcatccaaattcaataaggctgtgtcagccaacttcagcgagacaaagctgtacataacataaaagcactttacaaaccttaaggtaaatcacattcattttggtataaaaacggcatgaaaggaaactttctgtcaagtgtccccagtgcatgctagttacaattcataaagctccctctgcgttagtactgtattcatatcgctggtggtgacatatacaactgtgttcaaggatggagaccattttcatccagtatagcaagtgcatgcagttatgcttgaatatagccaaaacctggaagacgttaaactaccagcttggatgaaaattaaccgtctcaagtactgaggaacaagcatgaacctttctcaatccaatcatctttccttataattggcggcaataaatctaaggctcctatctcctgctatgtcgctttaaatcatttctggaaggctaagacatataaattaaccaccatccctgccgcacgcgtacagcaaagtcctttccacctccagattcccttcctcccaccgcccctagcttcatcgcctgcaggaacacagggctcagcaacgggcccgagctctggctcccggcgccagacgtctgcgcggtgccccaaacagcttgtcaaaaagacctcgcagagagaggttcagagctgtagctttccagcgaggctaccatgcagacccagctacgaaaagtaaaccaaactagccaaaaccagcccacaagggccctcttctgtttcagcggggcgggagcggaagctcaggtgggtcatagagttctctagttctggtttccggaccgcattcggaactagagcgcctctcttccgccaggcatcccagaggtcctggtggtttcatttccgggtgcggcttctgtcataaagcggagacctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggtaaggtattaattcttggaaaggttttagggacaactgggtaaaaaacaaacgaataatttgtgcttatttggtagcctagcgtttgaaatagccaatttgcaaataacttgtatcccatgacttaagagttactgagtctctgttatgtgtagagacctgtactgaatacccagcatttcagggtccaacagtgacttatttaaaacaaattgtgtagactttagaggaaaagggggaatgtaaataggtgtagaacttgtgtaatggaatgaatttcacttattgctttattttgctttaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggaggtaaggccttaacatttccaaaagatctttagttagtaaattcgaaaatcgtatcccagttttgtaaaattcacctccctgttaactttgtggcatttcatagagtcatagaaaagctattccttgtgtccataaaacaaggactgtcatcctggtaaccttcatcattctaggtatactttagtgcatacttgctatgtcccaggccctgtgctaggtgcttgctttacgtacattatctcaatcctcaacacaacccaatgaagtaaatgtattagctcacagttgaggaaactaaacccaagcagttaagtaccttgccaaagtcacgtaggtacatagaaggtggcagagctgggattcaaaccaaaccaatacaattctaaagactgtgctctgtgagccactgcacccagcctaagactgtgctcttaatcatgatgctgtgctccttctagttcatatttgtgttctcctacaagttcaaatatatacattcctcaatactgctaagttttttattaagtgaattgggtttttttttttttttctggatcactatcttccactaaaaaaagggaggtctatataatcaaattctctgatttatctttcaaaacacaaaaccaaaccctaatcatgttactaaaaacaaagcttagctcctatgctcctaaaatattgtaagttagaatcacttagaatagatccttaaggagatagtaccagtctaccaaccattcagtcccccagtgattctgatgaaaaatgtaagaattgcatttatattagtcactttgtaatgatacctaaataaagtttctctctttgcctccttgttcttttctcccaacagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctggggggggaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagactacctttgactttttgaggtgtttttatatttaacattttgccaattcagtagttggaacaaaaatcctctgctccgacaacaagaattcagcctcatgcaaaataccttgcatcaacttaagaaacacttaagttgcctatgtaggagcatttatgccattggattggtagactggtgaaaacatgggttaaaaaaaaatcatcactagaagaggaaggatgaaaatgatttttaagagcctctgctgacataagtgttttccaatactttaactcattttaccagttcaaagcacattctctgatagcacaaaggtgataaagctaaaattttaaatagaatatcccatggattttaacattaagacatttatgatgttagttgagacaataaaaaaaattaaaacttttatatgccataagaaaagtataatgaattttaaaattctcattaaacctcaaaggttttaccaaagcaaatatcatggttaattaaacatttttatttatttattttttttttactgagacagagtctcactctgatgccaaggcttgagtgcagtggtgtgatctcggctcactgcaacctccacctcctgggttcaaacaattctgccacctcagcctcctaagtagctgtgattacaggtgcgtgccaccacgcctggctaatttttgtatttttagtagaggcggggttttgccatgttggccaggctggtgtcgaactcctgacctcaagtgatccgcctgccttggcctcccaaagtgctgggattacaggcgtgaaccactgtgcctggccaattaaacgtttttaatacagtaataagtgaataatagaattgagccagattcaggattgaaatgatgtagtcctccatgaagaattcaaagcaagagttttcatctcaacctaaggaggaaaacatgagaatatcagtaattcaaaagaaaataaaagaaacatcttaaacataataaaaccagtgtccaaacaggatacaacacacctgtgtggaaaaaccacaatcagaatcagctcagagagaagattaagagatcataccctggtcaaagccaacagtgaagcaatggcaataccaggtcaggctctacttcactcatcatcgcatcgctgcatttcatctccttgtattacctaagagcaacccagtgccctagtttcacatccaagaaaacataggcttacctatgaaaaaaaataaagccttctattcaggtaagtttcaaccatgggtttctaattaatatttctttctttctttttttttttaagacagggtcttactctgtcacccaggctggagtgcaatggcctgatcatggctcactgcagtctcaacctccccaggctcagacgatcatcccacctcagcctcccaagtagctgggactacagtcacaggccaccatatctggctaatttttgtactttttgtagagacagggttttaccatgttgtccaggctgttctcaaactcctggactcaagcaatccaccttctccagcctcccaaagtgcgcggattacaggcgtgagccaccatgcctggcctgttttcaattaatatatatatatatttttattttgagacaaggtttcactcttgtcaaccaggctggagtgcagtggtgtgatcatggctcactgtagcctcaaactcctgggctcaggtgatccaaccaggtagctaggactacaggtgcatgtccaccatccctggctaattctttttaaatttttgtagagacaagagtctcggtatgtttcccaggctggtctcaaactcctggcttcaagtgatcctcctgccttggcctcccaaaaccctgggatcacaggcttgagcccataagcctgcccttagcctagttcaaaagcaaaagctttagaaaatatattttctttttaaaaatttctttattttttctggagacagggtcttgccctgtcacctagcctggagtgcag

SEQ ID NO: 11784 - DNA, 95318 bp, Human
tgtttatattttagaaagcttcacaggtgggatgaaatattttacaatgctataatcatgtatggttaggtaaggagcaggtaatagctcagtttgtgtgtgtgtgtgtatgtccaaggtcactgtaaatagtttaccccagctggaaccagcctttctccctccccagagataccacactatttttagcttagattggataactctttatatacaactctttgccaaggtcccagctgcttcatgtttgcttactttgatattttattaacgcctatttagcatttcaataaactccagaatgtttccaggttactttttgtagtattacgaaaaacacactgatcatttaggcactgtattaggctgcattcactcaacatttcctgaatgcttaaataccaggtccttgggatacaacagcgaacataacaagcaaaaatttctgccctcatgcagcatacattccagtgactacatatgataaaaatccaaaataatagaggccacactggtctggatcctcaagtgatccgcctgcctcggcctcctagtgtgctgggattacaggtgtgaaccaccgcgcccggcctgcaaaagtcttttaactggcctccccatctccaaactctatcctccatattagtgttgcaggactttttaaaataaaaccttggtcatttaatttctcacattagaaaacttccactgtttttcactgtttacagtagaaatccaattctcttagtatggtatataagactcttcatgatctagccccagtaaaacactctacagtctccccacccaatatttttttcaccgtatcccttccatctggccaggctgagtcctggcagccacgaccccctatggatcatgctggtttaaatctcctgggttgctcatgttattcctgctcctacaaagatctccatcttcttgtctacctaaagaaaacctactcatctgtgtgcaatcaccataaagacttatctctcttctgcagcctttcctgcaatttccatacctctggcacggacaatcaccttttaaaaataccccatataaatttatcatagcctctacagtattttgattacacttaactaattacatgacttctcttttagtcttcttctctaatctcttgaggccatggaccatatcccattattttgaatcccaaatgcctagtactgttcttggtatatggttaagatgatcatacgacttggtttgtgcctgttgacctggcttaataattacaccctctttactctcaaaagtatcttggtttggcagataaattatatttggtcattctccacatagtatatgcctggcaataaatgaatgaatgagcaccagcatctgagcacttattaccatacaatatatacatgtatagtaatactttttaaaaaagttgtatatgatgatgtgctgcttttttgcttagcttcattagaactggccagctcctttttctcacttgccaagcatggggagttggtttggagttggtgtttcatcttttccagttacagtgtgaaagtagcccaccagcccacgctcttattcctaaagaccgcagtgactccacggacttaagttctcattgcttccagtttccttgggcaacgcagcacgcaattttggacgcgctgcgtggtttcagagtcggctgtaacttttctcactttataatcatcaggaaaagttcctgatgccagtcttccaaacgctcaatgaaataaaaaccagatagcaccgcagaggaggctgagatgcaacgacaaaagctgtcgtaattattaataatacctaaccctggatcactcccctgatagatctgtatctttgcagcaggcgcaattcagtttggattcacccaaaacaaaaatggtctccgtcggagtcaacgccctttcctgtgcggaccaatcagaatctcaaacacagggcacggggcccacacttccgtccggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggtgaggcggcgccgcgcagctggggccggggggcggaggcggaggcgggggccagccgggctccagttcctcgcgctcgagggaaagcccctctgagcgtagacggttccgcgggtccacgccagggggcagaagaggcgctggtcggcgcttctcctttctttgccgagtgcgaggagttggtctgaagcaggagtcgatcttccagttgtgtgcaagtgcatatacgtgtagcctagtagcccgtgtccttgttccttgagaccgcgctgcctccgccacgtgtcacacgcccaggcacacgtccccgtagggagagccgggggagcctgcgcggtcccttggatcggtccgctcggcacagcagtacggggaagacggtctgagccagaaccgacccagggctcgcgagttggcccacaattcccagtctgcattcgagcactgagctgcgacctgcgggctggccttcctaaggacgatgctcctgaatggacgcctggagtcccacgggtgacaccatgaaatatatcaagttcagttcttacctgtagttgtctaacgaggaatgcacacattcgcaagtaggtgttacagactccagttaattgtctcccgtcgcgcgcattggctcagcctgtggttaaagctgctcaggaggctgaggcgggaggatcgcttgagcccgggatgttgaggctacagtgagctgagatcacatcactctgccccagcccagtgagctgagatcacatcactccactccagcctgggtgacagactgagaccccgtcttaaaaagaaaaaaggccaagcgcggtgcggtggctcacgtctgtaatcccagcactttgggaggccgaggtgggcggatcacttgagttcgggagttccagaccagcctgaccaacatggagaaaccccatctctactgaaaatacaaaattagccgggcgtggtggcgcatgcctgtaatcccagctacttgggaggctgaggtaagagaatagtttgaacccaggaggcagaggttgcggtgagccgagatcgtgccattgcactccagcctgggcaagaagagcaaaactccgtctcaaaaaaaagagtccatctagtccgtggactagatgaaaaggcgtaggttcattctcgcttttgccttaattcatgtcctagctattatacgcactgaagcgagatgcaaaaactcatttcataatgtcagtggtctattgtatttttttgttttgtcctacagcagaaaaaaatgttacttctaaaactcagagaaatacttgatttattttcattattagctcttagtgcttgcacattcagatttacatggcccaccagttagactgaagactcatgagtctataatggtagtagttttctttttttcttttttctttttctctttagagacagggtctcaccctgttgcctaggttgagtagagtggtgcaatcacagctcaccgtagcctccacctcctgggctcatatgatcctcctgtctcaacctcaccagtagctgggaccacaggcatgtaccatcacacctggctaatttttgattttttatttttgtagagacagggtatcactatgttgcccaggctggtccggaactgggtgcaagcgatcttcctgccttggcctcccaaagtgctgggattacaggcgtgagccactgtgactggcctgtaatgctacttaaaatcttatgcaaaaactctttaaagggaattggtatttaaaaaaaaaaattcagtcatgtttaaatagaagagattttcccccttggtctctataaaaagtaaacataacttttaaaatacaatggccctttggtaaaataatctttgacaggtaacatattaatactgttttcagcactttattaccaccagttatgtagtaaatcccaccaagtatctccgcattcatattttgttttaaaatcctgtgtgagatgtgttttagatttactggtgaggagtgcagtccctggggtctgtaagccagaggtttctcatctgtcagtaggaatgataacaccaacttggaaggtttgtgtctctggtgccttgtctggctacagagtaggcccttaagtatttcacccccctgttaggtccatgtctgaattccaatcataggtgcaatgggaagttgaatatttagtaactgaagtacaatatggaaaaacagaaatagagaacacatttggtattcatgtcccaaaaactttagggagaaattgatcacctgaccatttggtattcaaggtcccaaatactttggggaaaaatttgtggtattaaaatcaggtatcaattacttgataactccttgactttcgatgttaccctggcaggttcaaagggatgaccttgattttttttctctttaggctgtggaaccctactaatattggatccagatgaagctgggctaaggctttttagaaggtaagggggctgaaattattaaaggtatatattgttgctattaaagccttaatagaattaggttttgactctttgattaatgttttaatatacagtataaaaggaaccttggcgtttgcataggatgaagcttatttttagctgattgtggtggtgcgcacctgtagtcccagctattcccaagtctgaggcagaaggatcacttgaggccgggagttcaagaccagcctcgtgggcaacataggaggaccccgtctctaaaagaaattttttttttttatgcacagagtctggctctgtcacccaggctggagtacagtggcgccatcttggctcagtgcagtcttcccctcctgggttcaagtgattctcctgcctcagcctcccaagtagctgggattataggtgcccgccaccacacccggctaatttttgtattttttagtagagatggggtttcatcattttggccaggctggtctcaaactcctgacctcaggtgatctgcccaccttggcctcccaaagtgggtattatatgcgtgagccactgggcccagcctaaaaatttttttaatttttaggccgtagtcccagctacttgggaagctgaggtgggaggattgcttgagtccagttcaaggctgtagtgagctgtgattgggccactacactccagcctggatgacagaacaagactctttctctcaaataaaaaacaaaacaaatctgaagcctgtctcttagtgtccactcataaattataaaatttaaacataaaaaaatgtggagcagtatactgtgtactattacatttttggactactacattccactggactgttttttttaacctttctgaatctgttgccatatttgtcaagtacctactctacttaactcccgtagttgtgcagattacatgagatatacgtgttaaaatgtgtgataaattgaaagaaaaaaaaccataattgttattttttttgttgtgtagctgcctatgtaagtgttgtatttttttgttgtttgttttttcctagtgtagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtaggagggaaatctttctgggctgattatttttctttcttcgactttggttgaaatccatttggggatggacacatggagaaatatcttcaggggacaagtttaaacgttagcatttcttatacatactagatgtcacttattatttgattattcaaacataaagtacctcttggcctaaggagtggggaaagaaaagaaaaggtcagtcttctcattaggcagaaagaacacctccagcagtgtactctggcaccatttcctcctgagaggcccatcactttctttgtgctctaagaatgtgcttgccacatggtgccttaaggtagaggtaggtggacttttcacatagacatcacaagattgcctttggggcttcagtgagattcccgaggtgtttcagagtatattggagcaagagcataaaatactgagtatgaggcagaacttactgaagggattttatatctaaatctggttcatgtgtctagattttgtgtgtgtgtatgtatagcatagaaaatagtttgggcttcagttgtactaacatacatgtatattttcagtgaacataaagacatcctctttttgtgtttttaccttaaatgttttaagattttccttaagggagcagtacatccttcagatgaaaacttgctaatctactttcaaatttttgtccaccacagtgcctggcccgagaaggccctcaataaatgcttattagatgcaagaatatcagtcttttgtggtaaagattagttatgtgaggggtccagatgttttatagctgtagctattgacaatcaagatttctaagattgttactgaaataatgaaaaattttagtttctattttaattatgatagctatttgaataaatgtagttgtaaattactatgttttcagggaattactgaatattaagacaattttggtaaaggagaaattttagtttcaggataatcaatgcacgaatctctacagaacagtatgtccaaaattcagatacttttgtggaacctgtgtgaatttgtgtgtgtgtgtgtgtgtgtgtgtgtgtgtgtgtgtgtgtgtgtcagggtctcactctgttgcccaggctagagtgcagtggtgcaatcttggcttactgcaacctccaccttctggaatgggctcaagccattctcatgtcttagccacccgagtagctgggattacagacgtgcgccaccgtgccctgctaatttttgtatttttagtagagacgggtttcaccatgttggctaggctggtcttgaactcctgggctcacatgatccacctgccttggcctcccaaagtgctgggattataggcgtgagccaccgtgcccagccaatttttgtgtgtgtgtgtttttttgttgttgtttttttttgtagagatggagtttcgctatgttgcccaggctagtttttgtgatgtttgacatctttttataccacttgtattataatgtatttcttttccttctttcttttttaaaaaatatttttcttttcagaagttttttttttcctttttcttaaatctttggtgccttttattatctatataaattcaaggatgataactgacatcataaaataatatagctatttaaggtaaattcaatatattgacttaatgtttttctttcaatcaagtaaagtcgttgcttcatttatcctaaaacagtaatattcatgaaacaatggggttgatggctactttagtatgtacatttatttgtttttagtgtacattgagataagtaagtaatgaataaaataaatgtatgtaccagttaaaataatctctggtgtaactactctctggaaaatactgttctaggatatcctggatggatgctcactcagtctttacttcctgtcagtgaaagtaaatttcactttctcttgagataacttatttgacttttaggttgttctgattattaagaaactgcttcttgtaatcccaactctaccttctatagcaaccaactgctgcttttagtgtctttctctgaagtggcaagaccaggtccagcccctcttgtccaggaaacctcttgaaaatagccatcgtgctctcttccagactgtgcacttgtcatttcattgtcctgtcctcagatgacatgatctgtacgtctttcatccttctgatagcctcctttgataatcctgtttttcaactcccctttcaacatatacctaatttattccagaaatgtgatgaagggctaagctttataagattttaccaccatagtcttgagcccctagctctaataatattacctaaagtggctatacattgttctcagccatgtcttagtgttaggttactttgagtctgctagtaacacacttacctcttttgttatttgaactgctattaaaccagttttacatcattctgtgattttgcagctgatttcttgaaccgaagacacacttctgttttttaattttttaaatttgttttgcgtactgctattctagttagacttcctcgttttcttttcaaatgcactttttggtaagcgtttgtatcaggatgccttgaatgttagtgtaatagaaaacaattaaatggcttcaacagtcagagtttactgtttcacatattttgcttggttatgtgaaaaataaatgaagataacctttttaggtatttgttacagcagcacccctaattcttggcaccagtttctgcctcagtctgttcaggctgctgtaacaaagtattatagactgggtgccttataaagaacagaaatttatttcttactattctggaggttggaagtccaaggtcagggtgcccacatgtttgggttctgatgagggccctcttttaggtcaaagactactactgtcttttcattgtatctgcaggtggtggaaagagaatgagagaggtctgggaaatcccttttataagagcactaatcccattcatgagggctctacattcatgacctaattaccccccagaggccctacgtcctaaaaccattacactggggggttaagatttcaacatgtgggttttgtggggatatattcagtccattgcatatgccagatactcaaaaatacttaaaaggatttaagctcaaatgagagttttaaggagctagtaaatatttgttgaataaattaataaatgaggctgagtgcagtgagtcatgcctgtaatcctaacactttggaaggtcgaggtgggcagatcactgaaggccaggagtttgggaccagcctggccaacatggcgaaaaccccgcctctactaaaaataaaaaaattagctgggtgtggtggtgcacacctgtagtcccagctatttggtggctgaggcacaagaatcatttgagcatgggaggtggaggttgcagtgagctgagttcgtgccattgcactccagcctggacaacagagtgagaccctgtcttaaaagaaagttattaaaaaaaaaagttgataatgaacatagccaatttctgttttttttttttccaccagtatgttcagggaagctgtgttgtgaaatagaagagcaactaatgggtcattttcttctgtggaagagagtatataataaagacgtatagcatggttttagtcaatcttggatttgaatcccagctttgtaagttacctgttgtgagaccttgcgtatgtcacatatttttcctaaacttgagtgtttttatttgcaaactaagtttattagtagtctgtatcacagaccagcattgaataaatatgagctagtattattatttgctcttattataatagggtttgaaaaatgtaaaacaagttagaacttttccagttacccactttaccacttgatggctatgtgtccaacagtcaattttcaagttgtcagatgaagcaaaaaagagaaatccaagatttagatatattttaggctttgaggagtgaaggtcttggtgaaatgaaaagaaagaaaaacatggacattatctgtgtgaatggttgctaaacctagcatcgaagtaggaatcaaattcttctgtctattgtttaactggtgtctgcagaggtcattatgtcttttgagtcccataaaatgcctttggctttgcttattctaatgctgctgaatatataataaaaatttttaaaagttcagtgagaatagaaaaataagagtgaattgacaattttatttcactgctttctgacttaaaacactgtgctactgagagtgagttaaagtgactttaaagatgacataaatcaatgtaatatattaatttctaattttcagactaatgagttggcttatcacaatttaaaaatgagttaaaatttgttctcatagtcaaataacaaggtttatcaatttgctgaatttttataacatatttgatccattgaggtttttgagcattgcttataaaaacttatttttgacctaagtatacaactattagtattctgttatggaggaaatgtatttgcttatacatttcaagagttaaaatcttgtttactttaaaaaatgaatcaattatttactttttgataatgatagaagctgagaagtcaataatgataggtattgtattagtctgttttcacattgttataaagaaatacctgagagtgggtaatttataaaggaaagaggtttaattgactcacagttccacatgactggggaggcctcaggaaacttaaaattatggcagaaggtgaaggggaagtagataaccttcttcacaaggcagcaggagagagagaaagagagagagagaaagcaggggaaactgccacttttaaagccatcagatcttttgagaactccctcactatcacaagaacagcatgggggaaactgcccccatgatccgatcacttcctaccgggttcctccctggacacatggggattacaattcaagatgagatttgggtggggatataaagccaaaccatatcattccactcctggcgcctcccaaatctcatgtctttttcacatttcaaaaccaatcatgactttccaacagtcccccaaagtcttaacttattccagcattaacccaaaagtccaagtccaaagtctcatctgagacaaggcaagtcccttttgcctatgagcctataaaataaaaaacaagttagttacttctaagatacagtagggctataggcattagctaaatgtttcaaatgggagaaattggccaaaacaaaggggccacaggccccatgcaagtctgaaacccagcagtgcagttactaaatcttaaagctctgaaatgatctcctttgactccatatctcacatccaaggggtaggctcccatggccttgggcagctctacccttgtagctctgaaaggtgcagtccttatggctgctttcactggctggcattgagtgcctgtggcttttccagctgtacaatacaagctgtcagtgaatctacctttctggggcctgggggacagtggctctctcctcacaactccagtaggcagtgccccagtggggactgtgtggggccttcaaccccacattttccttctgtactgccctagcaaaggttctccatgagggctcctcccttgcagcagacttctgcctggacattcaggtgtttccatacatcctctgaaatttaggtggaggttaaactcttgtcttctaaactcttcttgtcttctgtgcacccacagacccaacaccacatggaagctgccaaggtttagggcttgcaccctcagaagcaatggcttgagctgtaccttggctccttttagccatggctggagctagagcagctggatgcagggcaccatgtcttgaggctgcacagagcagcagggccactcaggcccacaaaaccatttttccctcctaggccgctgggcctgtgatgggaggggcttctgcaaatgtctctgacatgccttggatacatttttcccattgttttggctattaatatttggctccttgttacttatacaaatttctgcagcaggtttgaatttccccccaagaaataggtttttcttttctacctcatggttaggttgcaaattttctgaacttttatgctgtgcttcccttttaaatataagttccaaattcaaataatctcttcatgaatgcatgtgactatacacttttagaaacaaccgggtcacttcttgaatgctttggtgcttagaaatctctttcaccagacactctaaatcatctctctcaaattcaagcttccacggatctctagggcaggggcaaaatgccaccagtctctttgctaaagcattgcatgaatgacctttactccagttcccagtaagttcgtcatctctatttgagaccacctcagcctgaacttcattgttcatatcactattagcattttgttcagaaccatttaagaagtctttaagaatttccaaactttcccacatcttcctgtcttcttctgagccctcacactgttccagcctctgcccgttacccagttccaaagttgctttgacattttcagattatctttatagcagtacctcactatcctggtaccaattctctatattagtcctttttcacactgctataaagaaatacctgaggctgggtaatttataaaggaaagaggcttaattgactcacagttctgcatgactggggaggccttaggaaacttacaatcatggtggaagcagacaccttcttcagaaggtgacaggagagagagagcaagggaaactgccacttttaaaagcatcagatcacatgaaaactcacgatcactagaacagcatgggggaaactgcacccatgatccagtcacctcctaccaggtccctccttcgacacgtggggattacaattcaagatgagatccgtatcaggtgccaataaaaaatattaatgcagaatgacaaccagtcctgcatttaaaactagtgtgttttcttcagaaatgcatttatgtttaaaactacacaacacatttatcaactgaaggcatttttttctttgcatcctgtttcttttttaaaaattgaggaaatagttggacttgatatatttctttttgcatatttagtcatgcccagccattcattttggaataggttactgcagtaagattttattacaattgataatagccatttaaagcttttccctgtaaagattgtgattgtacagaaaaatagtttctagttagatgtcacttgaatcaattctccctttttggattttactgccattaggatgtgatatgtcatcacttttcaattctcatgttttaaaagcatttaccttcttttggctttgttttatattttaaagtttagacttgtattaaaaaaggcagacctgtctctacttgtagcacatattatatgccaggcatgtgccagtcattgaagatgtaggtataaataagactcatgtgctgttctctgattgtagtttgggacatgcagacaaaccatttagggtcccacgtaaattaaaaaacaacaacaacaaaaaaaacaaccattccgtacaacatgatagatattgaaaagaggtatctagaaggtacacagagaggagaaccagggactgccacagaagagttgctatttgacctgagtcttgggtagttagtagtttttagtagtttgctaggtagccctaagggaaagggacattttttgttttgtttttatcttgagatggagtctcactctgttgcccaggcagactgcagtggcacaatctcagttcactgcaacctctgactcctgaggcaagcaatcctctggcctcctgagctcgagcaatcctcctgcttcagcctcctaagtagctgggactataggtgcttgccaccatgcctggctaatttttgaattttttgtagagatggggtttctccatgttgcccaggctggtctggaacacttgggctcaagcaatccacttgccttggcctcccaaagtcctgggattataggcatgagccaccacacccaactgaaaaggacatttctgatggagaagagcctctacaaaagttaagatttgtgaaagagcgtggcatgtccacacaaccagatgtcctttgatgtgcctggagcatagagtgtgtgtactaggagatggtgtaatggaggtgggtaaggatcatatcctaatgggccttgaatacctggatggtgggggttggactttatgctttgaaaattcaggagaaagatggattgtgtagattttgggccacacactgtgggcagaaaacaggacatacatgtataggtaagtattagccattttctacttaatctgcttctttaagtattagctgttaggtaggactagactacaattcaggcatttggaattttaatacttaacataaaaaaggtgtgcaaaggcttgtcttaactctttagttttttgttttttgtttttttttgagatggaggttcactcttgttgcccaggctggagtgcaatggtgcaatcttggcccactgcaacctccgcctcccaggttcaagtgattgtcctgcctcactctcccaagtatctgggctaacaggcatgactaattttgtatttttagtagagatggggtttcaacgtgttggtcaggctggtcttgaactcctgacctgaggtgttctggccgcctcagcctcccaaagtgttgggattacaggcttgagccactgtccctagccttaagtctgtggttcttaaactttgcagcagattagcatcactttgggagcttacaaaaatttttttttcttttttttttttgagacaaagtcttcctgtcttgcccaggctggagtgcagtggcatgttctcagctcactgcaacttccacctcccgggttcaagcaattctcctgcctcagcctcttgagtagctcagattataggtgtgtgccaccgtgcttggctgatttttgtatttttagtagagacaggatttcaccatgttggccaggctggtctcgaactcctgaccttgtgatccgcctgactcgtcctcccaaagtgctaggattacaggcgtgagccactgcatccagccaggagctttaaaatatcttcatgcccaggtcacagtgtctggggctggagccagacatcagtattatttaaagattcccagatgatttcaatgtgcagcattgtttggaagccactgccttgacttggtaagtgttcaattctaatgaccttcgtaagtgtgttatctagtaatttggagattgcaatattcaaaatatagatttaaaaaacctttaataaaaggagcgatttgatttaccttgcaaaatcattattcccaacccattatctaacctcaaagtttctaaaattttttaaagaagagaaaatgatagttttaaatagatggaaactataatagaatatgttcagatagagaaggactttgaagcatgactgctgctactatatctgtagtctctctcatacacacagtgtaggtgtcaacactatgcatgtctctgaagtgagttagtgagtgaattgtagatagaaattaaaatccccatctctgattttagaatctattaaaaagcatatgtaggagaattatgcaatcttatttgagaacttatatgaaactggaaattagttttgctgcaagctaatatgaggtgaaattattggtagagctatgtaaatatatgtaaaatttgttttacataaagaggaatagaagcatatatatttaactatagctgttatatattataaatatatatagtgtatatacatttcaaaaagaaacaatggaaaaataattcaaaaactaataaaaatggttaccttgaaagagggggtaaggtagaaagcaggggaagggggaccagaatggaaataagatttcttcagatataacttgtattatagttttgaccttggaaccattgaaatgttttatgtaattaagaatcccaatatgttaataagttggaaagaaaaagcaattgctaaaaattgaaaacaagcacattaatctaaagatctatcaaattggtgccataactaggtattgaaaataattattcaagtgactttaaaaacccagtattgtgattatacattcctaataagatcagtctaatgaacaaaaataattaggcctgggcatagtggttcacgcctgtaatcccagcactttgggagatcaaggcgaatgggtcacttgaggccaggagttcgagaccagcctggccaacatgttgaaaccccatctctactaaaaatacaaaaattagccgggtgtggtggtgaacatctgtaatctcggctacttaggaggctgaggcaggagaatcgcttgaacccgggaggcagagtttgcagtgagtgaaatcatgccactgcactccagcctgggcaacagagtgagactcttgtcacaagaaacaaaaacaaagaattggaaagaaatttgaaactgcattcaaaaaaattaacattgttactttgaaactcatatgtaccttgtaggataaggcatatcagtaattatgtcattagaaactgaaagttttagccgcgcttacgcctgtaatcccagcactttgggaggctgaggtgggcggatcacagggtcaggagattgagaccatcctggctaacacggtgaaaccctgtatctactaaaaaatattttaaaaaattagccgggtgtggtggcggcctctgtagttcagctgctcgggaggctgaggcgggagaatggcgtgaacctgggaggtggagcttgcagtgcgccaagatcgcgccactgcactccagcctgggcgacagagtgagagtctgtcacaaaaaaaaaaaaaagaaactgaaagttttaaagtgagagaaaagcgttatgagaataaagaagtagaagcgatcttaaagttaaatggggaatagttatataaacttgtgatttatttttctctgtctaaaaaaagtacatatttctttgttttttgcacagtaaagatttagaagcagtgacaactgagtagcagtgaatattcttagtgccctgagtatggcctctaaatactgtttgccactaacaggaatagtgtctttggagaagtcatttattccagagctgagcaggaatgcaagatatcttcttgtgtcagaaagcaggaaagctatgaaaggccgctggagacatatcaaaggtttagaaggtacaacttgaagggactctcactggccgaagatgagactattggaacaaccaaaagaatgaaagcaatgaatttaaacgccacacacacacacacacacacacacacacacacgtacatgtattttcagtccttacgtggagatggagttgtgattaggaaaaatgtagtcaccattgaagattattaggacatccagctcattattctgaaaattgataaacaaaagtaaagaatcagtgcatttactttccctttcttgtatgagttttattgtggtattataaaatagttgataagaaaagttcttgctaatagagttctagctaataaatgcagaaggaataacagaattagaaaatcactatttagtagcccgtaatgaaataatgattaggcagggatcatgtggatgctaaaaccattagtttaagattgaaacattctgtgaacaatcttaggatcactaaaagtgggtcaaccagaaattatatgcctcctaatataattggaagctaaaaaacatgaactgaatctgattaagcctccagatctaacttctaatttaaaggaaattggaagggtagagaaaaaagttaattaccaccatgaggaaacatttgggataatccagaaggcaagacattctacaagaccaataacttggttttttcaacaagtaaatgttatgggatgtggggcagaaagagcaaggtgtcaggaggaggactgtcctagcttagaggatacttaagagacataacagctaagtgtaaaatgtgggtcttgtttgggtactgattcaaataagccgactgtaaaagaaacatttttgggacagtcagggaaatatgaataaggactgagtgttaaatgatattaagtagccattgttaatcttgttggggtgaaattggcctgtgcttatgtaaaaaaagataaaccagccttacctgctgaagtatttaggaataaaaggtctgatgttagaatactccagcagtcagtcattcagtcagtaatgggacagaagaaacatgatgggcaacatgttgattattatggaaggtgtgtaatgggtgcctgggggtttattatactattctctctacttttatgcatgttttaaaatttccgtaatgaaaaaacctgaaaatttaagtttcagggctgggtatggtggctcatgcatgtaattccagcactttggaaggcctaggcagggggattacgtgagcccaggatttagagaccagcctgggtaacatggtaaaaccctgtctctacaaaaaattaaaaaattagctggtgttgtggtgtgcacctgtggtcccagctacccgggaggttgaggtgggaggatcaattgagcccagaaggtggaggctgcagtgagctgtgctcgttcgtggcactgcactccagcctgggtaacagagtgagatcctgtctcaaaagagaaaaaaaagagaaaatttaagtttcaccttaaaagaaatatatagccctttctaatcactcagtaattaaaagtcagtgaccctttcctttgtattcatacagataataataaaaattctggacatagttttttatttgacaatttttaattaagtagaccaacttaaaaagggcaatgctttacagtagattaaatatgagctctttgggaattggtttcagtaataaaatttgtcctctcaaactgtggttttgatgaggttcagatttcataaagcagcacaaaacattgtgcggtgggtttttttcttttcccattttcctggttaattttcttcaccactgccaagagtaatttaatcagataggcctctagaggaccctgctcttaaagcataaagtcaggcactgcatatctctcttcctttttatatttaatttgaccatttgccatgcccactatttgagtgggtgtggacggggaggttgggaataaggaagagatggaagaggagactaatagaagatgtgcttttcattcagatttgtttctcttttccttcattcattccagaaacttttattaactctactgtgtgcaagatactgtaccaggctagctgggaagacaaaacaccttaggcatgcccttgccctcctggggtccttgcactgtctggggaggcaggattctggttgtctaatgtctaatgtggtaagcgctgtgaatgtatgcagtgttatgggaagggaggatttgtctggggaaggggcagggagggcatcctttggtctaaaggggaagttggaatgaattattcaagtggagaggccagggtagtagtgttagaggcaaatgaaagagcatgcttgaccagagaggatagagcctgtgtgcttagagctgtcagcgttttggccattgtgccaagatcagtggaaagacattgcagattttaaaaatcaatgaaatattttatacattataaaatacatgtaagatgtaaaaatggtatattgaacacacatattcaccatctagcttaagaaatgaaacattacctataccattagcgtcccctgcttaccctttctagtcttatcgttcttctctctgcttttttttcttcctcgcttcttcccaggagtaaccactagcctgaattttctatttatatattttttgcttttctttctatttttactacatatgtatgcatccctaagtcatgcatagttttgcatgattttgacctttgggtagtaagaatcagcatggatgaatctcacataatgttgagcgaagatgctaagttgtaggagctacatatagtgtgaaaccattgaaaggctttgcacaggggagtgacatttaatttgtattttctaaagattactttttatgcagtgtggataatggattggaggtaaacaaaaatggatggggagagcagttagaaggatgttataatctaagtggtaacttatggttgatggttgtaacctcttaagagaaatcatagacaaattcttagccatagccctttaggatcttatccctcccagctattcaaccttgctcttccctgaatctggcaagcttgttccctgttaaggtctttccctgttctctgtaacctgagcctttcatctcgggtctgcagagttcagtctttaactgcactcaagtctctgcacagagaggtctttcctggccattttgttgagaagtgaccccctgcccttgtcattattttctgttctccttactctgctttttctttgtagtttttaaaaaaattgcaacttgaaattatacatttatttatagcatgtttgctgctgctaaaatataagatccatgggggctggtcttatctaaaattgtaacctcctttccccccgtgcctagtacatagtaggtgctcaataaatatttgttgaatagatgagtgaattgattgaagttgggataatggaattcattcttcccttttcagctgtttctcaaacatctctctggctgtgaacttttttcagagcttgaggttaatgcccaaaccctgtcttgctgtcacctcaaactcagtatatataaaattacattattttccttcctccagtctttcacttttgttaatgctgccatcactgacagtcctcaggcacaaaaccttggtgttatcttgcagtgttcactacccccgatccctagggtgctgtatattcccatttatgtgtttgaggaagttttctggttactgtttcacctctgctttttgcctattgacattttagccagccctcagggccctgcctcagtctttctcttctgagcacgaagctgaatttccatccaagcaccccttttgtacttatgtttatagtttgttttgttttgtttttgagacaaggtctttctctgctacccaggctggaatgcagtggcgtgatcactgctcactgctgtcttgaccttgaccttgtgggctcaagccatcctcccaccccagcctcctgggtagctgggactactgttataggtcaccacacctggctaatttttaaaattttttatagagacgggggtctcgccatattttccaggctggtctcgaactcgtggcctcaagcggtcctcctgcctcggcctcccaaagtgctgggattacaggcatgagccaccgtgcctggtgtaattactctttttttaaattaaaaaaaaaaacccacacagtctcctgatctgttagttcctttcccatgtcctaatattttaaacatagtattgagttgcctttcttttctttttcttttttttttttttgagacaggttctcactctgtcacccagcttaaagtgcagtggcacaatcttggctcactacaacctccacctcctgggagcgattctcctgcctcagcctcctgagtagctgagactgcaggtgcctgccatcacacctggctaaattttatatgtttagtagagacggggtttcaccatgttggccaggctggtcttgaactcctggcctcaagtgacctgcccgccttggcctcccaaagtgctgggattacaggcgtgagccaccgcactcagcctatttccttctttatgatcccatttttaacttcaccaccatgtgtgtcctatctttagctctgtcatagagacctaatgcttgctacttggttgtgcaacagaagacagctgacagcaacaatgccatcagcatggttttcttaccttctatctttgatgttgattcaggctggattctcttgagccggtggaggctcctgcagttttagaaggtgagtagtcataaggtgtcacctgctgcatcacactggaaatgtgtggaggcagtggagtctgagctgatgatgagtatttacttagtagttctctgtacctacctagcagtgattcaggttgtaaagaaaaatttaattggttaaattattttaaccaatgtttgagtgcctattttactgtgatgaacatagatgtacaagatgttttgctcattaggagtctccaaaatctagcaggtatgtgagttatgtaacattctttttagtaaataaaatatggtaaatgctgagttagaagtaggtgtgagctgctgttgaaggcagcatatgactcattgaaggacttatcaggggaggcttatttcgtaagggatgtaatggggcacgtcttgatggataaatggaaattcacaagtggagaggggctttaagatctgtgtataggtaattcatgaaaacacagtggaatcaatctaggcccaaatgtagctccagtaaagggtgaaaccagcaggggtagagctttagttccttgatatcatggcttaaggtagccaagaagttctgattcaacagtgccctcaagtagcatgctgtacagatagcctcacattgcgattaaaagtggactctgcaattaggctgcccacgttcagatttcatatctgcaccttactagctttgggactctggacaagttacttaacctctctgggccttgatatagtatctacttcatataaatgaagattaaatgaaataaaatacataaagtgcttatgaacaggatctgacactcagagtgttcaataaaggtttgctatttttatttttgactgtttacatcagcctagagcaggggttggcaaactacgtcatgtggaccaggaccaaatctggcctgcagttagatttacaaataaagtttttttggaatcaagccatgcgcattcattcggtattgactatggcttcttggtgtgtgctataagagctgggtttagtagttgtgacagtgaccaaatagcctgtaaaatctaaagtatttaccatatggccctttatagaagaaatgtaccttttttgaagaaacttaccatttactatatggtcctttgtaggcgaaatttagaggataaaatcaaactccttagctctcaagatcttcagtgattgcttccaaaccagccttttttctatccataactaacagatggccacagcagctctttggttttcactggcccttctattccttttatagctgctgtctgttgctggattgtgcttcctttagtgttccaactactcttctgtcttttgcgtgaatatgggcagaggcagggccaggactagggtagaatgtgtgaggcactcactctaggtacacaatttaagggggccccaaaaaacttgataatcaagataatttgttaatgtttttaaaaataaaaattaatgcaaaaaacccattatgaacaaaatatcgatattttactttttttgaagcttaatattaattttattaaacttttttccaggtttattatgattggcaaataaaaatttgtaggctgggcacggtggctcatgcctgtaatcctagcactttgggaggctgaggcggtaggactgcttgagcctaggagtttgagaccagcctggggaacatggtgagacactgtctctacagaaaataagaaaaaaattagctgggtgtggtggcacgcaagcgtgactccagctacttaggaggctgaggtgtgggaggaccgcttgagcccaggaggtcatcgctgcagtgagctgagattgtgcccactgcactccagcctgggcgactgcgcaagaccctgttttggaaaaaaaaaagaaaaatctaagttgtacagcttagggttttgatctaaatatatcttgagtaatgattcctacagtcaagctaattaacatatccatcacttgaatggttaccattttcttgtgtgtgagataagaacatttcagatctactctcagcaaatttcaagtattcagtaatacattattatttataatagttaccatggtgtacattgaatctctagaaattattcatcttataactaaaagtttgtatcctttgaccaacatatccccatttcccccacccccagcccctggcaaacactactctactgtatgtttctctaagtttgacttttttagattccacctataagtgacgggatcagtattactgatgttttttttcctcagcctccaacatggctcaatatagtactgggcagcagagagaaagtaacccacatgtaagcggcttaagcccagatactcatacttcctacgtatatgtgggagagagtagtaagattcaaagtaacctgctggctgatcaccaatgtgatataccaatggcatatactcaggtccttgtcaggactaatttcataaagtataattatgcacatattttgttgaacttagtttacagcagtgatctgtgtataatctgttgtataaaatgaaagaatgaaaacatttccaaaagttttcaagtagttcatttgaaatggttcactgagagcagtgaagcatatactttagaatagcagcattggataactaaaactgtttaccaagagatctggaaggatcacctggttcctgcaagctttttctaagaaaggccagatagggatattaattgaattttaatgctttccaataaacattgacccagcaagcttttttagatgactaactttctaatctgctttgacatttcttcgtggggctgcaaacagtgatttgttggtaggttttaaaatatgtataatttgttttagtgaagaaggtttggaagtatactgtagaattctgtgaaagcagaatggagtcttatctgtaaggaataagtctggaggaatggacaagatcaacttttcatttctcagacaccttgttgagatggataggaattatttgatgttttgacatagtaaattagttgttctgcctctcattgttatataacaagagataaaatgcaatgttgaacttgatggtcttttgctttctaaacacttttcaatgtttttaggtgtatagtgttgattggagccaaaccagaggtgaacagcttgtggtgtctggctcatgggatcaaactgtcaaattggtatgttagcattattgtattcaaaaacgaatattcccttctctagagcttccactaaattttcttctctttttccaacatacttctgtagctctatgattcgacagctgagctttcttttaaaaaaaaaattaaaacacttattagaacttaaaattttctaatcttttggctgtgaactaatagttagctcagcattagtttggcccttaaatacagtcttgctttatatcaaaacagatctttaaaaatccttgagatctgtatatatattgtatgcatatatataaatgtatatagtttattggtgtatgtagtatatgtaaaagcataaatttgaatttatccctcaagtaattgatctattcatttatttgtagtgggatccaactgttggaaagtctctgtgcacctttagaggccatgaaagtattatttatagcacaatctggtctccccacatccctggttgttttgcttcagcctcaggtaaattattctgtatttaccaaaagccttacttgtagtgaatggtggccttgtttttaccattaggtggcgctgtgtaccttagcttcagagagaaaacaggagaatattactattcttttgtgttcttaagactttacttctttttttatttttatttttttatttttattattatactttaagttctagggtacatgtgcacaacgtgcgggtttgttacatgtgtgtgcatgtgtgccatgttggtgtgctgcacccattaactcatcatttacattggatatatctcctaatgctatctctccccccttcccccaccccatgacaggccccggtgtgtgatgttccccatcctgtgtccaagtgttctcattgttcacttcccacctatgagtgagaacatgcggtgtttggttttctgtccttggaatagtttgctcagaatgatggtttccagctttgtccatgtccctacaaaggacatgaactcatccttttttatggctgcatagtattccatggtgtatatgtgccacattttcttgatccagtctatcattgttggacatttgggttggttccaagtctttgttattgtgcatagcgccgcagtaaacatacatatgcatgtctttatagcagcatgatttataatctttgggtatatatccagtaaatggaatggctgggtcaaatggtatttctagttctagatccttgaggaatcgccacactgtcttccacaatggttgaactagtttacagtcccaccaacagtataaaagtgttcctatttctccacatcctctccagcacctgttgtttcctgactttttgatgatcgccattctaactggcgtgagatggtatctcattgtggttttgatttgcatttctctgaaggccagtgatgatgagcattttttcatgtgtctgttggctgcataaatgtcttcttttgagaagtgtctgttcatatcctttgcccactttttgatggggttgtttgattttttcttgtaaatttgtttttaagttttttgtagattctggatattagccttttgtcagatgagtagattgcagaaattttctcccatttcgtaggttgcctgttcactctgatggtagtttcttttgctgtgcagaagctctttagtttaattagatcccatttgtcaattttggcttttgttgccattgcttttggtgttttagacatgaaatccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattggtctagatctctgttttggtaccagtaccatgctgttttgattactgtagccttgtagtatagtttgaagtcaggtagcttgatgcctccagctttgttcttttggcctaggattgtcttggcaatgtgggctcttttttggttccataggaactttaaaatagttttttccaattctgtgaagaaagtcattggcagcttgatggggatggcattgaatctataaattaccttgggcagtatggccattttcacgatattgattcttcctatcaataagcatagaatgtttttccatttgtttgtgtcctcttttatttcgttgaggagtggtttgtagttctccttgaagaggtccttcacatcccttgtaagttggattcctaggtattttattccctttgtagcaattgtgaatgggagttcactcatgatttggctctctttttgtctgttattggtgtataggaatgcttgtgattcttgcacattgattttgtatcctgagactttgctgaagctgcttatcagcttgagattttgggctgagacggtggggttttctaaatacacaatcatgtcatctgcaaacagggacaatttgacttcctcttttcctaattgaataccctttatttctttctcctgcctaattgccctggccagaacttccaacactatgttgaataggagtggtgagagagggcatccctatcttgtgccagttttcaaagggaatgcttccagtttttacccattcagtaaatattatcatattggctgtgggtttgtcataaatagctcttattattttgagatacatcccatcaatacctagtttattgagagtttttagcacgaagggctgttcaatttggtcaaaggccttttctgcatctgttgagataatcatgtggtttttgtctttggttctgtttatatgatggattacatttattgatttgtgtatgttgaaccagccttgcatcccagggatgaagccaacttgatcttggtggataagctttttgatgtgctgctagattcagtttgccagtattttactgaggatttttgcattgatgttcatcagggatattggtctaaaattctcttttttttgttgtgtctctaccaggctttggtatcagtatgctgctggcctcataaaatgagttaaggaggattccgtcttgttctattgattggaatagtttcagaaggaatggtaccagctcctctttatacctctggtagaattcggctgtgaatctgtctggttctggagttttcttggttggtaggctattaattattgcctcaatttcagagcctgttattggtgtattcaggggttcagcttcttcctggtttagtcttgggagggtgtatgtgtcaaggaatttatccatttcttctagattttctagtttatttgcatagaggtgtttatagtattctctgatggtagtttttatttctgtgggattggtggtgatatcccctttatcattttttatagtgtctatttgattcttctcccttttcttctttattagtcttgctagtggtctatcaattttgttgatcttttcaaaaaaccagctcctggattcattgatttttttgaagggttttttgtgtctctatctccttcagttctgctctgatctcagttatttgttgccttctgctagcttttgaatgtgtttgctcttgcttctctagttcttttaattgtgatgttagggtgtcaattttagatctttccttctttctcttgtgggcatttagtgctatgaatttccctctacacactgctttaaatgtgtcccagagattctggtatgttgtgtctttgttctcattggtttcaaagaacatctttatttctgccttcatttcgttatgtatccagtagtcattcaggagcgggttgttcagtgtccatgtagttctgtggttttgagtgagtttcttaatcctgagttctagtttgattgcactgtggtccgggagaaagtttgttataatttctgttcgtttacatttgctgaggagtgctttgcttccaagtatgtggtcagttttggaataagtgtgatgtggtgctgagaagaatgtatattcagttgatctggggtggagagttctgtagatgtctgttaggtctgcttggtgcagagctgagtttaattcctggatatccttgttaactttctgtctcgttgatctgtctaatgttgacagtggggtgttaaagtctcccattattattgtgtggggagtctaagtctctttgtaggtctctaaggacttgctttatgaatctgggtgctcctgtattgggtgcatatatatttaggatagttagctcttcttgttgcattgatccctttaccattatgtaatggccttctttgtctcttctgatctttgttgtaaaaaaaaagtctgttttatcagagactaggattgcaacctctgcttttttttttgttttccatttgcttggtagatcttccttcatccctttattttgagcctttatgtgtctctgcacgtgagatgggtctcctgaatacagcccactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatgggctttacaatttggcatgtttttgcagtggctggtaccgattattcctttccatgtttaggactttacttcatcaacctcttgacaagagttagctgtggttcagattacttttcaatgattccaactcctaaagaataattcctagatttctggcaaggacaaattcatggatggtaatgttataactgagatatgatacatgtttgaaagagaaggtcttgagttttgttttacaacactgtttcagaacctgtgagacacgcatctgcttgtcaatgagcaggttgagcttggagctgagaactctggcctcatgaataaaaattgtatcattggcttagaattggtaactaaagccattgcagtaaatcagagcacctaggaaagactaagtcaaagaaaccttggaatagagcacaagttggcaaactactgccctcagatcaaaactgatggtttttttttttttttttttttgcattgtctaaagatatttatttctgctgtcttttttttttattttttttttatttttaattttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgttaatagtgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttgggcatgaagtccttgcccacgcctgtgtcctgaatggtaatgcctaggttttcttctagggtttttatggttttaggtctaacgtttaaatctttaatccatcttgaattgatttttgtataaggtgtaaggaagggatccagtttcagctttctggaagcactggaagcattccctttgaaaactggcacaagacagggatgccctctctcaccgctcctattcaacatagtgttggaagttctggccagggcaatcaggcaggagaaggaaataaagcgtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaaactgatggtttttataaatagtttcattgggatgcagctacgcccgtttattaacatattgtttatggttgctttcacactacagtggtggagttgagtagttgtgagagagactgaaaggtcctcaaagccaaaaatatttaccgcctgtggcccttgacagaaaacgtttgctgacctctggcataaatcctcaaggagagagtaagaagtggaaactcttttgtgcagttggctgtttagtagagaacagaagacattagctagaggaggaggtggtgctcctaatagtgtctcctctttcagttatgcagcatccaaagatagacaataggtaggataattgttcctttcttgctaataaactataccaatgccctgagttgttgaattatgttgattggctttcttaggaaatataatatcacacacttttttcccattttatttcattatttttaattttaaaagtaaaaaatgaccaaaccatcctaaattgtgaaagtactattaggttgaaaatactcagaaatggaaaccttcaggtaaattatatacagacaagtatatccatttagattatgcaactttctttttacagggagcatgactgaggtgaaagattatgtaattttttgagatcctaataatgaatactagtaatgcctatgtatagaggcatagttaatttaagaaaaaatatttttgttctctgataaaaattaatagctttcttttctagaatgttgagcagtacacactgtcgacttataaggttataaactattattttttgaatttttaagctaagtcatagctttttttgtccataatctgaattaaatcttttctaatatatgaagtcttttgggatgggaccagtaatatattttttcttcttatgttgcctttcccaagcctgcatccttctttggtcttttatccttctgtaacatagttaaccgtaaggctgagtgtgcattaagtcagtggtagcaatattaatatatttaatttgaatcaattaaccctttcatttacatgtataacttgagttaatcatcttttatgtttttattattattattgagtcagagtctagctctgtcgcccaggctggagtgcagtggtacaatctcggctcactgcaacctccgcctcccgggttcaagcaattctcctgcctcagccttctgagtacaggtgtgcgccatcacacccagctaatttttgtatttttagtagagacagggtttcaccatgttggctaggctggtctcgaactcctgacctcaggtgatcaacccgccttggcctcccaaagtgttgggattacaggtgtgagctactgcgcctggcctgtgtttttaatttagtataaatggtaatgagttttgtgcttatagtgaatcggatctgtaagttgaccacagttcagtttactggtttatactgttaccattttgtaattttaccgttggtgaaagattctaccacagagagtattagtccaagtcgaattaaagttcttgtaaggatgtgaattagattgacattagcattattttcttaggggagggatgccttttggccttatatcctacagtttcaaaggagtcatttcaaactctagattgaattagtggtgtagaatagatccacctcaaaaatgaactgaggccaggcatggtggctcacatctgtaatcccagcactttgggagctgaggcagatggatcacttgagaacaggagtttgagaccagcctggccaaccaacatggtgaaacctgtctctacaaaaatacaaaaattagccgggcatggtggcacacacctgtaatcccagctacttgggaggctgaggcaggagaatcacttgaacacgggaagtggagattgcagtgagccgagatagcgccaccgtaccccagcctgggcaacagagcaagactgtctcaaaaaaaaaaaaaggaactgaagcatgcttctgttctagtgaaacagtgaagacttacctgctgggagctctaattggcaacatacacagtaaactaaaattaataatgagaatataattttgtatatttggaaaagtattagtaagtacaattccttgaacaattgataggtcttaaaaaattccttacctttctattttatgtaatcttgttgatgtttgttattatttaaagttcttttctttttctttttcttcttccttttttttttttttgagacggagtctctgtcccccaggctggagtacaatggtgcaatctcagctcactgcaacttccgcctcccaccttcaagcgattctcctgcctcagcctcccgagtagctgggattacaggcacgtgccactatgcccggctaatttttgtatttttagtagagccgggctttcgccttgttggccaggctggtctcaagctcctgacctcaggtaatccgcctgccttggcctcccaaagtgctgggagtataggcatgagccaccgtgcccggcctatttaaggttctaaatttgccttgatttgggcatttttgtttgtttgtttgttttcagtttgttttctctgacaggatacatgaccatgacaaacacccagtttgcctgagttttaaaaaggatatttcgtttgccccactggaatgaccagtaaagacatacatccagttggcaaagtggaaagagggtattgatttgtttttaatcattgttctctttatgcgtatgaccaaatataaatctgatagtgacaaaatcacaaactaatacagctgcattttttggacgtcagtcagaattgtgtgtattagcccttcatttgagctgagtcacacacctcttctttttacattggtctttgtgtagcatggaatacatagcattgactctggatagtgctgtagaatatgcactgtatgagactgaataacagaagatgaattgtttctagagtgttgctataatcacaacacttcacttttcaaactatctgtacagtgtaagtgggtagtagaaaagtgatcttttatcaacagaatgactgtttgcttctgtagaagacccctgtttcattacattaccttcatatgttgtgttagaaattaatataaatcttggtcatatcagccaggacttctttggttgaaagtaaaaaaaaaaaaaaaaaaaaaaaaaattctgacccaaagtgctttaaggaagaagataacttatttgctcacataagtgaaaagttcagaattaaatctggctttataggcatggttgaatgtagggctctgtcttctgttgtgctggtttcagaatcagggtatcaggcaccacatgatggcaagatagtagtagctccaacacctacctcttttctggtttctgtccagtaggagaaagtgaaagattccttctcagacatccagactgtttcattttctgtcatgggctctgatgcgtccttgtggatgttcctgaactaatcactgtgtgtgggtgagggggatacaatattttgattggcttaggcttggttagtccctgcagttgggaatggaaaatgagagagggtgttacccaaacaacatggattgaggatggaaagagtgaatccagattaggtgaatgtaggtggatggagtcgaaggggccagtattcactaaattggctgcacatctaaggcttcagataaatcagaggggatttgatgaaaatcaagtactggacctgtaagctctaacatatgttcttcaaaaactttccttgtgaaatggatacagtaaagctgttttctaccaatttttatgacttagggaactcattggaagattgatttttcaaacatttgccattttcctgaaataatcctttgtggtgatttacaaatattagtctacttagtactttttaaaagattcaaagttcttcttccactctgcaaaaatattggaatgagttggggtgtagtaaaaagtcaatgcaagttgcaaaactctcactgtgccttagccatttcagagacaagaacatttactcactgggctgtgtaccatgcgtttgtaagcaaatgcagtgcttagatcttctttgcttcacttgttttcatacatttcctataacacttgtgtattcttttacatagccgaatgccttacatagccaaacacgaaaatatttttgattgttattatataagatatgggagtaaccatcttattcaaatttttaaaacatactgagttcattttgattgttgagaaggacgctgctagtgagtcagtcagatatttattgaatgtccatcatttattggagattcagtgaggaagacaacagatggagttcctgcactcttagagcatatagtccagtaggaaagaggaatgctaagacaaaatctagaagcagctagtgatgaagactgtgaagttctttaaggagaggtaatatagcacagtggtcaggaacaaggattctggagctggactgcttcagatcaagttctactttcctgctgttaggagactttctttggtcatgccatttaaacctctgtctcctcattcctcatttctaaaatcagggtgataatggtatccacatcatggagttttgaggaggattaagtggctaatgtgcataaagggcttagttagaacagtgactggcagagtaaaagctctgtgagcattacctctttttttttgagacagggtctggctctgttgcccggctggaatgcagtggtgccatctcagctcactgaaacctctgcctcctgggctcaaacaatcctcccacctcagcctactagctagggccacaggcgtgcgccaccacccagctaatttttgtatttttggtagagacagggtttcaccatgttgcccaggctggtctagaactcctgggctcaagcaatcctcccgccttcagcctcccaaagtgctgggattacaggcatgagccactgcacccgaccttaagtattacctgttattattaacacgtgtgcccagaattctgtggaaatgtataaatggattcctgagcttgtcagggttggctggtcaggtcacttccctgaagaaatagtctaagctgctgccttatggacaagtaagaggaaatgggaagtgggaggcaaaagttggaacatggagagaacagagcatacttgaggaccatcagaatggcctttgcagtgtatatgtgctgtaacagtggacagttagtgcttatctaagagctaaaactcttggagctctagggtaatttgctctaggtagacgctggaaagcatggttgtatagtaacatactagtccagcgattctagaatctggctaatcatcagaaccattgggagagcattaaaaaacagcagcagaattgtgggcttcatcttaagtcttgctgaataaaaagacagaatacccctgggagatacatttttaaatcccagctgaatctagtgaacagcccaatttgggaagcactgtactagtctatggaatagctgtgtttgagatgccaaattgacagcttagttctatttgaggtaatgggaattgcatgtctgttttcaaaggaatatactcaactctttttttaaaaatctacagaatggtttcagtgccgaattcagagaagtggttgctttagttggagaactgcttagttttttctcagttttgctagtgagtttatctttattaattctcttgctttgtcttcttgcttacggacgagtgtttattataaaacataacataatctttgcataaagtaatcccaactgcaaagtttgtagtgtggaacccatagttgtaaaatacttgtttttcatagtggaagcttatgtgataggcagtcaagatgtatttttatgtctaatcctgttgcacacatgtagttaagtatatctttcaacagattacaacaatttatattttaagataatatatgagaacgtagcatttagtttgctccaagaatttagtcatcttcaaagttgtatagttttgcaaatctagcatcaaattagttaccattagataagctaagacaggccaaaatgggggaagtttttagagaactaccagtagatctagatttaccttccatagcagagttgcctaaagacattgcattttgcctaattcatgatagttgtgttagtacagacatcatatttctaaattatatgagatagaagggaagaatatttgagctctttttatgaagaggattaatatgaagtaaattatctttggaatcatgaaaactaaattattgctgtcacagactccatctagttgcgtaagtcataaccatgcctgaatgtgtgggatccagtagttaaagcaaacctcgttctactgtaagaaaaagtcatattacatctgagaggcacaaggcatttcggttaagttatattggccccaaagtacccttttgctactcagttcacttcccagttttagactcttatgtttacactcattctccttatgcaacttcctcgtacctgctgcaatttgaaattagacatagtaacagccagcacttccttgcccatattgtacatttaaattcactggttctggccaggcacagtggctcacatctgtaatcccagcactttgggaggccaaggtgagcggatcacttgaggtcaggagtttgagaccagcctgaccaacatggtgagaccccatctctactaaaaactcaaaaaaattagccaggcatgatggcgggtgcctgtaatcccagctactgggaggctgaggcaggagaatcgcttgaaccctggaggcagaggttgcagtgagccactacactccagcctgggtgacagagttagactctgtctcagaaaaaaaaaaaaagaaaaaaaaattcactggttctgtcagtggcaggtctgcaattgataagagaagctggcaattcaggtgagtctatggcaccatcacagggccctgataaatgtctgcctgtcaatgaaaggccagttgtctagaaaattcaattgaaaaaacaatataaatacagaagtcctggcagctgaaagagctgaatgagtcattgtaccatttggtcattaggtctccttcctacctggaaaacaaaatggcgaggatgaagtgccaaatggttacatcaggagttgctgtcaaggaagtggaattctcagctcctgcccagcagtcttcacatttttgtgcccattaaattaactgcaagaggggacagctcaagccatggctcttttttttttttttttttttttaaatattgcatgaaagtggtggtgtgaattgaacaatgagaacacatggacacaggaaggggaacatcacacaccggggcctgttgtggggtgggggaaggcgggagggatagcattaggagatatacctaatgttaaatgacgagttaatgggtgcagcacaccaacatggcacatgtatacatatgtaacaaacctgcatgttgtgcacatgtaccctaaaacttaaagtataattaaaaaaaaaaaagaaagtggtggtgtggaacaaaacctcccaacctttgttattgtgttttttaatcttttattgaagtataatacacatattgaacagtgcataatcttagtatacaatttggtgaattctcacaatgaacacatccttgtaactggcacccaggtgaagaaacagaatgttcccagagggcctcctcccatccttatagtcgcttctcaccacgtcccaccccaggtgaccactgtgtggccttccaataacatggattaatgttgcccattttcatacctttgttactggtttttttcatgcaacattatgtcttgtgagactcatccatgttattcctacaataacagttcttaatctcctagtctgcattcattgtaatgttttggtacttttaaatttttttatttttattttttgagacagagtctggctctatcacccaggctggagtgcagcggcacagtctcggctcattgtagcctctgcctcctaggctcaagcagtcctcccacctcagcctcctgagtagctgggactacaggtgcatgctaccaagcccgactaatttttgtattttctgtagagacaggatttcacggttgcccaggctggtctggaactcttaaactcaaacgacctgcctgccttgaccttccaaagtgctaggattacaagtgtgagccaccatgcctgacctgttttggtactttaagtcagttcacatactcatatcttattagggtgaacccaagctcattgatcttgagacaatgctatagctatagcagaatttatacttttaacctagtattagatataaattcctgaaagttagtatatattatttaggcattttgtatgttttaatggaaacctcgagcttaattaaatggtttttttttagctagtttcaggagactgacgctttaggagaatacccttcgctcccttatgataaagagtgatttcctttgcctgcaagtgatagaactgggactatgttagatctttgtgaaatttgttaaaaagcatactccagaaagggaagggctgtttgaaaggccccaggacacattctgtttctcatctggacttttctctacttgttgacttggctctgcagactggctttctccacacagtgagacacatggccactagtggctcctgaatttatatatatataaatatatataaattcactatgtttatatatatattcagtgtataatgcagcgtgacatccacgtcaccctgcattatacactgaaggctggagaaggtcatgagagatcatttcatcaaagctatatatatatattttttctgtatttatatatatatattttatatatattatatatatatatattatatatatatagttttttttttggggggacagaaacttgctccattgcccaggctggagttaaggggcgtgatctcagctcactgcaacctccacccctggggttcaagtaattcttatgccccagcgtcttgagtagctgggattacaggcgtgtgccaccatgcctggctaatttatttatttattttgtatttttagtagagacagggttttgccatgttggccaggctggtctcaaacgcctggcctcaagtgatccacctgccttagcctcccaaagtgctaggatgacaggcatgagccactgtgcctggccatatttttacgtttttgagacagggtcttgttctgtcacccagggtggagtacagtggtgcgatcatggctcactgcagccttgacctcccggactcaagcagttctcctacctcaacctccagagtagctgggactacaggtgtgtgccaccatgcctggctaatttttaaattttttgtagagctggaatctcactatgttgctcaggctgatctcgaactcctgggctcaagtgatcctcctgccttagccccttaaagtgctgggattacaggtgtaaaccatcatgcccagcctcctgaattttataagttgtaaatgctaccataagaggacagacattattttttcagttatagttcagaaaaatcccaagtacctgcctttgacctttcagctgtagtcaaagcagggaatgaggtactgtggttggtcttgcctggacctgcctttggtcagtcaattgtgttgaggtgtaagtctttatagaatcacttggtgagaaaaggacatgctgttcctagaaaaagggtatttctgggcaggccaaacactagacatccacgtcaccctgcattatacactgaaggctggagaaagtcatgagagatcatttcatcaaagctatttggaattctagaagcagattctactgactggtggctagaccacagacagtgattataatgagggccgttggagttatttgaagctctaacctgtaccaattctgaacaatttccttttggtactttcaaacttatcattcatttttcacaatgagatatgttgtcactagtgggtcctgaattttataacttgtcagttctgccatagaagagggactgacattatttttcagttgtagtaagaaaaatcccaagtacccccatttggcctgtcagctgtggtctgagcaaggaatgaggtgctatggacggaggtaccatccttagctaggtccaaaaatgtttgttactctcatctatcaaagtggttttcaacctttttttaatgtagcaggacagtatttttaaatcaaaaaaggaaaaaaaatcctacatacaaagcagtagtagtacgtatttatggatccataaaaatataataaaagtattaccaaaatgcaaactaaagggctgcggaccaaattcatgactgttgtggcctctgggcagggaggatgggaagtggtattgaaaatataatagaaatttttctccgatttatagaaaaagtaatacagggctggatgcagtggctcacacctgtaatcccctcactttgggaggctgaggcaggtggattgcttgagctcgggagctggaaaccagcctggacaacatggcaaaaccccgtctctgccaaaaatagaaaaattagcaggggcatggtggtgtgcgcttgtagtcccagctacttgggaggctgagatgggaggattgcttgagtctgggaggtggaggttgcagtgagctgagatcgcatcactgcactccagcctggaaattaaaagaattaaaataattcctccagaattagccaacattgattgtatggcatttgtcgtccagcaacacaaggaggcagcagcgcagtgtagttgtaaagctgtaaagtgtgcatgctggggacccagactccttgggttctggttccaggtcctggttctgttgcttactatcctgggtgagttatttcatctttatatgctgcatttgtatagtactatattcctcatttgtatagtactatacaattacttttatatctccgaattcctactttatgtagttgtgatgtttttagaaaaaatatgtataaaatgcttagaacagtatgtggcacattggaagcactcaataaatattaactattattcatgttgttattattggggggacataaataacttctaatcatgggtattttttctcataaaaaaaaacacacatattgagagcttactgcatatcttttgcgtatctggcaccgtactcatgctactaccttgtctcatttcagccttacaaggcagttattttattgtaggtaggaaactgaagatcagcgaaataacttgattaagcatcagtggccaccaaatgattgagctggattagaaccaagctcaggaactccaaaggccctgttcttaacctctgcatttcattactgccaacacatttcttatctttcttaagcaacttccgaagaagccaggaaaaaattgcctaggatagctaaatttagcttaacaatatatgatttagaattgggaatataggaaaatatatgtagataagtgaaagatactttaaaaatttagcatttttatataccgtatttggcagtttctagtatgtgttagagaccatgctaggtgctttacagaaacgtgatgaaattcttagacagcgctgcatgttgggcattctgtgtctcctttagaatgaatcagtctcagagatattacgtatcctatgcagggtatgtatcctataaccacaaaatggcattcaagtccccacctgctatcatgccagaaactacatgcttttcattacatggaactggttttctcacatcatcagttgtttatattttacttttgaggtaggtatatatattctggattttattcatcttgtcatcttttgtttcctcatagtttagaaaaactggaggcaaacaacatgtaaaacatttaattgggtgtctgtgcaattaagtaatgcaaactgtttttgtaataatgcaaagtgtaatctttaaatgtttttagcttgttggccaggcatggtggctcatacctgtaatcccagtactttgggaggctgaggtgggaagattgcctgaggtcagaaattcgagactagcctggccaacatggtgaaaccccatctctctcactctttatttatttatttatttttttgagatagaatttcactcttgttgtctgggttggagtgcagtggcacaatctcggctcactgcaacctctgcctcccaggttcaagtgattcttctgccttagcttccccagtagctgggattacaggcacccgccaccaccacgcccaactaattttttgtttagtagagatagggtttcatcatgttggccaggctggtctcagactcctgaccacaggtgatctgcccaccttggcctcccgaagggtagggattacaggcgtgagccaccacgcctggctaaaactccatctctactaaaaatacaaaaattagctgggcgtggtagcacacatctgtaatcccagctacttggggggctgaagcatgagaattgcttgaacccaggaggtggaagttgcaatgagctgagaccgtgcctccgcactccagcctgggcaatagagcaagactctgtctcaaaaaaatatcaaaataaataaataggccgggcgctgcggctcatgcctgtaatcccaacactttgggaggctgaggcgggtggatcacgaggtcaggcaatcgagatcatcctggccaacatggcgaaaccccgtctctactaaaaatacaaaaattagctgggcgtggtggtgtgcacctgtagtcctggctactcgggaggctgaggcaggagaatcacctgaacctgggaggcggagattacagtgagccgatatcgtgccactgcactccagcctggcgacagagtgagactctgtctcgaaataaataaataaatacataaaaataaataaataaaattttttagcttttttttttgaggagaaaaatacacttatagctggcccgttaaaatatagtatacttgacaatgaaaagtaaaaaattctccattttggcttggtagactttgcccgcctttagcagtaaaattgttactctattgttggtttctagtacaatacactggtacagagtgatcactttatttcctaacacgagaattttcagggcctttcctgcctcgaacacacaccagctgtgtgtttagtcaatactgtgtttatctcagcgtgagattcaaattttcctcctaatagcattatcacggtgcaacgtcactttttgtattccttcatttgaatagttcctatacattattatggtttaaaaaataagtctgaaggtggcaatatcctaacactgaaagcagtgtatttttacttgacttattattgtgaacacattatgtcactgcacattcaagtggtgtgatgggaaatgatcaagtcttcctttttactaggtgatcagactctgagaatatgggatgtgaaggcagcaggagtaagaatcgtgattcctgcacatcaggcagaaatcttgagttgtgactggtgtaaatacaatgaggtatagtgtatggctctatcctatgctgctgtccttcctaatgttaaaatgttctgaattttatttgtctttgtttatgtggactttggtggtgttcctggaccattaagttaaattctgtccctttcctttctaattaatgattgtgactgacctgcattagcattaattggatttaagtgctcatgaaacgggcaaaataagaaacagaaattctcaaagttcaacagtgcaggcttacttgtttgttttgggaagctgccttatgtaatttttttctttattgctcttaaccctgcaattttgtatcatcttttgcttttatttctttctcactttgctagtcaggctgttgaactattgtaatttgatttttaatttgacagtccatcagtttttaaatttttctgttttatcttcctttttaagcctaaccaattttcatgcctctgtaagataagtgtccatgtgcaacttttttaaagcttcagttaaccacatgagcgtatgaatcagagatagaaatggattaaatatgtgttaatatactacagtcatgcactgcataacaacatttcagccagtgacagattgcatatgtgacagggcccgtaagatataatggagctgaaaaattcctattgcccccgaaaaccttccagcaggacaagatgtgaaggtagaagacagtgatattgataatcctgactcagtgtagtcctaaactaatatgtgtgtgtctcagtttttaaaaaaagagtttaaaaagtaaaaaaaaaaattaaatagaaaaaagcttataaactaaggatataaagaaagaaaatatttttgtatagctctacaatgtgtttatattttaagttttgttattatgaagagtcaaaaagtaaaaaaagccaggcatggtggcaggcgcctgtagtcccagctactcgggaggctgaggcaggggaatcgcttgaactgggaggcagaggctgcagtgagccaagatcacgccactgcactccagcctggcaacagagcaagactccatctcaaaacaacaacaacaacaacaaaaaactttaaaaaaaattagaaagtttatgaagcaaaaaattacagtgagctaaggttaatttattattgaagaaaggaaataaaaaataaatttagtgtacagtaatgttctaggcctttccattcactcactactcattcactcactgactcacccagagtaatttccagttttgtaagctccattcatggtaaggaccctactaccattttttatcttccatactatatttttactataccttttctatgtttagatacagaaagccttacaattgtgttacagtagcctacagtattcagtacagtaacatgctggacaggcatgtagcctaggagcaataggctgtttcatctagcctgggtgtgtactaggctgtaccacctaggtttgtgtaagtacactctgtgatgttcacgcaaagatgaaattgcctaatgccacatttctgagagcatatccccatcattaagtgatgcatgactgtatttatgtccctgaagtggtctgttgaccgtgacaaataggtaaaatgtatgctttgtttttttcccagttttaaattaattaaagttaaaagaacattgtattggcagagttctttaaataaaaataagtaaaataagttaaaatatagtatatatacaatgatattactcaatctaaacatttcaatgctgatgactatagtttcaaactcataaatgaatgtttcatattggaaaattaattatggcctgtatgttagatgtttgggaactctaaagaaagatgctgatagacatttgagagtgatttacaaaaattattttctaataactgaaacttttcttcaaattagcttaaactaaagcccaacatagtcagacaatgttaggttggtgcaagagtagttgcagtttttgccattactttcaatggcaaaaactgcaactacttttgcgccaacttaaatccattgctgttctgagttatgtggggtggactgagtgtggacccagcacttgtcctattcagccaggacctctgggttcacttggggctctagatagcagaatttgtaaagccggaatagataagagactcaccactatttgattacattcttggatatgattagatatcgtattaagaattttggtccaagagagttggaaacaatgattaatttagatttagagaacatggaaaaatttaattcatagcctttgctttttcagatgtgcctaaatgaacagacctcttgccttttaatgcctggaaaaacctcagagtatgttgaaaccctttttgtttgtttgttttttagagatgaggtctcactgttgcccaggctggtctcaaactcctgggctcaagtgatccaccggccttggcctcccaaagtgctgggattataggagtgaaccaccgcacccagccttgaaaaccttttttaaatttttattttttttttagagacagggtctcgctgtgtcatccaggctgaggtacagtggggtgatcataccacactgtagcctctgactcttgggctcacacaatcctcctgcctcactcagcctctcaagtagctaaaattacaggtgtgtgttaccacgcctggctaattttttgggtagacagggtcttgctttattgtccatgctggtctcaagttcctggcctcaagtgatcctcccacctttgcctcccaaggtgctggaattccagggaaaaccttttgaagagaaagctgggctcatttgtcagataaaatttttaatcccctatgtatttactgccgcttctaaagctgaattagaaaatccacaatgctgtttggaactatgccttttccagctgtctgtagtgttccatcgtgtacataaagcatattgagttctttttctcacaagtcatattagttttttgctattaatgtctatgttgattcctgtctatacttgttatacaacttctcaaaaatgactccttggttcatattaaatagttatcagaaagcagatgttgtttctagtaggaaagcctgcatactgtttaattgcaaagatgtcacagtttatgtttctctgaattgtttttagaatttgctggtgaccggggcggttgactgtagtttgagaggctgggacttaaggaatgtacgacaaccagtgtttgaacttcttggtcatacctatgctattaggagggtgaaagtaagttttcatcttttcttttatatgtagaataaaattatataaatataatcaatgaagtgtatattaaaaagtgttctgggtttagggattggagttactaattcttttttatatgtgtttttgttacccaattaattagtagtgaaagctaaaattaggcaaaaatatttgaataatgattgaatgaatttgggcaatgtagacattcaatacttaaggttaaataaaaatctttttctcattctttcacctccaatctgtttttcctttaatatatttttttaactatagtaattcacttttagtattatgttctttataagtttctaattagcgagagtctctactttgttgaaacagatgtaaagagatggttaattctttctttttcctaacatgataacatacatgactgttcacagatgtttgggatatagaaagttttctactctgtgaacagcagaggatgaggtaaatttttaatgatggtctcagtaaatttatctgggttataagatgacttaggttggtttcctggcttttatatttaggcaggttctgctaaatgactgtggaaaacatcttattaagtgacatctcccaatttcatccttttgtttttttacgttaaggataaaaaagtaccttattgattattttaataaggtaattatgttattcctactatttaaaaaattctaaatttttttttctttttttttgagatggagtcttgccctgtcacccagacacgatctcagctcactgcaacctctgccttctgggttcaagctgttctcctgcctcagcctactgagtagctgggactacaggtgtgcaccaccatgcccggctaatttttttgtatttttagtggagacagggtttcacagtgttggccaggctggtcttgaactcctgacctcaagtgatctgcctgccttagccttccacagtgctgggattacaggctgagtcactgtgcctggccaaaaattctaaatttttagttaagttaatattttaagtttctctggctgcaatgcaacataggagacacagtgctctgttttattttttaataaatttgtttaattggacaagttttagcagttgaaaaatatgctctatgtatattttagagtgattatgagaatgaaataaggtaatgtagtgaaagtactttgcaaactaagtgctggtcaaatgtagttatatatgtgtatttaactattaaagtgcgataagacaaacactgaagaaatgtaattgcaaaggtcaacttattaagtacattattactcatctagaagacgttacttgtctttaaacttgctttttacccttgatataattttccattagctgtaatatacaaataacgtaaaaataacttaagggtgtttttatttaacatttaaatgtttattttgataacgtgattatagcaatcatatatttgtaaaattggtaaattatataattatatatttgtactcttatatacttaaatcccttatatttgtaagaatcatttttgtttattactttgtttgcttttgctttttttgagccagagtctctctctgtcgccggggctggagtgcagtggcatgatctcggctcactgcaacctccaccttctgggttaaagcaattcacctgcttcagcttcccgagaagctgagattataggcatatgtgccaccatgcccatctaacttttgtatttttagtacaggcggggtttcaccatgttggccaggctggtctcgagctcctgacctgaggtgatctgccctcctgagcctcccaaggtgctgggattacaggtgtgagctgctgcatctggcctgtaagaatcatttttggatagccaatatgaaattgtatttaatttttccagaatagcaacattttgggaatattttattctaaataagttctaaaaagcttgagggataattttctttggagaatgtaaaaatatttttcctgaagatggatacttataaggccagaagatttttgcctcaaattatagcatatatgctttgaaaaagcataattttaagtgacagctctgactcaacttaaatttattataatgtttatggaatgatcatagaaagcagtgttataatcacagctgacttcaaaaagggttttttttttctttttttttttgtagttttcaccatttcatgcttctgtgctggcctcttgctcgtatgattttactgtaaggtacagtggtttttaatacatttcattgtgaaataccaggtaacatttgcatctttgcaacttttataagagataatatgattactcttactaacatgaaaataatctgagatgggtacatttaaatatttactaggattaatattatatttttcctgttttcgtgatccagtcacatatatgagtaaattttttctcttcaaatattagcctggctattctgtttaaaagccatcttttctaatagatgttcctatggtaacactttcctacactatagatggcatagccaatatattctaaatttagatatagaaatttggaaattgcatttcttcaggtctaattatatgagtcgtaaggctaagattgcttagatgaaaaaacaatgaacatgagtgtatgattttttgtgaatgtagatatatgaacatgtatgtgtatatatgtgcatggatatctagataagagtgtgtgtgggtgtgggtctctatttatacttccagttacagttccataccacagaggatttattttccctttccaaatttgtaactcttgacttccattttattcacaatatattttcttatgtgttaaaccctgtaatgcttagaaagtagttcagaattgcaaagccatacctttgaaaaaaacaatcttactaattagagctcagcacttgcttagagttttttttgtctttagtttgaatactatattcagaagttacttaggttaattctcctcttctctgttagagtgtggttatgttattcacttgaaacatggtttgattcctttgtttctgtttgtattcaattttagggttttcctcccatccttgttgattttgtctaggcaaaacattgacatggtttcaaaagtcaagatgtacataaagatatattcagaaaggtttccaggattttcactaaaatatatcctggaaatcattctgtatcaaagagatcattctcattctgcataatacaccattgtgtggatgtgctatagtttatttggctaccctcctatctatggacatttagcttgttttcaatgttttgtaaataaacagtgccacagtgaatgatagctttgtgttactagagaattaatgtctggtattcctagaagtgggattgctgagttaaaaggtaaacatatgtagttttgttagatattaccaaattcccatccataaggaatatgccaattttgatactcagtagcaatgtttgagagtacctgtttctctgccttctaaagatcattgattcattaaggttttccagatgtatgatcttatcacctgcaaataaaggtggttctacaccttcatttccaattctgatgcctctaattgatttttcttaaaattccctccacaaataccactaatacagtgctaaatagtttatagagaatgtctgattcctgatatgagtacaaacgcctttagtgtttctctattaaaaataagattctgactttaatgcaaattatatatgtttacttgtttgtcatactaagaaagtatgcatgaattcctattttcttgagtttttttaattaggaatgggtcttaagttttgttgaaggctttttttcccagcatttatggagataatcatgatttttcttcttagagatatggctatgatgtattatattaatggattgaaccaaccttgcattcctggagtaagtctctcacgttctttgtgtatcattttctcaccatggtgttgaattgtgtttgctaatattttatttaaagcttttgcgtcaatattcaaaggtgatattagttgcagttttctttcttttctcgttttgtttaatgtgtctgtgttttacttgcttcataaaaagaattaagaaattttcctttgtttccaaagctctggaacaacttgtacagcattgaggctatttggtctttgaatcctttgtaggattgctctgcaaaactagtggagcatggtgctttttgtggagtactttcttgataacttcatttctttcatggaagtgagtctgtttaaactttgtatctctaatgggatcaagtttggaaattgtcccttgcttttaggttttcaaatttattcgtagaggtgtctgtaaagtgggtggacacagtggctcatgcctgtattcccagcactttgggaggccaaggtgggcagatcacctgaggttaagggttcaagaccagcctggccaacatggtgaaaccctgtctctactaaaaatagaaaaattagccaggcatgatggcaggtgcctgtaatcccagctacttgggaggctgaggtggaattgcttgaacccagaaggcagagattgcagtgagctaaaatcataccactgcactccagcctgggtgacagagtgagactttgcctcaaaaaaaaaaaaaaaaaaaagtctataaaggaatgttgtaggatttcttctctttcattggttgttttactcttgttatttctgattttgtatctttaataagttctttgaatatctagtggtatgtttattttgttatttttcttcagcaggcagaattttaatttatcaattagaactacttttttcagctgggtgcagtagctcatgcgtgtaatcccagcactttgggaggctgaggcgggtggatcacctgaggtcaggagttcaagaccagcctgaccaacatggtgaaaccccgtctctactaaaaatacaaaattagctgggcgtggtggcacatgcctgtaatccctgctactggggaggctgaggcaggagaattgcttgaacccaggtggcagaagttgcagtgagccgagatcgtgccattgcactccagcctgggcaacaagagcaaaactctgtctcaaaaaagaaaaaaaaagaacttttttttttttattaatcactgcttttatttttattatttcctttttggtactttctttttgttgttctttttttcagcttcttgagataggaatttatttttattctttcattttgttaaagtatttaaggctataaatttttttctggttattattcaaactatagcccatagattctgatatataatgttttcattatcattttaaaacatttgtaagttctgtttatacttgccttttcttccaagaggtgtataataggaaattatttagtttccatatgaaaatgccttttaacttaaaaaaatttgttaataatttctacttttattgcattaaaatcagagaatactattttagtcattctgttctatggaacatattgaaatttgggggaagtggaacctaataaatgatcagtttttgtgaatgtttcatttgcagttcagaagaatgtacagtctccattttcaggctgtaaagttcagtatataatcataagcttacaaattgattatgttgtttaggccttctgtatcccttcttattattggtccacttagtctgagaatggtatgttactgagagtggtatgttaaaatctcctatcattagcaggcttctatatctccctgcatcttttgtagttttgattttatagaaacagatgctgtgtttctggtatgtagatattatggtgaattgagacttttagcattaaagaatatccttctttgtcacagttaatgctttttgtttcagttatgccttgtctcatatcagaatcattgccctcgctttcatactgtgtttactttccagatatgcttttccccatacctttttttttgttttatcatattttcaattctttcattaaattttttttttttgagacagagtctggctctgtcgcccaggctggagtgcagtggcacaatctcggctcactgcaagctccgcctcctgggttcacaccattctcctgcctcagcctcccgagtagctgggactacaggcacccgtcactatgctaggctaattttttgtatttttagtagagatggggtttcaccgtgttagccaggatggtcttgatctcctgacctcgtgatccacccgcctcagcctcccaaagtgctgggattacaggcgtgagccactgcgcccggccgattaaattttttttattatactttaagttctgggatgcatgtgcagaacgtgcaggtttgttaacataggtatatacgtgctatggtggtttggtgcacccatcagccagtcatctacattaggtatttctcctaatgctatccctcctctagtcccccaccccccaaaaggccccaatgtgtggtgttcacctccctgtgtccatgtgatctcgttgttcaactcccacttatgagtgagaacacgcggtgttcggttttctgttcctgtgttagtttgctgagaatgatgtttccagcttcatccctgcccctgcaaaggacatgaactcatcattttttatggctgtatagtgttccatggtgtatatgtgccacattttctttatccagcctatcattgatgggcatttgggttggttccaagtctttgctattgtgaacagtgctgcaataaacatatgtgtgcatgtgtctttattgtagaatgatttataatcctttgggtatatacccagtaatgggattgctgggtcaaatggtgtttctgattctagatccttgaggaatcaccacactgtcttccacaatggttgaactaatttacactcccaccaacagtgtaaaagccttcgtatttctccatatcctctctagcatctgttatttcttgactttttaatgatcaccattctaactgttgtgaggtggtatctcattgtggttttgatttgcatttctctaatgactggtgatgatgagctttttttcatatgtttgttggccacattaatatcttcttttgagaagtgactgttcatatccttcacccactttttgatggggttgttttttttttgttgattctggatattagccccttgtgagatggatagattgcaaaaattttctcccattctgtaggctgcctgttcactctgatgatagtttgttttgctgtacagaagctctttagtttaattagatcccatttgttaattttggcttttgttgccattgcttttggtgctttagtcatgaagtctttgcccatgcctatgtcctgaatggtattgcctaggttttcttctagggtttttatggttttgggtttacatttaagtctttaatccatcttgagttaatttttgtataaggtgtaaggaaggtgtccagtttcagttttctgcatatggctaaccagtttttccaacaccatttattaaatagggaaaccttcccccattgcttgtttttgtcaggtttgtcaaagagcagatggttgtagatgtgtggcattatttctgaggcctcctttctcttccattggtctatatatctgttttggtaccagtaccatgctgttttgattgctgtagccttgtagtatactttgaagtcaggtagtgtgatgcctccagctttgtaggattgtcttggctttatgggctctttttcggttccatatgaaatttaaagtagtttttttctaattctgttaagaaagtcaatggtagcttgatggggatagcattgaatctataaattactttgggtggtatggtcattttcacgatattgattcttcctatccatgagcatggattgtttttccatttgtttgtgtcctctctgatttccttgagcagtggtttgtagttctccttgaagaggtccttcacatcccttgtaagttggattcctaggtattttattccctttgtagcatttgtgaatgggagttcactcatgatttggctctgtgtttgtctattattggtgcataggaatgcttgtgatttttgcacattgattttgtatcctgagactttgctgaagttgcttatcagcttaaggagattctgggctgagacgatggggctttctaagtatacaatcatgtcatctgcaaacacagacgatttgacttcctctcttcctatttgaaatccctttattcctttcttttgcctgattgccctggccagaacttccaatactatgttgaataggagaggtgagagagggcatccttgtcttgtgccggttttcaaagggaatggttccagctcttgcccattcagtatgatagtggctgtgggtttgtcataagtagctcttattattttgagatactctccttcaatacctagtttattgagagtttttagcatgaagggtgttgaattttgtcgaaagccttttgtgcatcaaaaatcatggggtttttgtcattggttctgtttatgtgatgggttatgtttattgatttgtgtattttgaacccccatacctttatttttaaacagttttgttgaaccattttgttctaggtatgtttttgtatagagtatatattaggatctcgcttagtgaacaaatagtctttttattagaatatgtaagtttaactctttcatatttcttgataaaaatgtttagcatcgaatgtgtcatattttatgttatgattattatttgtattttatttgctatgtttctgtgtgtgatgtgcttttttgttgtgtttttttctttgacaaattttttttgacatttaggtaagtttttatatgttttagtggttgcctttggtgttacaactttttaaatgccttcataagttttctgaaaaaaattaaccgtttattgcctggttgtgagtttttcattatatttttgtgaaatcccacctatttcttatataataaccagtgaacttgttctactttcgcttttttttcccttttccatcaaattttgtttcatttatgctttgttagaacatgcaacatgtaacatatagcacatatcatatgatatatttttacttagtttctacctttgttttagtcttaagtgtataattaaatatattaagtgctcattatcagttttttattcctaagtttccctcattatctgatgcagtttatcttcaggaaatgccatagatttctcaagagggactgatgggcatagaattctcatgaactctcatatgtttaaaactatttttctgtagctttcctacttggaggatagtttagctgaatataaactccttgatttacatttctttctttgaggtttttgaaaatgctactatgtttttatcttgctttctatgtcgtttttgagaattctgatgccagtctaactctcttttacttgtaagttgtttggcaccaccccgaccccaaccatcaatcctttccctcctcctcgagaccctggggaaaaagaacccttgttgcatttcagtttttcttgctgcaggctcagtgagctctttaagtatatagatttgggtcttcttttattcctagaaagttttttgaattacaattttaaataatagttctacttaattgttttattttctgtggaactcccattatgtataaaaggactctcctttacctgtcttctctctcaggtactttctgtctgatactttttccttctatatttctttatctcattttcattcttttggttgttttcctgttgtcctcaatgcccttattatgtttttgtgtgaatctgctcttcttgggccccaatgtaattctgtgtttatttgtgaaatgattttgccttttttcttgtgtttcttcagttcagtcaggtctgtttcagttcttctgtttttgtccacttcttttctttgtttttgagttcctgatcaagggttttgttggttttttttcttccatgtccctaaatgcttgcttgaagataatttgattcagtttagaatatgttacggttttctacttcactatttttttttttgagggaagcttttgtcagatgaattgttggaattcttgtaaccatttatttgtgtatgtgtgtgtttttaaaaataaataaagacttttttgtctctttatatctgtggacagggttgatggtttgaggttggcacctttccttccttttaattttctttcacccctaaactatcaactttctaagatcacctccctgtatccagtgtactttaaaatctgtaatctaatctttattatgcctttttccagtattttcactcataggatgcactttctctttctcatgatggttttaggtcagcgttagacctagtcctagctcctgccctctctgtaccattcagtgttccccacactgtccttgccattcacacaggcttgcagctggaacaaggaagagagctcatagggattctgttttgatttttcttcttacagttaatttgaagtttggatgtgtggaagacctgaggtttgtgtagttttatttgttctctttgttgttctgtattggtttttgtaagaatacagtaacagttttggatttacatggcctcattgcctagactctcctctctcctcacttctgagtccgtattagatatggcccagtctatatagctttgtttgtataaaatgtacttctaatagaataaattacaacaatgctttgagatgtatttcatgccttaacttggttttcttgattcattcaatacaagcgggcagacagctgggaagaataatcacatggaggctcccagctctcaaaagtgtactttaaccaggcttttgtttgttttttagtattccatataaaataataagtagtgattataaagttttcagcctgggaactaacgaatggcaacacaacagaaaggaagaaactggaactgtggagctagatcactggctggaggttaaggctgtgcatgtagatttggacaccatttactcactgataattcagtccataagaatgaataagccaaagggagataagtgtagagaaagaacaaaaattccctccttcaggagggagttcatgttggaaagcaggaaggagcagcccaccaggaacaggaggaaaccttagagcatgcaatagtcacagaagctgtgggaggaggggctttcaacaaggtgtgaatggccagtaatgtcagatccaccagataggttaagcagtatgaagagagaacttggaatcttctctttttgtcgctcatggattcaaaaagatatccacatataggatctagttcttggaattcgaacacctttctggcatttgaagcaagaaggcataaactgagatgagacattaatcttttggtgatctcatatttggtattcttaacagttttaattgggacatcttaaatccatttcagtgctttgtttctgattaaagagaaaaatctaatgactactgagactttcttctcagaattgtcattttgatcttaatcctagtgactgaccactccctgttttatgtatttaagtacccctaaacaccctgtgggaaaatgccttgttctcaggaatgtttgttaagactggatgtcaactacatttctgaaaatcttgggagtatcaaaccatgctcagaatcatcatagtttttggctttcagtcttacttttctctccactgttaaatgctgagtcctgagcaaggacagggagcgggggatagatatttagtgcccctggggagggaggtggcttaggtcatggtcctgagaccagatcaaaggtgttgtagctatatttgtaagcacttggaaaaattgagatttatagttcaataataggagatctttaacgtaagttaaacagaaagttaagaagatatttgaaatcaatgatcgtgtataacttagagtccaggtttcttttattaatgtgtaatatggcaactagtgatatctgtgctcacaagctcacagggtgattacaagaaatatatgagaagacgttcttgaaaatactatgataattcttaattgcttttccccctcttcttcttcttttttttttttttttttttttgagacagtcttgctctgtcacccaggctgcagtgcagttgtgtgatcttggctcattgtaacctccacctccagggttcaagcgattctcccaccttagcctcctgactatctgggactacaggcacacatcaccacacccagctaatctttgtatgtttagtagagacagggttttaccatgttggccaggctggtctcgaactcctgacctcaagtgatctgcccaccacagcctcccaaagtgctgggattataggcgtgagcccccgcacctggccctttgcctctcttctaaagccatctttccaaccctattccctgcacattcagcaaaagatcttacctttaaaataataataataataataattgtgggactcaagcacaaattatcttaatttctaagctaggcctgcagattttctctaaatctgtacctcttcattcctcctgttatttagatcccttagacatgtgtgctgttgatccctcgtacttgttttcttcaggactttacgccgtgaagtgacctgttctccccctatatctctctatatctttagtctccaactctttagtgactttttcctcagcctgtaacattttccttcatcctgcatttgcctttaactcctctcttacatctctcttttttacttagccaagcttttagtgtccgcataagcttccattcaccagggccattttaaggtcttcactgtcccagcgtactctgtgttggaggtcttaccctggatcactagaacctataaaatggatctacatcactgattaaatagggttaattattttgaaaagatttgtggcttttgcttttgaagtgatttggattgagtaagtcacttatgattgattatgacttcttggcaatcattatgcttgctaaggaattcatgtgaagtaaaaaagaaacatccctaacctagaaattgtttccgagtggaatgaaatgtttctgagtgccaggtttatcaattagtaatgttaatttattaattttaaatttaattattttaagtttaatttaaatgttcaggtctcaggcatttttgtagacctttgaaagcttataggcataggcacttaaggttcttcctaatggcacaactagcttcagtccctccttctttactgaaattgctctggcaaaagccactagcgacctctgtaaaaccaaatccagtccacttgtcagcatttgtcatgctgaacctttttctgttttacaccgtcgatcataccttcccttctggaaactccttatcctaaggattccatgttcttttttgtttatttgtttttcttactctcctctgacccttccttcttagggttcatcatagaatcagtctccttctcttccccttaaacttggtcgtctccctttggtttagaactttttttacatgcccgttctaaatgataatttccagcccctgtgtcaggtctggcctttcttgagagccttaggcctgcatattcagctgtttctggacacaggcacctgagtgtccaaacaggaatctcacactgaactccttctttgcttgtttatctgtgttatttatctcagttaatgggaaacttatccctattcaaacaagccaaaaacctggaattctcctttttcttgaaaaattggtaaacattttcccagtacgaagtggagcattgcttcacaggcagtatatagaagcaacatcattttttttagaaatataattttaattttaacattcgttgtagctactaaattactgtttcacctccatgctaaatgtaactggaggctagtgattgcatattccaatataggattatcgaagactttcttgtaacaaggaaaataaatagaaaaggaagccaaaatcatttgaaaacccttcacttttgactatattacatgtatatatatttgtaattctcaacacatgtcgagaataagactttaatcgttctaatgcctgtgtgagtctagtctcattatttgaatgtggtgaccactgattggaaaggtcagaaaaggtgcatttttggtggatttttactccatgtgatatgagttaaatttatcctctgaagaattttaaatctgattggattgatgatatttttagtgtcagaaaaccattttaacaagaagaaaaagatttcagatataagaccaacagtaacctgtttaatttttaggactgataactatacagatactacctttagattctctggatggctaatatttgcaacacaagctttttaaatataagtttttaatttgttgcccattgttatatttaggtttgtaaatttttcaaatttaattttaaaattgtttatatggtgggtgttatatcaaaactgatgatatggtggatattttagaaaatgtaagtttcatatttctattttatgttgctatttaccaaatataatagaagctttaagacctttacctctgtagtagctcattacatttcacagaataactaatgaagatctaagaagtgatatataacatagcattggaaattgtttagtatggtttatgttaaataaaaacttcaacttttatgaagaatatcagaactcccttcagctggtggacaatatagtctatcaaaatacatcttgattctttctaaacttcactcaagataatactaaagttaaaatgtttcatagtagattatttctattcttccatgaatgttatcatcgtagattttagcatattatctttttcctatatactgtcccttaagttagttaacttctcttcctgccaagccacatttgttgtgccaaccgtgcataagcattatttgagttgtaaatgcttgtttttggtttcataccaagtagatcatttcataaacagaaaagcaaaccaggtatgtgtgacaaccaaacaaaagtaaaagctgttataattcatagtttttttcattaggaagagcagcattccgtgtcttccacattgtagcaaattctcagatatctgaagattttaattgataaagctaaaatgaccagtttagcctcagagtaacactccagtttcatgatacttttataaatattataacctttaaaacttttttatcagtggtcttaatggcctttgataataataagccagaccaagcacttaatttttttagacatatggatttgggggcaagaaaaatataaagtgaattttaatttcagtgttgtcaaactgtattcagccacagtttgcgtgatgtgagtctctctctgcctatgtcagcaacattaatgtttccaactcaactgttaagctactttttggtgacaaaattgtacaactgtactctactttaaaattcaggcatatttacagaatgtctgttatctgccagccattgtaatagacagtttgaaatgtctttttgaggaaatgataaaaatgaaggcttggagacaagtagtaacacacctaggagaaccctaagcctgtcagttttgttggtatcgtgggacatatgtagtcacaaatgtaaatagggagtactggaagatatatattcaatagagtaattatgggttggcacattcccaggtaacatagtaggaccacagactttggagccagactgccttctactagctgtataaacttgagcaagttattttaaaacttgatggctcagtttccccatccctgtaaatggagatgctaatagtacccaccacatgggattgttgtgatggttagaagagctaatatacacaaatactggtacatagtaagtactatgtaagtgtttgctacttttgtcattattaaggctagaatggatggtgacagaaggctgtctccttgggcttgaggccatttcagcgctctagtcttcaagagtgaggtaattttattttacagcagtaagagcaagcagccccatctagccttttgttgccctctgctccttggaggtgaaagagaagtacgaattggggataggaagttatctagaatcagctctgtccttccacatccctgttctttggagatatttagaaacgttctatagattagacatctattatgtagtggggtgagcatgtagacctttgagtgagtcatacttgaagtgaaaagctgactcctctatttactagttgtgaaatatgggaaatgatactgtgatctaccttgctgggatgttcagaggattaaatgaagtagtatctgtaaatactctggcacataataagagctcaaaaaactagcagatgttttaaatgagaatactagtagtaataatgtttcccattttaaaatgtaagtactttagggagagctagatattaatcattcatgccttacctagcattacgttaataacataattatattgcttacagccactgaggagctttgtgaataggaattttcattgcactgtgaaggtgaagtaggagagtgaacctagtgaatatggtgcagcatgaaccaggacagtggtcaccatacaaagttgaatatgtctgggcatttgattcaaatctgttaccagaggggctgggcacagtggcttatgcttgtattcctagcactttgggaggccaaggcgggaaaatttcttgagcccaggaattcgagaccagcctggacaacatggtgagaccgcacctctacaaaattaaaacattagccaggtatggtggcacatacctgtgatctcagctgcttgggtgctgaggcaggaggatcacttgagcccaggagatggaagctgcagtgagccatgtttgcaacattgtactgcctgggcaacagagtgagaccctgtcttgaaaaaaacaaacaaaaaaaacctgttaccaggtgaccacttctatttcatttcaacctatttagaaattttcccctaaattattatgtattacctacacacatttgttgaaaaaattatttcataaggaggcagcatgatgtaatagaaaaagagatacagcttaaaatcctgaatttgccattactagctatattataatttaattgtatattacttaatatataattaatgtaatttagttacatttaatctctcataaagtgacttaacctccctgagcctttgtttcctcagtcataagatgtactgctacgagatttaaatatcaatatatgcaaggctgttcccacagagcctggcccatatctggcactcagaattttattttttattcccatatatattcttcagactttgtacttgttgtcatgtcactgtaaatatgttcttatatttctgatcaaagttgctgaaaaccagcaaaatgacaaagacaaattatgatgtctgcagtttatttttaaatggttcagcaaaaatattccttcatatgcgtatgtgtagagagagaaagataaaacaaatgtggcaaaattttagcagttggtaaactagacaaaggacatacgggtgttcattttattctttgaggtttattgtgggttggtaattttcaaaataaaaacatttgagaaaaaagcaaactgtatttactcatgcaaaataagaccctaaaataccttctagttaatgttattatttaatgatattagtttaattgtagaataagataactagctttattatattgtgttaagtgggaaaatgatctttaattggattgtagtaaacttaaaatcttaaagcagaggatgcagaaataccttttatctttgtcacagatactctcatgggatttgcccttatctagtaagtgtcttaactttggtgtggctgatgggcttttttgatccttatgtttattagcacagagatttccacaggcagatacttctctttcttccccttccccttaaaaaaaggtcagccaaagtaaacagatagtatagttgaatatgtactctgcctcacaaacctttcatttcaactttgcctagtccccgttaccaacaaaaaaaggtcagtcagagtaaacagataagaaatgtggctgaatatgagctgccacacagcttcaaatgatcattttacctcatcttttaagatagttgtttttaattcctctacttttgttcatcaaaccataagaaatcatgtggctaatgatatgatactgattgttaacatttgcaggaactacagttaaattcttaggatgatcagagattttcaaaatgttctgtgccttcagatatcttagctagaaatgtctttgtaaccctatcaccgttttttgctttgtgagatgggttcaccacacctcaccaataactttagaaaagcatcttaatgtagtcatctttggtttccttttaagaacgggaatatttgcattccccgatttgtgtaatccttgcaaggatattttagtactgaatttattctgtgttaataaagcacattgcctgatgacagggtaggacttgtctgttttattgttttgtccctggctcctgggatgtggatatgctaagtacatgtttataaatataagtgaatttgaattaaatgaaaaattgtgataccctttggtcactctgactgtagaagctcaaacatttgtattttaatgtggtttccactttaaatatttctgaagcagtcattaataaaacaatttaaagtagaaagtcctgttgggatgagaaatcttttccaaggagaagacttgctgttcagttgtggttaagtcagcactgactgactaatagaatgttactatttagcacatttgggaccatcgcgtttgttaactaaagtgacagataaacatttttatttttttctacaaatcaagtgtaatatgcaatatactgacacatctctaagcttcatatatctttgggttaagatacatatttatatgtatgaagcaataactcccaagtttgttgatatgttcattttttaatatgtcccgaaagagtttttccatttgacttgtttaaattagaaaattcttgtgttaattactgtcatactggaaagatcttttcatgaagtgaagtatacttttgtaagttaagtaccagatgaaaatgaaaataatttcctataaaatgaaacaacatatattaattggaaagaaacttgtaagacttttgattttaaatagcttgctttataactgcagagctttttcagaattatttgttactaacatttttctttaagaatgaaaccagatccgtgtctaattcataactgaatgcaagcacatgaataaatagataaatctaaaaggaacaaggaatgttaagccttagcttaatgcagtataagtcattgctttgaactttgaattgtgctgattagttccaacagaacatttatggactttctaaattaatttgcatcatactttttaaaaaatcctattgtgtggtttcaataaggcaactgagtagattttgttgcatgtatttgtattttttaaatgtagatactgctttttctcatttttcgtagtaggaagtcaaaagataatatctgaaaatgacaaaataaatgagctccatgagcatattctttagaaatatagagtaaaacattagaagaagcaactaaaagaatttagagtgattgcctctgaggtgaaagattgaggaagtacggcaggaagctgctgttttctgttacaaaccttgtagaattagttgactctaatgtgtgcaattatagtttttaagaaaaagataattgagcagaaaaacctgtctttccctctctccgttatttgcacacatagtaagcctatttacttagaccaactgggtactgccagtcagctggtagtagtttacacagttcccagagagcataaggatgaataatacaccctttgaggtctgtcctgaaaccctagtcaagagtgtggcaacactaaatattctaaaatggaattcttagacattggacttaatggaatgaaccacgtggagatttaaaaaaccgtaattattcatctattttcatcctaaataaaattcagcagagtcccttatctttctccagtatattatttacagtatgtgtgtctgtgcacacatgtgtaaaacagaaaccatccttagatagcttaaatataaacagggaaatatttctcagactatggggtcccccagagcccaaaggcagaagcacggtgtgcagtgtggcctatggaaggcattgaaactgtacagccgactttgtcattcctcctcctcctgcaggctgatttttttttctttttttacctcaagctttcatgtccagttacaagaaaaggaacagaattatttggtctgctctgtctctgtttttttctctctttgtcggtgtctgtcttctccccctcctcacccccatcaccgtgtccaccctctgctgaggagagagttgttaaataaaggagatccttgtaagcagtgcagacattccactacatgacagcctgagtaggtttattcataaatgcttagctgcagagatgaggacattaagtatttcatggtaatgtcactaataaatgaccaaagcataggcagctgctgtaagcttaatgattgtcaacatttaggtgtggggtgaagttctaaagcaaccccatgtggtcacattatccactggtgaaatgctcttttgctctaggtgggtgcattttggtgctaccagttacgcttcagatgtacacagactattcttatccttaagatagtgatactatttcatgagtagagttcttccagttttacttcttttttagtcaagcatttatttgaagctgtattgcaaaaattatttcatgattctttgatttgtaccagtaagcaatacacaaaccgcataggagttttgcctcttttcctttatctcctcttattgagatgtggcattcttcagaaagtcatccagcatccctgtggatctctgccataaatactctcagagcaggccttccatcagcctgatgattttctttaatttgtcagagtactctaggctttgtggtatgtggttcccgggcttaatgtttactgtgatgaagtaaagtctgcttctctaaaatactgatctgattagagttttcgatgaaatattgtgatggactcattttgagaaggaagcttaagtctagaattttatcatatgtaaccttcaaagtttgtaattgtggagtttctgggtattagtgattgagcattccaagagacacctttgaaaattgttcagtagtttttcacaattgatcatgtattcttcatttagcaggtagttagggtttttttctgttttaaactttatttttattgttattaatacaagttccaaaaccaaaaaacagtttttaatccagtcatgcaaataaatgaatgttaccatcagtaaatatttttgagtgaatgaatagtttaactctataaaattgttcaacagccctttttttttttttttgagacagagtctcactctgttgctcaggctcactgcagatcacggttcactgcagcctctacctcctgggctcaagcgatcctcctgcctcagcctcccaagtagctgggactgtagacatccaccaccatccatgcctggctaatttttgtatttttggtagagacagggtttcatcacgttgcccaggctgggcttgaactcctggccttaagtgatccacccgccttgcccttgcaaagtgctaccgggcccgaccacttctattttttaatcccttccaaaaatgttacagatcgtaaagtaataggcccatgagtccatgtgttctatagggggttcattgcaaaaggatggaaatctgagtgattatagaaagagagttgagtgatacataagttagaaagagacagcagagtagactagaggatgcaataagtgcatataaaaaatattaaaagagagaaaagaaaattcccaaagtccttgccatggtagttcagatgtattctggctcataatttccttaggatttttattgtaagtggctgactaatggactcttggcatgggctttggcttatgaaattctttctgtagtttgaagagtttaggggatacctgacttggtccatgcctatttgaactttcagggtgttaatcaaaactgcctgaagaattgcagatcctgcccacctatatttaaaattttctggcatgacctaggcctagagaaaaaaatgtatggtgccatcttttttagtagaaaaagtactagacatgatgtcaggagagtctgtgttttggggctgccatttattagctctataaccatggattgcttaatttcttggatcatattgtcttcacctttgaaatgaggattatacccattgtatatttatttgctcattcattcattcattcattcatgagtgcccataaattctttggttgaccatgtggcagacacttttatacatgcaaaagatacaaagaataggacactgtccctgaattcaaggagcttattgcctattaaaggaggatagatttgtattaagaaataaataaatgcatggaaatattatgagtactatgaatgaaacaagaaacatgagaatcttttttgatgtcttctgtttcattaatcaccaggttgtattaattcttctgcctaaataaatctccaatccatcaacttttcttcatcatcacagtcagtaccttaagtccaagctgctattacctctttttggaccactgatcttcccatacccactcaagccctcaagtccattcttctcactgtggccagagacacctttgaaggcaaagctgatcatagaccgatgttaacagtaggggaacctggctgttgaggtgtatgggacccctcttcactatcttcacaagttatctgtaaatttagaacttttctaaatgaaaaatgtttattaaaatgttttaaaataaggcaaactgaccacacaaatttaagttgctgcttaaaatccttcagtggctttttttttctttttttaaagagaaaatcccaaattcttcaaatgacctacaagacctgtttgacctggccctgcttacgtcctggaacattcttccctttccctgcgccagcctcatgggccctctggtcacacactgtcaggctccttgcagacaagcaataagctgctcttctgctgtctccctggctaactcctcaaccttcagatctgcagctcagatgtcacttcctcaggacgtcctcttaagtcatcctgcattgtcttttggggcacttgtcaattgtcattacgtttgtgttttggtgatttttaaaaacatgtcagttgatcccactgaactatgagccgcacaggagggctgaggccatgtctgtcttgcatatggtgcttagcacctacctggcacatggaaggactcatcagttgttgaatgaataactaaatgatgtgaaagtaagtgttgtgacatttttgctccttgctctaaagactactgtgcccaagcactgcaaatggagaggagtatatagtgaaatttgcttaaaatgataaaaacacaacaaaaattaatatacatgtaagacattgaaaaatagccagaacattgtccctttctcatagtaaggaaagacttacaagtaattcatgactaactcataagttgagtacagaaaaggaaaagaaagaactttaaaaaaatattttaaaccttctgctgaattcacctgttggctaaatttcaaaagtgttagtatagagatttcaaattacatttagttaaagtagaaagtaagtaatttcagcttaattgttgaaatgattttgacgttgtatttaatacagactatgatgagccaggcatagtggtacccacctgtagtcccagctatttgggagggtggagtggggagattgcttgaggccaggagtttgaggctgcagtgccctatgatttagctgtctccaaaaaaagtaataataggccaggaacggtgtctcatgcctgtaatcccagcactttgggaggccaaggtgggcagatcacaaggtcaggagttcgagaccagcctgaccaacatggtgaaaccccgtctctactaaaaatacaaaaattagcaggggatggtggcacgtgcctgtaatcccagcactttgggaggccgaggcgggcagatcacgaggtcaggagttcaagaccagcctgaccaacatggtgaaatcccatctctactaaaaatacaaaaattagctgagcgtagtggcgtgcgcctgtaattccagctactcaggaggctgaggcaggagaattgcttgaacccgggaggcagaggttgcagtgagccgagatcgcgccactgcactccagcctgggcgacagagtgagactccatctcaaaaaaaataaaagtaataataaaatgtttaaagaagagagatgtgatacagtgctgtatacttgcattgttaaagaattgtggaaccaaaaagcaaaaaataactcaaccaagacattatattatgatatacaatttaaataaaaaatgttcctagagttctgtaatatttttaatcattggaggcttatccagtatatttacttcccatgagggagattaaatagtcagtgatttcatcagcaaagagacaaaaaggcaccaagtagtatatatgctggatcaaaacaaacatttcacttaagaataatgtgccttatttgaccacttaatgatatatgatagtatgacttcttgcagcaaaaaggagctcattttacttacgcgatagatgcatgaaggcccttggatatatagcacttatgggatgtttgaatccagaagaaggttgcaaggagagaccatgcccactcccttaactgcaaacttgagaaaacttggagaaacacccactttctccctgttagcccctcctttcaactcactctttctggctggaacttcaatagagatacatagaaaaactctggaagtatactcattaaactgttaacaatggttgctaattagagagtgagaatggggaaagaaatacatgtatttcttttgttattaaaaagccattagcaattaaataataaattatagtatattgacataccgtttagcatttggttttctcaacttagtttgtataatttactgtatttaacaatatttttgatatttcactactgaatattatttttaaattatgcatattaatattgattgaaaaaattttcctgactcctgatccccttgaggtgaagaaatctgaagcttaggttgtctctgtttagtaaatcctctcaaggcaaaagctggcttcatttttccatttactgctctgggtttcagtcttgtgttggtttttactatagtgttcctcactaatgctttaatgaagttttaaggttggttatttgtttttatgtttcgtccagggtttttagttgtttttaaaatgttggtctagaaaccaggtcagccattctgttggaaatgaacctctcttagattaggcaccataatgtatacacttggtatgttacataatttctaccagagctgtgaaatggtataatgaagtgtctttatgccattcagtagactaaccctcccttcaccaaagagtttcagcatgtattttctttgatgaactctttgcaagatgcagataaatactggatagtttttcccaggttaaaattatgtctgtgattctgtggtgtagaactctgtgaggctttgactacccattagctgtatattagagcaaattcaggtggactttttgaatagaatcacagttctcctgaatgtgtgacttccctcatcacactttcaggctgaagttggatagctgcacacatgtgtctttgtgagacatcttaattttcataaggcccaccttatcttatctcagtgcagctttgtcctaagctggctcaaaacaacagaagctgcattccaggaatttatcaggagagtataaataaattctcgttgttttgtattatccttacgttctaaaagaaaccagtttttatggtttacataaagaatatttagcgtatccattctgctgaaataaaatctaaatttcaaatgaagtcagagagctaaatacccggattacatcaaattgactttcccttagacccattcttttaaactgccctttagggtgatgccattcactcataagcagcagctgacaaagcatctgtatgtttcctcacagatgttgaggatgttcttattacataaacattgggtttcttgtcactgaactcccaagggagaatttccttctgagctttccaggagcagtttggttgtggacaccatgcatttgggtcttgattgtctccctttttcctttggctgctagaaagcttagcatcttgaggtccttccctgtcaaggacatagaacttcatggaatgtaccaatctcattgcagatgccatcttactttcctacccttaattttcctttaactcattttttgccatattaaatgcttattttaaaatcattttgagtattttttggaacatagtagccacatgcagaatcatttgattattatttcagataatgcaaatcagtgaataaccatgttttagaaatgaaattacaaaattatatgtttacttttgcttctctcaacattatcgggacccagaaaattagattttgatataattcactgtctctagaattcaaagaaacaaatatgcaaagacagtggagaccactattaggatttctgagaatgcatacagcttgttccctcatttggttgaacaggcaaattttcaaaagtaaaatcactcttcccaaatattttgtagattttggtaatctgataaatgagctatttactcattgtttctttggtacccacacagtggattatccatagcgacaacccttttcaaaacttaatagggccaactctgtatttattagggaaataataccaccaggttaaacaaactgtggctcttggttctgtgtatttactctctttcaaagggatctgttaaaccttcagtgtgccatgttgtagatcattagagaagctgaattaggatatgactctgtgatcctgaatgtgcctgccatttttatagtatgtttagaatcaaataaaaaagatgatgagcaaataaagcattagaaataaagtaccatgttatgtattgaaaacagggccaaattcttgtctgcacagtacaaatgagagcttgattatggtaaatattaccactttcagtctatggaggttaagtagaatacataatattggctcaggaaaatacatttctgtttttcttgattctaggaattatattgatgtggaatctgtaagaaaggctgtgcctcaaaaaagaagaaagatagtttcagaattacagagattttcataagagaacagatttttttcaaagaattctaattgctgttgaaatttaaattaagcctaagatctttcatgtcaattgttgagaaatgaagtcatatttaaaatcacaaaatgttagagttcatttaattcaatatccttattttatagccatgaatgcttttagaaattgctacaaaagcatactatcatctcaatgtccttgtgcaatataaaaacattttttaaattaaaacttgttaagcttctgtcctaaaaggtatactaatgggagtagaataatcttttatagggtagattgatgtagggttttttttttatatatataataggatggagtacttttttttcttattggattttttacgtagggcttaatagtggggttctgtatttatgaattggctgagcctgtttggataaaatctttgctatgtcaaatatctattttttcttaatataagttttttggtagttttagcatttaaattattcccttttatttatcttcacagattctggaacttttcaaagcctgactctcttcttgaaacagtggagcatcatacagagtttacttgtggtttagacttcagtcttcagagccccactcaggtaacggatacaatctcatgatattctcttctgcccaagttcacagccaactctgtgtggcatgcattgcttttatgaataaaattgttgccattttagctatataagctggagcgtttgagcattaaactactagggaataagaggtatcaagaaagttgacatacctttctcctcttgaaagactgatttccctgagagaaaaaggaaccttcccaggaggtattatcctaacattttaaaggctttctctaggcctctcccaacagaaaagtgacaagagaaagatggaatatggcaggattgtcgccacgggttggcaggagtcaggagcatgtggtcctgactcagctgtcccattaggcagttgagaccatgggcaggcaggtcactaccctttcaagactgtcacccttgtcttcacaccacgtgtcgaatgggaggcttctgatggagaacaagtaaaatagaatgtctgctatttaagttaataaacaatatatgtctccctttttgttctcttgaggacttgagagtagacactttggactttaaatatccctcaggtttttttttttaaaaaagccttttcattttagaaattgtaaagtcaatcagaaacactacaatatgttgagtgataaggccctttaaatacagagtgtgtgaaagaaccagcatatcaatgaaacacaaaataatatgtggaaattgtagagcatgactgtgaaattgtgcttttatgataactctcataagttaagcaaaaagaaaatcccacttcacattaatgtgttctgaaatttaaataaatatgtaagtgttttttttttcttttcttttttttttttttttttgagacagagtttcacactgtcacccaggctggagtgcagtggtgcaatcttggctcactgcaacctccacctcccaggttcacacaattctcccacctcagcctcctaagtatctgggattacaggcatgcaacaccacacccaattaattttttttttttttgacagagtttttgctctgttgcccaggctggagtgcagtggcgcaatcttggctcactgcaaccttcgcctcccggattcaagtgattctcctgcctcagcctcctgagtagctgggattacaggcacatgccaccatgcctggcttattttttgtatttttagtagagatggggtttcgccatgttgactaggctggtctcaaactgctaacctcaagtgatccacctgctttggcctcccaaagtgctgggattacagacatgaaccaccgtgcctggcctaatctttatatttttagtagagatggggtttcaccatgttagccaggctggtctcgaactcctgacctcaagtgatccaccctcctcggcctcccaaagtgctgggattacaggcatgagctctcagcctatgagtttttcattttaggaattaaagatgtaattctgagtttaaacgattctcatttggtattagaatgttcccattaacattagaaataatcatttaaaatgacttaataggatataagagaaaaaactgaaatagtgatgagtgaaatggcattttttcagcataaatataatgtgtttcaaatgaactagttccttttctgatacatttattatagatggattttaataaaataattgtacctgttttctattttagtcttaaaaagttacagtgtacatactgaaatatggcaccccaaacaaaggatcctaagtaaatattcattcaatcctcatccttatatatttctattacctgtcctctgtgagcccagactagaacctgtggcagcagctgcagcgcctccatttcctcagctatggcgcttcctcgcccaggtctgaagaataccagatgttttctaaatcctccacacatagtaggcctaccttattaaaagcaactttgtgatgagaggacttaatcagaggacatacatccctaagtaatagattttattcaaattaagatggtgatctcaaccagtattttaaacacaaacatttgagttgtgtatattattaatttatatatttttcaaaggataatttgtattattttaattatttttatgtacagaaaactcaaccgtgtacatttaatccagtttagtggcaggttctttagcctttgccttttccagcttggcagtgtgagccacagacttgggaccaaggacattgcccccccagtgacagcagatctcatcgtgtctgtcattgtaattggtcctgatagcttccaccatcttagccaaagcccttttgtcttccgagttaatctgtgtgaaggtgatggtggtgtgggtcatcctgtgaaccagtcttgcctttcccttgacagcgcagtcagggacccccattttatgagacagggcaggcaggaagacaaccagcttgatgggatccacgtcatgtgcagtcaccgccagctgagccttcttcttctccaccaaggtggtgacggtgttaaccccagcttgaaggacaggtggtctcttagtggggacatcccctttgccaacagctttcttctcagcctgggccaagtctctgcctcttctcttgctttgtctctggtctgtattatgggccagcttatgtagttgagtagctgtttggtggtcccagggcctgggtgaactggttcatcacaggaggcacttttaggctcttgtagaggataactctttgctgctgcagcctgacatagtggggccatttcacaaagtgggtgaggtcccttttgggctggatgtcctgtccagtgccagaattcttaggcctttactcaacaggggattcaccactttcttggcctgttgcttcaagatagcaggggctggggccccgtcttgcccttggtcttctttcggcatcttgggcagctataggagagagataatttgtatatttacaagtcacatcaaactcttttctaggggagatatgaatcaagttctacatgtatctccatgtttttccctctcacttttgtcagttatctattactgtgtaatgaacaacttccaggacttagtggcgtaaaacaacaattttatttgctcacaattctgtgagtcagcaatttggaccagacacaccctagcagttcttcttttggtctttcctgtggccacccatgtggttccagccatctggtggcttaactagggccgggtggtcctattaggcctcgttcaatgtgtctggtggatagtgctggttgtcttccaggccgtgtgtctctaggtatgcccaggtctctgcacttaacagttgtgtgtttacaagagggcaagagcaaaagctgcaagtcatcttgagaattggacttggaagccacacagcattccttctgttgcaaagcaagttgcaaggccagcccagattcaaagagtgggaaatagactgtaccgtttgatgggaggacctgtgaagaattcatagtcacttaaaatctgccacactaacctgtgttggtatagtaggtggtttaagttttatttttgtttgtttgttttgagatggaatgttgctcttgttgcccaggctggagtgcaatggcgtgatctcggctcactgcagcctccgtcttctgggttcaagcaattctcctgcctcagcctcctgagtagctgggattacaggcatgtgccaccacgcccagctaattttgtatttttagtagagatggggtttctctatgttggccaggctggtcgcaaactcccgacctcaggtgatccgcccacctcagcctcccaaagtgctgagattacaggcgtgagccactgcgcccagccaagttatttttaacatactatatttatcctttagtctcataatgtgtcagatttacagattgtaagttaatttaattttactctttgatcattttttattcccttagaaagtatctttctctcacctcttagtgtctttccatctgctttcatatacctattgtcttttgtgatcttagcagctgtaggaccttgctgatgttactttaaggctctgtgtttttatatattctcagtcttaaaagagatttatctgagttcttctgtgtataattctttttctttttagcttctcctttcttagagatctgagaaatgaggtcaagggcattcatatattacaccacctttcttcttaacagaatgtaagatcttgtctttaaaagtttaaaacttgacaaataaatgtctggggtcattctttaaggataattgctgagaaatgctctatgccctctcttgttaaccaggctgaaggcatcgttttctttgaaaattttttttttctgatcatgatttgtacagttctgacattttatcttttctttcttatccttcttatttctaaattagatactctttttctttttgtagacttgtgattctagacctataatacacctatttatataactggaatttctatattagtttagaattcctgactttgtgttctgcagtatcaattctgctcttccaaatgctcagtgatgtttagtttagtatttataagctggatacaagtttacatatctttatacattcttttgggggcatagttatttattattttaatctcttttaaagtaaacgctaccactttcagatgtcgctgctgtatgtttaataagctttaatgttttcctcatgacaaaattttggaaattacatttagaagaaagaaaaaagattacctctagtttccccacttgagaaagaatctcttataccatattattatgtttcttttaaaaatctctgttttaccatattattatgtttcttagatttaattgaaatgtaaatttatattttaaaatgcacatatttttaagtgtacagctcaattagttatccagaagtgactacccctgtataaccactatccacgttgagatacagaacatcgcttgcattccagaagcctcttcccaaatctgaacccctccttcccagtggtagccacccatccagtctctgtctgtgtgtgtatttttcaaagtttgggtaaacaatcttttctttctttctctttttttttttttttttttcatagagacaggatcttgctatgttgcccaggttggtctagaactcctgagctcaagcagtcctcctgcctcggcctcccaaagtgctggcattataggcatgagctaccatgccccacctaagataatctttagtgaatgaatatctgaatctgtccatgctaggaacatgtagctcctatataatgagctttctttaaaatattaatagagtagaagtagttttgtatatttttgttttgtttcagtaaaagatgattagatttggttctgatttaaactagttctttagatatatttttatttttaattattattattatttgagacagggtcactgtgtcacacaggctggaatgcagtggtacgtcatggctcattgtagcttcaacttcctgggtgcaaacgatcctcccatctcaagcctccactcccaccctaccctactgaatagctgggactacaggtgtgcactttttttttttttttaattttttgtagaaatgaggtctcactgtgttgcccaggctggtctggatctcctgggctcaagtgatcctcccacctcagcctcccaaagtaccgggattacaggtgtgagccactgtgcctggttagatatcatttaaaaattcagctcttgttttggttcaaacctctattgccataatcttcgataccaggtttaatggttgacagtagataaaagtatttaagaattctttaatgagtttagaaaattggattttagaagatggcaagcattattggtagttaggatatttgtgtcctgttcaccttttatgtcaggtgatattttctgcatctgtcacagactagctttagagttaaaaagaacaagtgccagaagcagtcggtgtcctcaggcattagtctctgctgtttcctcattgatgctttcataattgtgtaattttttagcttacaatgatataacaagtccttgttgttttcgccaagccataaaacatttcccagttccagctctgtaggatatcagtgtgctccttagatggatggtattaggctgtgtctgctgccctctgcactacatagacaccctgatatagtttggctgtgtccccgcccaaatctcaccttgaattgtaactcccacaattcccatgtgtcatgggaggaacccggtgggaggtgattgaattatgggggcaggtctttcctgcactgttctcatgatagtgaatgagtctcatgagatctgatggttctataagggggagtttccctgcacaagcttttttttttttttttttactgctgccatccatgtaagatgtgacatgctcctccttgtcttctgccatgatcgtgaggcctccccagccatgtggaactgtaagtccattaaacctctttttcttcccattctcagatatgtctttatcagcagcgtgaaaatggactaatacataccccttgcaattatggcatcccttcactgttgacatctgcctctgatctttcattcctgaatcactcactttcctattcaatttcctttctcttgattatgaagcattgcttctgaaaacccaccaaacatactgactaggcacacttcagattactttttaaaaaacttcatttgggctcttggtcctactcaacttacctttgaagtctttctgattttacctttgaagtcttttttatttttttagtccattctccactgtatctttcctcatcctttttcagtgtcagtatctggacgtttgaccttatgttctacttactgttagaagagagttcccaggaatgagcatctttttccgtctctgtcaccccaaaaggtttgcattttatctctatttttttcccattcttccagtgggtttctaattttcttgctggtttcctcatccacatctttgcttcttcacttatccactgtttttagatcttcaatcggttcttctgttttcaaagctctatggggcttaccccactgtcctgtcacactatcagtaagttctgtttctcttctattattaaatatctagaattagtaaattgacctcttgcttttagtttctcagaatctacactctcttttaaacctgtcttcctttcatcattcaattgaagttaagcccaaaaaggtcaccagtaaactcctgaaacccgaattagccttttttcagacttttttcttatttagccatataattttgatatttgaaaaaaatcttcctgtcctattttttcaatgctaccatgctgacctcttcttccttacctctttgctacatatcttcatcaccatccctccaaaagtagatgttctccaatattcaatcttagccctcttactttggtgcaacttccccttaaagctgttgtataattctatgctagtgatacttgccctatgtatccagcagactttactgtgagatctgagtagatgtcatgcttttccttcagtattcctaacctggtcagttgattgcatttcggggccatactagagatctgggaagtaatcctagttttcctgtctcttcgcatttcctaaattcaacttggtattgagttaatgagttatttctcaccaatatctctgaaatccagacaatgcctttctacctccactgccttagataagcacttatttgtacctttaccgtggattactgcaacaatctcaaacctggtctctaagctctttccatcatcccattgattctccatgttgcctccagggagaggtttccataatgcaaatctggttttgttagtgcttgacctgaaatacgttaaaggtaggagcaaggtgagaactgccaccatcaccactgtaaatgaacatggttctaaaaattgtgtggccagttagaaataggagaaaacaaaatagaatataaaattttaaaggtagaacattttattgtcatttgtaattcatgattgtcaaattgaataagtattaaatatatcaactttaaacctattaaaaataataagagagtccaatgagaaagtcagttaaaataaatgtataacattgaataacctatagatataacaattatcagttagaaaataaaatgggaaaaattacttttacaaggcagcaactgtgtatgtgtgtgtgtgcatgtgtgtgtgtgtgtatgggtgtagtattcccaaagaaaaaaattaaaaatatacaggactccagattaagaagattatgttactttgctaagagacctttgaaaaaagactggaataaatggacagacatatcatgtgcctgcaacagaatacatttttcctattgctgtcccttttttaaggcatttgtcatccaatgcagatgctactatatttgcctcctaacctatctttctctttttgaaattcctggacaatcactcctgtgatgcttttaaaccactctgaccattaacctcttgccatactattaagtactagttttaatttgcaaatcaatccagttaaattgtcgtttttatcattgtcatctttgctcagaaaccttcaagaggaagcccattaattcccttcagtgtagagtctgaacttttaatcttgctttcaggattcagtgtaatccgttttcctttttaattttagttctcaccatcctatgtaatcctctattgcagaacaattacattttgttatttgtcatatccatgtttttacccgtttctcttgctctcctccgcctctgcctatggaaattatttctgcctttttgactccagaattaagttcttctcttccttctctcctcctcttctttccttctctgcttcagtaaatattttgtgtcaactaaatatcttgagtgctcggaaatacacagtggattaatgtcaaccacctgatacatatgtgctaaatagctattcaatgaattaatgaaaaggatttttttagtttattggtcagctctttccttgcttttgcataaattccataatgattatcataataaaccatattctctcctgtagtcactttctattgtaagctggttgagtaagtaaagcatgtttcttccttgagtcccaaatttaatatactgcagtataatgtcttggctgctttttcaaaatgtagagttaactgtgattttttttttcattctgtctgtatctttctgcctgtttctattattcatttttgctaaagaggccatgtgtcataaagataattacagtagattgaacaagtttcccaagggcaaaagcaattgtccacgaaatagagaaaaaaagggtataatgataaataggaaatggaaaacttcttaataaagtaaagctcctaatgagtcagttggaattcctgattattattaacaatcacattaaatcatttgagataagttaccttatcagttgcatgtgtaaatattttaataaagtggagggaattgatgcaattaagggatataaattcattttctaaattttacacgtatttaaagtgttgtatttccattttaatgtttccttctctaaaatccacatttatgggaccattattattgaagatgttctataatacatatgatttgatccactattggtaaatttttattatagtcttcttagtgaatgcatgtttctttactatctttggatttatgtagcatttagtccagtattttgcatataggaaatgctgaaatactggtttaatagagttgctctctggcattccatgtatgaagatgtcttaatgtatatgccatacatacctctgtttagaaattaataggctttattgacataaatttctgttcagtttttcaagctttattatatgttttgaagaaactgacacattagttcaaagcaagtaatttgtatttctgattagtgtgcttattcttataacagaaatacctattttgctgtattaaagtgaaaatgaaataattaaaaatagaacttatatggcatcttaccctattagtttagttttttttactaccctagtagatagcatcttttaaaataataagattggttctctcttcaaattttacattaagaaatataacattttgacaaaccatttttttttctgtaatgtcagtaattttaattctgactttgatgaaaagattagcatgttggtcttagcttaaaggaaattcagaagggcatagggatgaaatgtaccacagcaggggcttgtgagtaaaggaatacattttccacttgtgtatccttgggcggaagcagtagagcctggaggcccctgcccttgagtgtccacatgcacactcatactgtaagggaagagagtcaaacaagagataccccagccttcaaaaaaccctagttgggattcagaaaaaaactgcctctcgaaagattgagtttcgtcagaggagttataatgcaattataacttttaaattgccttaaaactaaaactttcagttcttcacttactcggatgtatcccactgcctagaacattttccttttttccactgtgcccctgacccaaaaacagcaacaaatgctgtctagcgggttcctcctttaagcctcagcttagatactacttccacctgaaagcaggcacttccctcacattcgattataatggccccttgcctacttttatgggaccccataattcctctatcattttacatattacgctacagtataggtgtctctttgcttacctgtctctccattacaatcaagatctgtggagccagagaccaggacccttgtgtttattgtcgtaacctgtacatacttctgacacagaggaggttcttaataagtctttgttgaataaatggatgaataggtgtatacataaattatcttttagatagctttgtaattctgaggaatatttgacaaacagttcttaggacacaaaggcaagctccctgtgaaacttctctaaatattcctgaaattaaaaacaaacaaacaaaatatatatccttcaaatcccataaaacttgttgcttttacccacatctctgacctcacacctaattggatgctttttattatgtgaggggctctctctactcaacaaaatcttgcagtgctaccagaagccattgcagtggcagtgataattaataagaggtcccctggggaccacatggcacaatagtttttccttaccaggaagttcctacatagcaaccttggagaatctagagcctctttgttagttagtaaagtgcttttttcttaccttattattattttctttattgttagcttgcttaaatttgtagaaccagatagggcttaattaacaaatagaggaatactattttcatcaatttgaattaatctattcataattctatatcattgcagttttagatctatcttaatccaattaagtatagatttatgaacatttgctgaatcagtggccttgacatttggtagttattataagtcctgaataaataagaagctggattggagagtgccgaataaggtttcagaaacataatttatagataccttgcactagaaacctaagtcttatttctctgattctcttctctccagtagcggatgcttaacatgtgggaaggcccagcacttgaaaaaaataggcatagatgagacaggggtaatttaacataatgatctttgtgtcctatggtataaaaactgaaaactgcaagattaggcaaataatggttttcagtttgccttttctatgaggcactgttttagtggatacattcaacaggtttaggttctggctgtagctctgctactctattgtgaacatgaggacagagttaacctctgaaattgtaatctatgaaattaatttgttgagccaatattcattgagttatgttctaataagacatggtccatgccctcaaagagctgaagacaactctttgtcttcagttgggaaaataagtacaatcaagtattatgggtacaatgaatgacttcatagaggagatgatacctaaactgattttttaaaaaagagacatctctggcagagcaaggcaaaggggacagaggagcagacagaaagggagggagaagaggagttattaaagggaagcgatcagtaaaggaacaagagcgaagaggcataagcagcatgcttggatttgaggtgtgagcccggtgcaatgagaaatgaaatgggaacaaccagatcttgaagagtgaggtttttaaatttaaaagtttgactaaaaagtctataatgctctctgtagcttggattctgatctcagaatattggtagtgaatgattggctatcactattcaaaattagtgatagccaagaaattacattagtcaaaacgaggtttctcttgtgtaattttcagcctttgtaataagcatgaaaggctgggaaatggagtgcaaatacttttggtcaaaagcactctcttgctacttcatctttcattttactgcctaccttgtttcttttcttcttttttttaaattgtggaaaattttgaaaacatacaaagtaacagaatcagataacgaacttcattacttagcttgaacaactatcaacattcttattttatttattcctgtactctcacacatcgtttagttatcgctaacattatttttactatttttaggtataattcacatatattgaaatttacaaatcttagatatacatttttgacaaatagatacgtctgtgaaattcacatcatcccagttattggaaactgggaaagcccccagtttcctttttacccctttccaatctcccctatccccacccttccctccaggtgagaagagtaacattgttctgactttttgtttgtttgtttgtttaccttagatgagttttgcctgtcttagaattctataaggaactcttctgtatgtcctcacttgtttctggcctcttacctgtgagcttcacccgtggtactgagcctgttagcaattcctccctttgttttgctgagcacatgctgttgtatgaatttactacaatttgttaccgattcttttgttagtgggtattttggttgttttcctttttttttagacagagtctcactctgttgcctaggctggagtgcagtggcatgatctcggctcactgcaacctctgcctcccaggttgaagcgattctcccacctcagcctccctagtagctgggattacaggtgcacaccaccacacctggctcattttatgtattttaggtagaggtggggtttcaccatggtgcccaggctggtctcaaactcctgacctgaggtgatccatctgcctcagcctcctaaaatgctgggattacaggtatgaaccactttgcccagccttgttttcgattttttgctatcgtgaatgaagttgctatgaacattcgtgtctacattgttttgcaaacatatgttttcatttttcttggacaaatatctgggagtggaattactgggtcaaaagataggtatgtgtttaacttggtaagaaacggccaaattgttttccaaaatggtggtaccatataccttccctaccagcaatgtatgtgatcacagctgttccacatccctgctgacatttggtgttgtcaatctttaattttagccataatgtgaatatatggtggtatctcattgtcatttttatttgcatttccctaatccctaatgatgttgagcacttttttatgtgcttacttttgcccatcatttttcattagattgccttttattattgagttgtattggttctttatgtattcttgatacaagttgtcaggtgtatattttatgaatattttatataactgtgtcttgcctgttcattttcttaacagtgtcttttgatgagcaaaagttttatttttgattgagtgtaacttaccaaatttttgattattactttttgtatccctaagaaatctttacttacctctgtattgagaatatattttcctttttttttttctgaaagtgttatacagtttgcttttatatttaggtctgtggtgcatctcaaattcatttttatgtgcaaagttggggtcaggattcacttttttccctatggatattcagttgttctgccaccatttattgaaaagactattttttccttttgctctttaattgttttggtacctttgttgaaagccatttgtccaagtgtggggcctatttctgaactctgttctcttcctttgatctacttgtctttatcctaatcctgcacagtcttgattacagtagtttcgtgctgagtctggaagtcagctagtgttaagtagtgcagctttgtttcatttcaagattcttttggctaagtcctggcatttccacataaattttaaaaattgcctcatccatttctattaaaaaacgagtatatagaaacacagtggttttcatatattaattttatacccggagacattgctatattcactaagtttttaatgcatagttcctgaacaccctggactttcttcccttcatgttttcctatggctctgtagatgtgaatgtccttgtcttttatgtctgcctcctacagaggtccagtgggaatgccatggcattgtgaagttgtctgacactgtcccagctggaatcatatagtccccctaagagtctctgttagtgcaccttccacactcagtcttgaatgagccattttttgaaggcaagagctttactttatcttcctctccagtcccacaatattgagcacagcatcttgttcacagtctggaacgtatcttttcgacatttatatcagatagtagggaattatgtagctgttgggtgaagtgaaggtgggggacattcttataggaaacctcagtcaattgaaatataccaattggaatatactcaatcaatgggaatcagttggaataccctgaggtatatcctaaaaagggaatatggaccttttatcaaaaacgtagccctatgttttccctattcaaaaatatgtttactagtggatgatttacgacactctaaatgacttgagtttttgctgtcaattttgaatttttgtatgtctaaatacgtttcttcttacttcatttttgttttctaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttataacttcccccaaaagactgctctttctaatacattgtatatgtgaatatagtactatatataatatagatatatctgtggttcagtaacaggacactagaatatatttaatttattcttttatttagtagctgtttattgagcatctactcagtgcttgacacatagactcaatgagattctgtcaaggactggtgccatgtttttaagaacatggaatgctgtgagctaagagcttacttttttttttttcttagaatttattcacacatttttagatattgtacccatgactctataattttgtcttcccacttctctaatatcaaaatttttttaaactgtcaattaaacaaaaagttttaggtcctactaaggcttctagcttttgcccttgaaaccaggcctaagtacagctatacgtgctccttgccacctccctaagttttcttgaaaaagctctaggtgcagatgaactgaaaaaaacaaaaaaagttggttaaagaggaaaaatcagcaaaacaaactactttgcataacacttatattttctacataatattaagatatgctataaatagcaaagattataattcttaagttctttttaaagaacaaaatacgctcataataatcagagcaaaaataaactaaaatatatgtatattgtcttctttatagatttccttgtttacttgttgcagaaaaaatttaagacagcttaagatataaaaacaaaacaacagcataaattaagaagtggaaccaaagacagaaagtggaggcaagagtggggcttgagtatacatacctcaaagtcctgtaaagttactactgactgggccaaagatttgccgctaaggtttctagcttcataaataggaaatctgaacagttacacagttcagtgcctatggcctagagggcagactctgtccttgtgccaggcttggccctaccaccctgcctggcacaggcaacagaaggggctcagcatggggcctcactatgttgcccaaaactggtcttgaactcctaggctgaagccctccttccacctcaggctcccaattacctgggactatgggtacatgccacagtgcccacttttttttggttcttaaatcagcaatacagattgcttttgagaggacccataaagaggacactgcttaacctaagtatactgcagggaacatggtgcttaaccacatccttagagttgtcacactgatgagtttgacagccttttttcttgctgcttgcctctatatgaactaatggcattacaccaaggtgtggtcagtaaaagtgggtctacaatgggtgttctctgtatcagcagaatttgtgataggccctaaaagtatccaacccaaagtagtcaggcatggtgacgtgtgcctgtagtcccagatactcaggaggctaaggcaggaggattgcttgatcctgggaagttgaggctgcagtgacccagactaaggcattccagcctaggtgacagaccttgtctcagaaaatatctaacccagataatatttacaatgaaatgaaattatttcctttccttctagaatgcaagagatttttattaacaaaacgttctatcacgtatctttcgaaacaaagacttgtaatttaaaaactaacctctcccttgatttattcttttccctctattccagggatgttagagatattcagatcattggcttcataatatataactcaggttcttggagtctatcaatatgagagtgggtgaatgcttatccagttggttccctggaactagaattggaaaactctgaggagcagacctggattctctcctgaaagacaatgtgcaagatttttgaatccttggtagctcacaagctaagcagcatttggacttcagaggatgaccagtcattctttccgggttgggaaatcagcatttgtctcctggctgctgagctcttagctttcatcttgtctgcct

SEQ ID NO: 11785 - DNA, 74096 bp, Human
aagagaagaacatgaatatctaaattaataaactgcaggatcaggtaataggtagccataattacctaaatattagcagcatgttatatgtgcctagagaacaaatgaataattcattaaggtggatggatggcatgggatgccatgctagaggagtacattaagagctgttaaagctaaattgtgtccccccaaaaatttctgtgttgaagtcctaacccccattacctcagaacatgaccatacttggagacagggtctttacagaagtaatgaagtgaaaacaaggtcatgagggtaggccctaatccaatatgatgtataagaatagacaattaggacacagacgcatacagagggaagagggaagacggcgtgaggacacaaaagcggggccatctgcaagccaaggagagaggcctcagaagaaaccaactctgccaacacctcgtgagaaaatacaatttttcttttctttttccttccttccttctttttttctttcttctctctctctctttctttctttatgagacagagtctcactctgtcacttggagtgcagtggcccgatcttggctcactacatcctctgcctcccgggctcaagcgatcctcccacctcagcgtccctaatagctgggaccaaaggcacacaccgcaaagcctggctaatttttgtattttttgtagagacaaggtgagcaaataaatttctgttaagccacccagtctctggtactttgttatggcagccctaacaaacaaatacaggagcagattatgagaatttactaaaccaaaccacagaaattaaattttatcctttcagctgccagaagcccacagaggtgtctaagcatcaacgtgacaaataagcagctttggttctgcaatataacctggaaatagtgaggacaccgacgtggagaatagagatgggagttgacagggatcaattgttctaatgcggaataatgcaagacataagatcaagccagcaggagtgagaaacagagatcatatcagggtgatatctgtggggcaaaagtaacaagaagataaggtgtaggcggtggagggtaaaccgcgaggcttccatgaagaagagtggcctgggaagtgaggaggacagcgaagccccaaacctcaccttgggatacgggaagtgaagcaggttccagagaaggggacaagataatgacttagggtaggataaatttcagacaattgcagagcatcacattagatgtgttcagaagagtggaaataaagttctgtgcctaggccctcatgcaggattctgttgctagaagtcagtgctggccgcagggagaccggagatcacagtggaggcaccagcgatccgagagtcctatgacgaatccctgggatccccacaatgtgtggagacagaagccaaccaaagagcgagaaagcatctccaaaccagcagaatcaggggcaggaggcccgccaaatgcacagcaagtcagccttggtagtttgcaaatggaaagatttctttgacccgctggagacttcagctcaggctggatgtcgctaattcacaccatcttaccaaaaggttctttccctgccctttggtgaatcgaggcagaagtggctggtggataactgggacccaagagttatctcagcgtcgggcaggcatcgacagctccaggagccctttccctgcaggcgggctggcgggtgagcgattccctcccttcccaggccttcccgggaatggaacgtgggcgcccgcgcccgggctccggttccacttggaacgcggactcgggagccgccgggcgagcgcgcagaccgcgggggcggctccctcgcacctccccgctcagcgcgccgcggcggatgggcgaggcggggcgaggccagagggaggcgggccaaaggggcgggcgagaggacgcgggaccgcggggaggtcgggggcggggagcaggcggcggcgggcgccgggaagaaaggaacatggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtaagagcgcgcgacccgcagcggcagatgcacgaaccagaacggccggcgccggccggggccatcgcccgctgcggcagctccccgggctccatctcgcatcccctctgcgttccgcctcccttggaagcgcattccccacctccgctagtgctgccctatttccggtacccagcgcggaattccactgctcttttgttggtgcacatttattggatacctccttcttcaggatatgtcaccatagtcttttttactgaaaattagtgaaagcctaattagagtgaaagagtacatctgggttttgtttttttttttcttgtagaggaaaaaatgaacattacttgtgtaactgatggtagttgcaactgcatatttgccaatgtcacaaaatctaaaggaaaatgttatagtcacccgtggtttccttcttgcctggacactccattgtcccgggctgaaaagggtagcagtacagtgcatataatgtcaagttgtgggaggagtgtggcagattgtcattggtgcatttttttggtgatgtgtgtggttgttttgaggagtgggagctgttaagaacaccacaaatagaataaaataatatcgtgaagttatttggccgtttctaattctagacatttttctaaaaacagttgcaaaggaaagattacattgttttaaaaaaatttgaagtatgtttttaaataactaaattaatgttctttgaaattccaccaaaatgatgaagtcaccagatagcagctgataaatgtgtctgagcccagtgcgcccagctctacaaaaggcagaagaggaattttcaaatttgccagtgcccagtaagaggacatgaattttctagtaccagaggaaattctctttttacaaattttgtcagaggtatccttgggaaagtatttcatttgcttttaccctccaaattattttaatctatatttttaagagtttccattctcagttgagtttttcttgttcttctccttctgtcagttttgaaagtcttgcacaaaaacaatccaggtgttgttacagcagtgtgattaaaaccaggtcaggcctacactgaaatcccagttccaccactcattagctgtacgaccttgagcaagttacttatcctctctgatacccaatttttggattttttttttttttaaagagatgatcataacgcttaggacttgactctttgggagaattaagtgagttaagacataaaatgtgcagcatgtatttgtcatgttattagcgcttcagaaatataaatgtaaacattttggtacttcgtttatggagattcttatactagttaattttattaaaagcatgatggggaacaaaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacacctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaactagaatagcatatcactgttttcctatggacaaaaacccagaaatgtaaaataaatagccatgaatgggttgagattccccctgccccctttggatactgatgacagaaatcttatatgcactatgtaagcagtgccctaggatcagaacagaaagtaacttgcaatttttaaaggtgggagaaatgactgaagtttggagtggtcaggagtttccctggaagtctcttgcctttgtgactttgtatagctccctcaaactacctgagcctgagctcctcatttataaaatggaagaattgaacctagcttccaaggtcctttctagcttcaccatgctctggtctgttgtttaatgacatgaatccaagatggacaacaaatggtcgattttgctccttctacagtaaatagatctatcttcttagcagaagtaaaatagtaaagaaagaagacatgtttgaggcctgttgaggcctgtttgctgtatgcattgtatctaatcaaggaattgagaatgtagccctaaatattaggaaggagttgaaagtttctgagcaggaacagaacatgctgaaaggaaattgtgtcagcagcatggtgtacaggagagcttggcagagagaaaggaggcaagaagacctgtgggaggcagccagtaaggaggtgaagagggcctggaccaaaggaagccaaggatgaccgaaagatttaaagatgaagcccagatttaaaagtatcctcaagtatttgtttattcttttcttagcaaattctttttagtacaaagataaaatatggcactctgagtcataaaattttctgaatttcagaagttgaatgtttttctgaatgtatcaacctgttaaagtcagttcctgtttgttattttaggcgtatattcttgggcttttttttttttttcctagagaaactatgaagtactagctgtgcaagtcagggtgggctaagctgctaaaacagatacctccctccccttcaataccctgaagaacaagaagttaattttttgctcgtgtaacattttagagagggtattccaggttgaatacctggaataatgaatgaaataataagtcgactcttatttctcctaaaataattggatcttgacattgaaattggtgtgctgattgtatttaataagtgacctccaatgcagttatttcattttgccatactttatgtaatttttattttttctgccttccctttcgatgtctaaagggaagcataattagttattggaaaggttattgagacttaaaaaaagatttgaacatggctttggttgatgctaccacacagaaactgcaaacatccaactcaccgctcttagttgctgttcatgatagtctatgcacagtgactgatgaatttagcctgtcttgaggcttcagaacttagtcttatgtcatcacgagcagagctttatcctaaattacaggttttcaatgggggggggggaggggcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttgagaaaccctgccctagactgttaaattcaaaaggaaataatggtttattgctcacagtgtgccaggcactgtgttaaactccttatattcatagttttgtttttatcctcacaacaacctgtgaagaaagaactctcatccgtcaccactttactgttgagggcactaagccttctaaaggttaaatgacttgcccagggccgcaactattagatgttgcagtcaggatttaattccaggcactttgtgttcaaagtgtttctcatccactgtgctatatgccagtagtgcccaaacctaactttagccagcaattgtctgcatctctttagtttatgaacatttatttattaggacatgcaggataaatcataccaacacagtccgtgtatccagaattctaattgatctagggagtgggagagcctgcctctctattttttttaaattggtgtgaaatatacataacataaaattggccattttaaccattttaagtatataattgagtgacattaagtagatttattatattatgtaaatggacttaacacgatttatttccagaacttttttatcatcccaaacagaaactctgtactcattaaacagtaactccctgtttccccactcccccttgccccagacgctagtaacctccattctacttcccctttctgtgagtctccctgttgtagctacctgatgtaagtgaaatcagaccatgtttgatcttttgtgtctggcttattcacttagcatagtattttcaaggtttatccatgcgtgcaaattcccttcttttttatgacgaaatactatttaattgtgtgtgtacatgtgcacacacaatgaaatactatttcatcataaaaaggaagtttgtacacatatatacacacacaccaaattttgtttatccattcatcagttcatgggcatttgcggtttttttccacctttcgactgttgtgactttccgtttatttttaatctgaactttactccatcacttcctccctttccttttttattcgcaccataattttgaacaagcagactttgtattttcattactctggggatttttttgagggaggcttgctaccctttggggttgtggtaaggttgtgccagtaacagaattcatgcagtaaaaaacattcatgggactttcttttgtgataggtactagggatgcagagatgaataatacaaggtctcgaccttcaaggagctcagggtttagtagggaaaacagaggtataagtaagtcattgcaatgccaggtcccagatatgggaggattccagcaaagagaggataaggccaggcacagccgctcatgcctatagtcccaacactttgggaagctgagatgggaggatcacttaagcccagcagttcaaggctaccctgggcaacatagtgagtggcaaaaaatacaaaaattagccaggcagggtggcacatgcctgtggtcccagttatttgggagtttgaggtgggagaatcacctgagcctgggagattgaggctgcagtgagctgtgatcacgccactgcactccagcctgggtgacacagtgagaggtgagagcctgtatctaaaaaaaaaaaaaagagaggatcagatttacctggagaggtcagagaaggtttccagagggagtaaaacttgagcttcattttgaagaatgaggggggaatacaaggagggaaaaataataggaacaagacctgttcctgttacagcaaacctgtaactcccaccatggaatgggcacgttttcctgtagacatttggagccagtgtgggcttcaagcctagggggctgatatgatcatttgtcaatctgaagatgactcttggaacaacgtagaggatagggtgaggtgggtaggctggtggctgacagactaggtcaggagagggctgaccaagaggaggaggggtgacgagggctggaactaaggcgtatgagctgggatggaaagaagctagatagaaaggaaacaaaaaccatcagaactgtggaaccaactccatgggagggataagaagagggcctattctagggtgaaacccaaatttctggcatggtaccattaacccaaacagaaagaggagatttccagagaaagaaaagcaaattttgcgggaggtgagtgtgagctgtctagagaatatgcaggtagaactacatgttaactgtaacatatacttgtctgcacctcaggagatggctgattaagaattcaggattcaggccaggcacggtggcacacgcctttaatcccagctgcttaagagactggggcgggaggattgcttgagcctgggaatccgagatcagcctgggcaacatagcaagacactgtctctaaaaaaaaaaaaaaaaaattcaagattctggagtcaatattacttaaggtagcaactgtctattctatagaaaatggacaaatatagataaaaagccacttccctttctaaaagtgtccctgcaattcaagtgaatactaggaaggattgtgttcattcttctaaacaagactcacatgtatcttagcacaaaaagaggattcttttatgatacaaatgcactgagaatttggtcaggctatcacaatgaactgatagttcagatggatttgagtctttataccactctggaatctggaccaactgggcctcctaaggccattttgcagatctgggcttgtttctgaagctacagacaggcctcttccaagcactctaagtgctccacaaataatatttctgtttcccagaacaaccccacaaaaaggtactcttactccatttttagatgaggaagtggaggctcatgatgtcaggtaagctttctcagctcccaagtggttaagccctcagtttaatgtcatttgactccagagccctatgttgcaccatgccttgataataggccatatgggtttcatgtatttcagatggggaaggttagtgtgaggtgaaagatacacaattaaccttttaaccatggaactgaaatatttacagatgaagtgatacaatagctggaattaattccaaaataattggggtggtactggtccatggcctgttaggaactgggccgcagagcaggaggtgagcagcaggctagtgagcattgctaccccctatcatatcagcagtggcatcagatgggtgaggatgtaaatgaactaggattggcattgagttgatattgttggatctaggtgatagatttatcattataatattctctctttgtgatatttctgatattttctaaaataaaaagttgtagttatttatttatttagacggagtttcactcttttgcccaggttggagtgcagtggtgtgatctcggctcactgtagcctccgcctcccgggttcaagcgattctcctgcctcagcctcccgagtagctgggactacagcctcccgagtagctcaccaccacacccagctaacttttgtatttttagtagagaggaggtttcaccatgttagataggctggtctcaaactcctgacctcaggtgatccacccacctcggcctcccagagtgctgggattacaggcgtgagccagtgtgcccagccaataaaaagtttttgaaaggatttagataaaatagttggggaaatggcatttttgttcaaagccaattatttatgtttggaatatcttttgtgcttggagttctccattacagagttccccagtgttcctattaataagtaacattgagcagaggaatgcactgtttagatcagcagtccccaacctttttggcaccagggaccggcttcatggaagacaatttttccacagacctggggtaggaagtgtttggggatgaaactgttccacctcagatcatcaggcattagtgagattctcataaggagcaggcaatctagattcttcacatgcgcagttcacaatagggttctcactcctgtgagaatctaatgccacccctgatctgacaggaggcggagctcgggcggtaatgctcacttgcctgcggctcacctcctgctgtggggcccggttcctaacaggccatggaccagtacccgtctgcagcctggggactggggaccctgctttagatgatgtactctggctttgcattctggcattagctaagcaccctcttaaaggaaattgggtctatactctcagtccgtgttctccctaacacctggaaacattgaataccttcaatgctgggaagttaactcccaccacaactagaacagctatgggaaagacaacagttgattttgaagagtgtcaccaatttgcacatgattccatccttaaccattcttatcctatcagctctgccaaacatggagaatagttggctgcaggacagctatttttcctacttgtagatgcaactatttctcacccaccaggatgtaaaaggtccctgtaccctaagattggtcctacatacacacccaatgggaaaatgagatgaaaaatttaaagcagtaaatatttgaggaagtagatagagtaatttagaaaaagaaaatacacagggccaagcacagtggctcacatctgtaatcccagcactttgagaggccaaggtgagaggattgcttgagctcaggagtttgaggccagcctaggcaatgtagtgagaccccacctctacaaaaaattaaaaacttagttgggcttggtagtatgtacctgtagtttaagaaacttgggaggctgagctgaggcaggaggattgtttgagcccgggtggtcaaggctgcagtgggccatgattgtgccagagtactccagcctgggtgatagagtgagactctgtctcaaacaaaaaaaaaaacagagacagaaaaaaagaaagaaaatatatggatgtatatcatataaaaatataaataagggaggccaagtgcagtggcatgcctgtaatcccagcactttgggaggctgaagcaggaggatcacttgaggccgagaattcgagaccagcctgggcaacgtattgagacctcatctctgcaaaaaatcaaaaaatgaggcggaaggatggcttgagcccaggagatcaagccttcagtgagctgtgatcgtaccactacactccaggctgggtaacagagagagaccctgcctcaagataaataaattcatacatacatacatacatacgtacatacatacatacataagaagacttgtttctttccatttgcaatgtttcattcaaaggctagaattaaattgccgtaggccatcacaagtttagcttgaatattattattttttcaagatggagtctcactctgtcacccaggctggagtgcagtggtgtgattttggctcactgcaacctctgtctcccgggttcaaccgattcttctgcctcagcctcccatgtagctgggattacaggcgcccgccaccacacctggctaagttttgtatttttagtagagacagggtttcaccatgttggccagactggtcttgaactcctgacctcaagtgatctacccgcctcaccctcccaaagtgctgggattataggcttgagccactgcacccagcctagcttgaagaaaatttgataggagtttgtttttttctatttataggccaagcaataccacgtataaatattaagaatcatggctgttccttagtgcctagttgtttataaaccatgggaaagaatgaaatcattgaccaaatgagacagggtaacagtcttccctgggagtaaagagactagcagtctctattgacatatattttaggcctggcctccaaaataaatttacccaaagaagtgatgtatttgtgtccagggctaccgagcctaatctttggctgcctctgtgttattctaagttgtaattttccatgtcatctaaatttgtaataattctttaatatgatagtgtttcagtgaacaaacattctgcttgctgcatttcttctgagtgagtaattccctgacaactaccagatcttggcagaagcaaagttggtcataagttatgctccactctcagtgctggtgaaacgtatgatgcgtaacacagtgtttttgaattcagtgctgattttcctaaaggacatttggaaggaaaaaagaaaaggaaaggaaatacccaaattcaggaatagaacttacatattattataagacttaaaaaatacatgaacactaatgatgaactcatttcttcgaagtaaaaggccttatgctattttttcccatttccctatgtggcttgattgtggcgaaagtggctgtgtgagtttccattattgaaggagttaaggtctgtggaatcaaagcatgagacaacatgcaaggaccaggttggtttccatttaacagccaacctaatctaactgaaaggattgagaggtttgtcttttttggaaagtgttaaggttcttccaagtaaccagcaatgtgactttaccacactgttcattaacggggctttggatggccaccatgtctgctgctggctgagtccaaaactgcggtcactctctccagcaagctcatggagggttacgtcatcttcactcagccagcccaacgctttttccatctgctaaaatgtagaacatggttgttgattctactctttctacaaagaaagagagggaacatggatgagttgctgcttttaaagattatatgttaattgctgttttaaaaatctgctcagctaagcacgcttagtgtaatcagtcaccatggagttttttaataggacagcttctgctcttacagagcagagtttttatgccagtaggttagaagcataacatgtttctatattgaagtgattctccaacaaggacttcttttcatcaggggtgacctaaaagttattacttgaaatataattacatcatgttcttaactgggtttagtagtaggataattacaaggttgtatccacctcaaataggaagaactgataagttttgcacaattatttaactcctctgttaggccttccttatttcctgttctctttttaaaatttgactaagatattgctaatgggcttgggagcctataaaatgatcagaattgttgccttatgttttgcatgtttggggtaacattggagccagatgtactcttaaataaaaggtaggcctacaaaaccagtttctcagttgcattcaaaatgtgattaaaaaaaaaaaaaggagaatctcccttataggtgaactttttaatttgtgctttattttcccttttgccattcatgagatttcttaaataaaatgatatcttttcttttcttcattattattttaaaggtctctggggaacaagactcatggaggaaagcagcactaaccgagagaaataccttaaaagtgttttacgggaactggtcacatacctcctttttctcatagtcttgtgcatctgtaagtagaatatttccttgcactaatgggaaagttttgaaaagatttgacctatccaaatcataattaaaaggaagtgtgtatgcaccagaggggcaactgggaagttaccttcttacctttgtttttaattctaatatttttatttgggcatttgtttattgactatcttcctatggtagaatgcaagctttataagagaagggacgtgatttgttctctgctgtacccccatttcccaaaactgcagatggcaacagaaggctctgaaaaatatataagaaagaatttttctaattgtgactaaattgtgaccaaatgctaagtgactgtggacttgcgtttaacacaggacgggagaggcaaagagttcaattccaatttagaatttggtcaagttctcttctgcactctggtaaacattaattaaaaatcagcattatctgaccagccagttcatcgtcagtggtggtgattttcactatgagatacgcgtggcaacttgccagacaccaagaaaccaagttagaggatttttgtattagattccttaacaatgaatacagtatcaccattattacagtatcatcattattgtcatactattattatatcagttaacataaagtctgcataagaattgtttccagaaaaatgactttccaaatttaactttcaggaaatacaaataatgctactaatattgcttttattggcgtatacatgtaatatccccttcttttggatttggatatgttgtgtcattgcctcattttaattcattatttcttctcaatctttaataattgctggacttttactccacaagaaacttgctataggcccatctctttcgtcttctttccttctttcagttcgtcttcccatcctctggtagggggaggggagggatgcctgagcgagagactagctgtaggaaccatttgtctcaaagtccagaaagccacaggtgatggatttgtcctctgaatcaaagggcgttcgatgatggatttctgtcatgtctcatctaaagtcttcacgagaacagatgaggaagcagttttatgaccccagagcctcctaccaaactcctctgagaaaaggtttccttttttttttttttttttaaattagagacagagtcttgatctgtttcacaggccggagtgcagtggcacaatcatagctcactgcagcctcgagctcctaggcttcagtgatcctcccacctcagtcacccacgtagctgggactacagctgcacaccaccatgcccagctaacttttaaaacatttttgtagaggtggggtctcactttgctgcctatactggtctccagctcctagcttcaagtgatcctcctgcctcggaagttctgggattataggcatgagccactgcacccagcctggatgtgatatttttatgttttaaattgttagagtttagaaacttgagattgagtttgctgcctgcattaaaatgatgcttaaacattaaactgcagtggccttaaatattaacaagttgattagaattactaagttcttttcaagctttacatatacagacaaatttcttatgcaaaatagaaggtaacccctgtacgtaagtctagaatttcagcagtccccaaaactgactgagcattagaatcactctgattttaaaatacatatgtggttttccgagatctactaacagagcctccataatgtagcctagagaaacgagttttcagatgtagtgataaatttggaaggtaagtcagagaagtaagctgaagacagagttttaggaaatatgcctaaagtcacataatgaattggttttcttgtttatttgagaatattgtcgctttttgttctttttcatgcaaatcacattttatttcttatgtgagtagctatatatttaaaaattttgtttttggaatattgtagaatctctacttaagaaagtatcttagcagtcatatggtctgacctcactgaatgctaaattctctttaaaacatccgtctcagatggttactcatactgcctctgattgaacaagagtcccaggttaagggacttacttctttgaaatcgttcatttcatttttctacagctatgttagaaagttcgtccttagcagtgaagccagagtctatctcttataacttctacccagttgcaccctccaagcctacctataccaagtatcttttttccacgttgcttttccaattcagctcttcgcaagtttggagacaaatacctaatctcctctaagccttctccaggttaagcctttccagttcatccagctgttgattatgtgattggagacacaagtttgagtaactcccatgatggaaagtccctctggtgaatgttctgttcatcagagtccctaagaaagcacatgagcctcaccatggtgagtggggccatgagattcctaaaccagacactacactgtggcttgtgcaacctaccatggccagactcatgaggctgtttcatcatataaataattccttagtctcttcaccaaaaactgtgaagcactgtgtcccccagctgtatgtgagctagcctgggaccatagtggaggactcctctttcaaccctgttaaatttcatcttgttaggatctgcccatttttccattctgttgaaattatcttggaactggattcattcatctcacatcagctactccccgaagcctcacagtatcagcagagttattatctctatccatatccttgtaaattattaaactaaaaaagattggtctaagaacatcagtccattaatcaaggctctttggttggagttcacttcattatattatcatccagctcagagtgttcataaacaagatgataggaaagacttttccaaatgcctgtctgagtaattcccccattcctgtgatctgtgagctgttgaccagattaaaaaggaagtgagaataaccaggcaagatttactcctagcaaaaccttactggcttctagtgactgagtcctttccctattgcttaccagctatctttttaattactagttttaaaatcttgccagcaatgtcaatatcaaatgaccaagaatatcaaactcattactctgtatgtaaatgagatagtgtacttacccctatggcttatgtattaggctgttcttgcattgccctaaatacctgagactgggtaatttataaaaaaagaggtttggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatggtggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctggggaggcctcaggaagctgttactcatggcagaaggtgaagcaggagcttgcacatcatgtggcaaaagcaggagcaagagagagagaatggggcagggaagaagccccacacttttaaatgaccagatcgcatgagaaatcactcgttacctcaaggacagtaccaagaggatggtactaaattcctgagaaatccacccccatgatctgatcacctcgtaccaggccccgccttcagcattggggattatgtttcaacatgagatttggatggggacaacatccaaactatatcaccttgcatagtaggtagggttttaaaaagcagtttggcacagtaagaaaagtacagattttttttgcatcagacagacctgagttaaaatcccagcttcactgctaacatgctaggtaaatgtgggcaagttaattaacatttctaagcctttgtttcctcactggtaaaacaagtatttggaaatatcattgtgaagattagaaataatacatgaaaagatcctaggatgctgtctgtcatacagtagtagtagtaagaagttattcttgccaaagattgttgagaatggcagaattatctcagttctaagagctatagtttctaattatttgagcctagactcagattcatttggagcagctaactgctcaccaagagcttattttccatcttaccaatgaggttatgtgccctgtgtttttaaaatcagtctacttaaccaagagaacagaaatgacatgagaattaagtaatctcactttctctgttatttaggatttattcctactcaaaacctgagagttgctatgaattcaccattaaagcacttattaatatacatgggttactgttataaatagcaatagtattgctattgtgtgagttaggtgttgaagttcaagaaaggaataaagaatatttagaagatctttgaaaacagtgtctgggtacggtggctcatgcctgtaatctcagcactttgggaggccgaggcaggcagatcacttgaggtcacgagttcaagaccagcctgggcaacttggcgagacctcgtctctacaagatatacaaaaattagccgggtatgttggcatgcacctgtaatcccagctacttaggaggctgaagcacaagaatcacttgaacctgggaagcagaggttgcagtgagccaagattgtaccactgcactccagcctgggcaatagagcaacactctgtctcgaaaaaaaaaaaaaaaaaaaaaaaaagaaagaaagaaggaaggaaggaaagaaaaaaaaaggaaaaaatgcaaggaaggtatttggtgaatctataataataaaaatgtatttgtcatttcctttttctgtgctctcattctataaaattgagtaaaaaatctatatatagtttaaacacattaatagaaatcacaaaagttagctgagtcaacattgtagaaacataatatttctgtatgtcaaagaaatagacaacattaaaaagcagaaagcaattacaaagaatgattataagaaacatcacaaagggttaatattttaacacatttgaaactcaaaaatcactgagaaaagcagtagacttccataaatattttatagagtagaaaaaataggccaagcacagtggctcatgcctgtaattccagcactttgggaggccgaggagggtggatcacgaggtcaggagttcaagaccagcccggccaagatggtgaaaccccatctctactaaaaatacaaaaactagccaggcgtggtggcaggtgcctgtaatcccagctacttgggaggctgaggcagggaattgcttaaacccttaaacccgggaggtggaggttgcagtgagccaagttcgcaccactgcattccagcctgggcgacagaacgagactctgtctcagaaaaagaaaagaaaagaatagaaaaagaatccatgggcaggcacagtggctcatgcttataatcccagtactctaggaagccaaggtgagaggatcaattgaggccaggagttcaaggccagcctgggcaacatagcaagactttgtctctattaaaaattttaaaattagccaggcatggtgacgcacacctgtagtcccaattacttgggagcctgaggcaggagaactgcttgaggctgcagtgagctatgattagaccactgcactccagcctgagctacacagtgagaccttgtgtcaaaaaagtaaaaaaataaaaattagccaggcatggtggcacatgcctgtagtcccagctactcaggaggctgaggcaagaggatgacttgagtctggaagatggagactgcagtgagctgtggtcatgccactgcactccagcctgggtgacagagcaagaccctgtctcaaaaaaaaaaaaaagaaaagaaaagaaaaataaataaaatttattcaaatacaaaagtgatgtggtttgactctgtgttgccacccagatctcatctccaattgtaatccccgtgtattgacggaggttcctggtaggagatgattggatcatggggatggtttcccctctgctgttctcatgatagtgagtgagttctcatgaaatctggttgtttggtaggtgtctgtcacttaccccttctttttctctctcctgctgccttgtgaagaaggtacttccttctcctttgccttccaccatgattataagtttcctgaggccttcccagccatttggaactgtaagtcaattaaacctctttcctttataaattaccgagtctcaggcagttttttatagaagtgtgaaaatggtctaatacagagacttggtaccaggagtggggtactgctataaaaaataacctgaagatatggaagcgactctggaactgggtaacaggcagcaattggaacagtttggagggctcagaagaagacaggaagatgtgggaaagtttggaatttcctagagacttgttgaatggctttgaccaatacactgatagtgatatggacaatgaagtccaggctgagatggtctcaggtggagatgaggaacttattgggaactggagtaaacgtcactcttacatgttttagcgaagagactggcagcatttttcccctgccctagagatctgtggaactttgaacttgagagacatgatttagagtatctggcagaagatatttctaagcaccaaagcattcgagaggtgacctggcttttcctgaaagcatacagttatatgtgctcacaaagagatggtttgaaattggaacttatgtttaaaggggaagcagagtgcaacaaaagtttagggagtttgcagcctgaccatgtggtagaaaagaaaaacccattttctggggagaaattcaagctggctggagaaatttgcataagtaacgaggagctgaatgtgagttgccaagacaatggggtaaatgtctccagggcgtttcagaaaatcttcagggcagaccctcacaacacaagcctggaggcctagaagggaaaaatggtgtgagccaggcccaggcccaggccccagctgttctgtgcagccttgggacatggcaccctgtgttccagccactccagctccagctgtggttaaaaggagccaaggtacagctggaccattgcttcagagggtacaaatcccaagcattagcagcttccatgtggtgttgggtctttgggtgcacagaagacaaaagttgagctttggaagccgctgcctagatttcagaggatgtatggaaacacctcgatgtccaggcagaagtctgctgcaggggcagagccttatggagaacctctgctagggcaatgcaggggggaaatgtggggttggagctcccacacagagtccccactggggcactgcctcatggagctgtgagaaaaggaccaccatcctccagactccagaatggtagatccaccaacagattgcactctgcgcttagaaaagctgcaggcactcaatgccagcctgtgaaagcagctgcaggggctgtaccctgcagagccacagaggtggagctgtccaaggccatgggagcccaccccttgcattagcatggagacaggggatcaaaggagattttggagatctaagatttaatgaatgccctgtcgagtttcagacttgaatggggcctgtgacccctttgttttggccaatttctcctatttggaatgggaacatatacccaatgcctgtacccccattgtatcttggaagtaactaacttgcttttgattttacagactcaggcagaagggacttgccttgtctcagatgagactttggacttgaacttttgagttaatgttggaacgaattaagacattggggttctgttgggaaggcgtatttggttttgaaatgtgagaaggacatgagattttggaggggccaggggtagaatgatatggtttgactctgtgtctccacccaaatctcatctccaattgtaatccccatgtgtcaagggagggacctgatgggaggtgactgaatcataggggcagtttcccccatgctgtttgcatgatagtgagggagttctcatgagatctggttttttggtaagtgtctggggcttcccccttttccctctctctcctactgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtgtaactttaaactcagtagtatccaaagaagtaatgaaaatggagaaacgaacaacaaaatcatagtacaatatggtgtatgtactaggacaggaagagcccttttaagaagagatctatgtatttccatttgtttatctctgaaagaaagcaactttgccttgtattctgaaaaagaaaggaatattttattttacttgtaaaaatcttacaaggatgctagtctaaatatagttttcctaatttgccagagaatccatgaagatcgagttgataacaagatcagtgaagtaaaggtcagtgagttaatctcacagcagctgcaggctaattccatttccagtgaaaaacgtcttgattgctcaccacatatcttttcaccacaaacagtttcagtcttaagatcacatgttgcaatccatgagaagtaactattaagccttcaactatgactggagggctcctcgccctttctgataaattgactggacaaaaactcaattttaaaatgacaagaaatagaagatgtataaatgtactttaaatgtgaccaaaatgggttgtgaaaacacaagacacaatatccaaaaatgctggcaacacagtacactgtagagtattggttgtttatttacccttgctattgtgtggctgagcttactgccactgcccagcattgcaagggcatcaaactgcctatcactagcctaggaaaagatcaaaattcaaaattctaagtacagtttctactgaatgcttatcacttttgcaccattttaaagtaaaaaaatcagtaagttgaaccatcatatatccaagattgtctgtatataaatattatacatctttctctcacttttaaaacaaaataatactagccaatactaccattctcaaaagcacttgtgtcaacagcctttaccccttaaagattttcctcacaattttaaaattgttacttactattttctttgaaatgttgaccaaacctggattaaaagatttgggggttttagtgactgtatttcacaaactctcttattgattctgcagcctcacttctgcctcctaaaaagccctcaccaaggtcacgggggatggctcttttcagcctcttcctggcatttggtccagtggcatttggcattctaggacttccctctttgtctttgataactccctctcttcctgtgttcctccttgctgtgttcacttgcttcgctttcttctttctgaagcatgtttacacagtgttttctctgattgggcctgtgacgttctttaggtcatcttttccacaaataatgcttcaactagtacttgcgtgccagtgactccacgtcccactcatgagctctgaacctagtaccagcttctgctggacatctacaatgggatctctcacaggcctctctcattggtaacatgccccagcctgaactcatctcccacccatctatccagccatgctctctagttcacctgaacacttgggtgtcatcctagatgctttcccttcccagtcttctgtgatcattctgcctcatcagaggctctctaatctgtcttctttcctatatcgctcttgtccctattttaatcctaatcatctatttcctgacttattcattccttaagttggtcagtaatttaattaaaaacagatttaggccctgaccttaaatgtgataagtgatatgaaaggagatgactggggaaaaggatttccctcaaggaaggcctctgtgaagcctgaagcaagaatgaaaacgagtcagacgaagagagaattgtatgaatgaaggctctgaggcaggaaaacactcagatcattccagaatcacttagaagccaagtgaagccagttcctggagagcagatcatcaaatgaagatggaaaggtgaccaggggccagacctgtagttttggtgggccttggtgagggatttacagtaggacaccccatggtttaagtatgaaagtgacaagattcctttaagttttaagaggcctcgaaatatgaaccacagattagatggaagctactctccctgtgtctggactttttagaatttccaagagctgctgtttctggaaccagattaatacaagtcagtcttccatttatttatttatgtatttatttgagacagggtctcactctgtcacccaggctggggtgcagtggcatgaacacagctcactgcagcttgggggctcaagagatcctcctgcctcagcctcccatgtagttgggaccacaggcacctaccacccagctaattttatttgttgtagaaatgaggtctcattttgctgcccaggctgttcttgaactcttgggctcaagcgatcctcctgcaacatcttcccaaagtgctgggatcactcttccatttaacatgctatctcaacgtcaagataaactttaaaatctttagataataggctggcattttacttaaacgatctttacttcttcagaactgccattccctataaatatctggttcttcaaccacatcaaaccacttgtgatctcaaaaagcctcagcgtacactgtcctttctgtcattctaattcctcctcatccttcaaaatcaactcaaggaccagatccagggagaagcttagtggtgcccacccgaaccggccccctccttcgagttgtgctgccattcgggcccacctcttcacacagggttgtcagaccagaccagctcatgcgttcaccgcccttgcagggatgggatgcagctgtgcacctctcagtgccgacacctggagagtctcacgaaatgttgacaacatggcctgtttccatttcttgttcactaggacttctcatttactaacacacagaatttcctgtagtatgtccacttaatcagttcaagcccaataattccttgatttgggtatagtgctttgcatttatatactgatggtccccaacttatgatggttcgatttatgatttttcaacttcatggtgatgtgaaagtgatacacattctatagaaaccacactttcaattttgaattttggtctttttccaggctaccatactctaaagatagagccacagatcccagtcagccatgtgattatgagggtaagcgaccaatactctacagtgtattgtattgccagatggttttgcccaactagcctaatgtaagtattctaaacatgtttaaggtaggccaggctaagctgtgttgctcattcagtaggttaggtatattaaatgcattttcaacttatgatattttcaatttacaatgagtttatcaggatgtaactctactataagtcaaggatcatcttgtatagcacttttaatttatagagtcccttcaaatgtttgtttgtattttatttccactgcatccctgtgaggataccataagttatacagctaacaaaacagttagttttcctgtgcaaagtgatggcttcatcttgtggcagattacctggaatactgtggccaaggcatcttagttctactgtctttatatatctagtacagttatatttttatggcagctctgatttcttctttggcccaagggttattaagagagggaaaaaatttaatttcttaacagatatatatatctatgtcaagtcatatatttaattcaaacccttaatattcctaggtaatttttgtctactttctctgtcaaagattgaaaggtacagggttttaagtttccaactgtaattgtagttttggtaattgttttattactaacaggtattgctctgtatattttgatgttctgttattcaatacataagaattcattacagttgaatcatcatgtatagtataatttaccaatgtaaaataacctttttatcaaactgagtattcaccttataatgtcctctgtcagaggattataataccacttaaaaccttttaaaaaatattttgttcctgataattttagctttgagtggttttcttataacaattctagagatgcgtttttattttttaaccaagatttaaagctttgtgatttagtaagagtctaaaccattcacagttcatgcttttttgtcaaatttctattatttagtattttcctctcttttatattttcctgttattttccatttctattcttttgttagactggaaattttttctttgctttcttttatcctagtgatttgaaatttatgtaatatatactattctacaataccctttatttgttttcaatatttgaacctatatttttcaacattattaagaataaaatagtatttgttgctattttgaaatgatagaccatgtttttaaggcaggttggtggttgttaaggcaccagtatcggccaggcacgatggctcacacctgtaatctcagcactttcggaggccgaggtgggcagatcgtttgagcccagcactttggccgatactgtggtttactgtattttgttctagtttattttatggaaaatgggaattcagtggttaagacaaggattaaatagcagaagaaagatgtgtacatatgtacagatgtatgtgtcctttatatgttttttagtactcttgtctcctttctggtcctcatttaaggttatctatttcatgcagtaaatttttcttcacaattcatttcatttagagagtgaatgctaccttccaagtgggctttctccagttttcctttcagggacttaaaggagaagtgatgttaacagttttatatttccattgcattttacagtgtgcagatgtcttcacatatatttccccatttgagctttacaaaagcccttagtattattctcattgtctagattccaaaatcaggcttagaggagttaaatagttgtccaggatctcaagatgcaagacccacaatcatgaacagaggcagatgttcaggatggaggcaagctgaaactcaaaaccaaatcattatgactccaaattcaggagtcttttagctgccacctgcatgggctcttggtgtagctgaccaccagagtttgtagagctgtcattcaggtgtgccatggactttcctgggacctcgcacaggagaaggactgagttaatgtttgctgattaaatatctgttacaggctgggcgcggtggctcacgaccgtaatcccagcactttgggaggccgagcagggaggatcacttgagctcacaagtttgagaccagcctgggcagcatggcgaaaccccgtctctacaaaaaatttgaaaattagctggccatggtgatgcatgcctgtagtcccaggtactcaggaagctgaggtgggaggatcacatgagcccatgagattgaagctgcagtgagctgagatggtgccactgcactccagccttggccatagagccagactttatctcaaaaaaaaaaaaaaaaagttacaataatcttcccttcaaagctggaaggcattatttacctgtctgtccagcagatggtgctacataaccaagggaatctgttgcttgcccttggtgaagctattaaagccaatacagatcttgagaatttcaaaagcaaaaatcaatactggattatgagtgctctaggaaaataaagagataaattttcaatttacatacttatatatagttataccatatttgtaaataaaaatatataaataatttatcaaaattcctttttaacagcaacaaccacagtaaacccacaggttaaaaactccacaacagtctatattaatcagtcaatgcaaagtacattccaattccaagttaactgaaaataatcaacttaatcatttggttggctctgagcagccttcactgcttgctcttgtgtcatgtttctttctgtcctcgattggctatagacttacagacggcttttgcagaggacagtgtactcatgtccatcctttgcatcctttgtgggagttggctaggcagcactctccctggggacactatgaactcctcttcttgagtgcagagatcacgtcttgttcatcttcatgcccaataccttgttccataaatatgaatggattagaattctaaactcttaactctgccccaagacagttctgagaggtagtaagtcatataacacctgaagaggactgttcttgtcctaattacattaggttataagatgacaggtgagggagccaaaccagggggcctggaaattattcatacatctctagatacagtatacaagttgtgtgtattatgtgtatttactctgtaattgattgcttgagatgaacccccaaacacactcgtgtttggatcattattatctacccttctccttaaataatcttaatttcctatgatgcttgaaagggaaagaggggccaggtgtggtggttcacacctgtaatcccagcactttgggaggctgaggtgggagcatcacctgaggtctggagttcaagaccaacctgaccaacatggtgaaaccctgtctctactaaaaataaaaaatcagctgggcatggtagcacatgcctgtaatcccagctacttgggaggctgaagtgggagaatcgcttgaacctgggagggggaggttgcagtgagccgagatcactccattgcactccagactgggcaacaacagtgaaactccgtctcaaaaaaaaaaaaaaaaaaaaggcagagtggggaagagagctgcatgaaggagagatttactaaatagtacttaatcccaaaataatttctataggtttgaatatgatccctgaaatttattataggttcaggtaagtattaatcacgggtattcagaactgtggtttaaaaaatgtatagaacatgtttccttccccttgaaactttttatcagctaattataggaattatattatacctgcaatcattaaagtccagaatgagacagtacttggtaaagtgctgaaatttataataaatgcattatagcaatccagttaaggaggaagagccaccattattgaacatttgttaagtgtcagccattgtactagataaattttagttattatttttatttaggcaccaaaaaatccatgggatagttggttatccccatcttactgaagaggaaactgaagctcagaaagtttaagcaacttgcacaggtcacatagcaagtaaggagcatggccaggaatcagaccctgatctcctttggtctactaagcttgcaaaggatcttcccgcctccttccaagaccattcaatattatcagtaaatgtccatggcaaggatgtagttcgagttatagggttccattcaagatatgattggtaggtgggaagcagatatgtctgtgtcaatcagtatcctggaagaaggagatgatgaactcaagtggtgattaagggaagtttaatgaagggactatttacagagatgtggtggggttaagagaaccaacaaggggaagtgatgcactcaaaaagttactacctccaggctttaggggattgggggagggagtggcacagtgtgaacccagtgtggttgtgagaaaagggattccctcagcagccatggccaaggttagagtctccactgccaaactgcatccaggtggtgagggaatggagaataggggtggggtaacaaactctgacctcggtatccccaaagggcaaaggattccaggtggtacagttcgtaaagattagcctcagggcacagaacagggcagagaagaatggagaattgatctggaggaaacaaacaatggcttgcccatgttattgcagggagagtaggctggtgtgcacagcaggagggtggggagcccagcatatagctgtgttggggcctgtgcagatcagcctcactggcagggaggatctgagccgagaggtggtggaagatgaaatcgagtaggcatgttggtagtcctaaatatcaagtaaacgttcctgatcttacattgatactcaatagtaagccaattttgtttcccataagccaatattaatattacgtatttcttttataagccagagatatagagagataccctagaagaatgataggggaaaggaaggcaagggtgagagaagaccttgtgtgaatttgtccaaaatgtttatccacaggaacaatccctttgtgaaggctgctggtatgtgaatgtgtgccggttcccttggggcgttcatttggatctttctgtgttccagtgacctacggcatgatgagctccaatgtgtactactacacccggatgatgtcacagctcttcctagacacccccgtgtccaaaacggagaaaactaactttaaaactctgtcttccatggaagacttctggaaggtatttgcaaataactttgaaagtacctctctatcacagaaaattgttcatttggcttcatcatttcaatgcatgagtatcgacaggacctgctttgcatttaacactgtgtgagacgtaagttatggtgagttgttagaagttactgttcctactctcaaagggggtaaactaacattgagaactttgcctgtgccttgcactgtgctgagtgtttcatatcttaccttatttaatttctatagtctaactctataaggtaagtactaagactatgccctagtttgttaatgaggaaaatgagattcaggatgtttaaatgcgtatggtcacatggctagggaacaagaaaaattgatttttttctagcctgacagctacttcatcctagtttgtaattcattccatgagtcaagattcaataaatatttattgagaatctcctagaatgtaaggccaatgaagggcagtgtggttcttctgtcttgcttcgccttttgtgttttgtctctttgttgatgatggcatgtatccccagctcttagaacagtgcttgattcaaagtaagcacattctttcaaaggtctgctgttggtggggcttggtggctcacgcctgtaatcccagcactttgggaggccaaggcaggaggattgctttagcccaggattttgaaaccagctgggcacaacatagtatgactttgtctctccaaaaaagttaaagaattagcagggtgtggtggtacacacctgcagtcccagctactcaggaggctgaggtgggagaatcacttgagcgattgcttgaggtcaaggctgcagtgagccatggccatgctactgcattccagctggggcaacagagtgagaccctttctcaaaaaaaatcccccccaaaaaaaaacccaaaaacaaacaaaaaaggtctgctgttgtgaagttcaacccaatccagccccttcccaagttgtcacaaattccaacgtagttaacagtataccaatgagtgataccacaggaaaaatattaaactgatctgagggatatggggcttggaatctaagaaaattggaagggaaattgaaaaggaaattattatttctccttggggagatagtttctaaaattcttactacaccctggggtcagagctgttgattttaaggatagagacaactgagtcacaggaaactattcatatataaaagtacctggcatccaaaaccacacttgtataatatgaatctttcaccatctgagtagggcaaatcagtctatctctgttgatcatctgacaaggatagcacactgagaaatagatctgtcttccctacaggcatagctagttgtacaaactaacaagagacttttgtatacacattccatgatgataaatgccaatcactaaagggacgaggagggattggagagttcaccatacagcaaaatagtccagacaggtgaaaggtctatcaaatgccaggctggtaatcaaaactgtagccttttctctaaacaaagtttagaaccatgattgtgtgggacattattttaataagggaaagtgcagttaatcatgaccccacctttagtccaagaacaaaaatcagagctgccacgtattaagtacccactctgtgccaggtgcagtaactatgcaaaagatgggttttccagatgcaagaaccttggttcagaggaccctgctcaaggcctcatagctaacaaatgatggggcaagatgctatcccaaatctctctgacaacaaaactcattcttatcactctactattttcatagagttgccaaatgcttggttatgcaaacgatgcaggcaggggcaagacagcggctgagcttggaactttttcaaagatgtttcctttgcttttagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcgtaagtgtctgtgactcattgccactcggtgatattcattcatttattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcgtttgaaaatttcatttaagatgccctgggccctgtttttacaggtccagtaacatcatccactaagttatttaacacaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaagggaggtcacttactattttagaagtattgtagttattataaagaaacaagaagacctccaaggccgtttcagggtgggcctttgcggttgctgtccctgggtacgtcactggtcggagtcatcttctaagctttgctcagctaattctgtcggttcatctaggttcttttcttggaaactgagttgcccagaatccacatttgttactatacaatgggcaatcaccttttcaattagtatattcttcttgtaccttccagtatacactctatttaataccagaacccataagaaacaaatttagtaaaaatccaggttgggcacagtttctcatgcctgtaatcccagcactttggaaagccaaggcggacagatcacttgaggtcaggagttcaagaccagcctagccaacatggtgaaaccctgactctactaaaaatacaaaaattagctgggtgtggtgacatgtgcctatagtcacagctattcgggaggctgaggcaggagaattgcttgagcccgagtggtgggggttgcagtgagctgaggtctcatcattgcactccagcctgggcaacagagcaagactccacctcaaaaaaaaaaaaaaacaaatttagtgaaaatccagagctttagaacaaaggaactaaatagtctcaaaggacattatcatccaagttatgatagtgatttcgctttctttaaaaaaaaaattattacagatagagtttcttgatgttgcccaggctggcctcaaactcctgggctcaagcagtcctccagcctcagcctcccaagtagctgggactatgagaatatgccaccatgcccagctttattttgctttctaatgtgcctttttgtagttcctgcaaagcataagcatgccttcatctgtggtaccctttccaatattttatttatctcacatcactaataagataaatttatacagccactgctctgtgccagacattatttaagaagttatttcacgcattatctcatctgccttcacaaaacaactctaaaataggtatcacctccattttatagatgaaaaaactgaggctcacttgcccaaagtgtcacagctaacaaattggactgaaccaagatttaagcagcctgactccaaaacccatgtttcgcctactaaacctcttccatattaattcctcctccatattaattgcgtcgttagggtggcttgtcgacgctctcagctccccatcagtactcaagcttcctgagggcagggattctattttgttaactgctgtattctcaaagccttgaacaatgcctcatatgtaaagatactaataaatatgtgctggatgcattcgagtgatttctactccagggtggattgccaaaggggaccttccctgtcatatctaaactatccttttattcttctacattctcaagtcactcccatttcttcttcccttcaactccaaacttcttggaagaatagtcttcatttgccacttccatttccttaccatcaattcacgtcttaaagcttaggttcttgcttttgacatctcaccaggaagctactagggacctctagttagcaaatccactgaacaaatctcagtttttatccccttcatactgtctgcagaaagtggcagtgttgaccgctcattcttttgacttccatgaagaactctacactttgggttcttttaactctgaaacccctttctctcacttctcttattcccaggttctatattcatatctccgtcttttctttcttttctctctttcccatgacattcagatggcttccactgacatctttatttggtgactcatcatttcttcaacaatgtgccaggcatgttcccattgctagaagtcccccctcttctagtagtgcccttgatgctggagaaacaaagcagcaggaaacagaagaaacgtcctttcttcacagagcttgcattctagtgatacaagacacatctctattccacctggatgtcccacacctcttgtgatttaatatgccccaaactaaactcatcgttttcttatgagatctgctctttgttctgttaatggcactgccgtcttcctattgccctgaaagagactccagagtcatttttgagccatgtttcctccttgccccaacttccaaatcagttaccaagttctgctggcagtcactgtggttacgacactctctcactccttcctttcccttcccatcttcactgagtgacttcaggcctcattacctcttggttattgcagactttgctaagggagctgtgtcaggggtccctaagaccacccccaggttcagtgattcactagaaggactcagcatagaggcatccttacagctaaggtttattatggtgaaaggatacaaaagaaaaggcacatggcaatatctggggaaaacctggtgtaggcttccaggagccctctcccagtgaggtcacataggatgtgctgaatttctccaggaacgagttgtagcaacatgtgtgaaatgtctatcagagagattaattagagactcagtgcctggggtgttcactgggtactggtactggtttatgactagcatgtgccaaaattcccgactctcagaaggaaagcaggtgttgagtgtaagccacattgcttatacaaatagcacaggcacagcaagcctctcttaccggtcagggaaagttgaatactggtgcagggagctgtttatcagtcaagttcccagatgccagccaaagtccaaccttgcaaacaggccttcctaaagaaaggccatctcaggcctgctgtgttaactcttttctgcacatgagccctctgttcctccccactccagtcttccctgctgccaccagaccagccctgttgtgtgcctcttagaactttcccttcacagactccttcatgtttgcccttcacaagctgaccacagaccacctttcaatctgccattctttatcttatgggagccaaactgaactacttcttctcttgaccaatggctcacggttgaaaatgcccttcccatttgtattagtctggtctcatgctgctgataaagacatacctgagactgggcaatttaccaaagaaagaggtttaatggacttacagttccacatggctggggaggcctcacaatcatggtggaaggcgaggagcaagtcacgtcttacgtggatggcagcaggcaaagagagagagcttgtgcagggaaaatcccacttataaaaccatcagatctcgtgagacttactcactatcatgagaccagcatgggaaagacctgcccccatgattcaattacctcctaccgggtttctccaacaaaacatgggaattgtgggagttacagttcaagatgagtttggttggggacacagccaacccatatgaccattcacctgtgcaagtccagatcctactcacctttcatggttcaggtccaacacagcttcttcctaaagccttttctaatccatccctccactgccagatccccaaataaggacagctttcctctgatctgccagccttatttcttttctcttttgcttcttattattatccaccttgtattttacttgtttaattataactcttatttccctacttgttataaatttgggagggaaaggacctttatatccccattagtgctgaagaagcatctgttttctaagagatcctctgaatatttgtggatgaaattcccaaatgctgacaatgccacttgatgaacttgtccctcttttggctgtaattttctctggggacctcaagtcgtctagtccctgagcacagttacccagagaaggcagccgtataaactgagcagaggctctagagcagagcagaggctctagggacaaacagccctggcattggttcccgagtctgccctcaaaagctttgggactacattgacctcactaagcctcagggccctcattcctaaagaggctaataacagtatgagaattaaccaagaaaacatgaactgccaggtcaggcacagtacccagcttgataggccttaatacatactttattttacaaggaaccagctgtccttgtaattgcctcaagtgttccactgattgtaactgtttgttttttggttttgtttttaatcagttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggtgtgtactgaggacatgcatccctcctatttctgtgtggttgtacatacatcctattctggggttagccagaaaaacctttgcctgcagttagctacatgaggatgccaaggacccagacggatagcaagggaggggtaaaaactgaaggcttaccgaaataaaggatatttgaggaagggagttgggatcctagaatattacgagttggaaagaaccataactctggtccaagttcatctcaatgctggaacctttccagaaaaagtattgtgtttttctaacatctgtctttacccattataaggatggttagtgccacatgttccatcaccaagtcccccggccatcaaatcttgactcatttcctggagtttctcactctcagatgagcctctgctattagcacacaagcacagtaaccggagtgcttgtaggatgctcagtaggatacccaggttacctgctcgtgctcagggctaccaaaggcacgtaaagttccttccacagatcctgggatgttgccatgatgacccctctgtgagatagtaacaaaaatgacaaagattccactggcttgtctgggactcttcttcattcatttattcagcaaacattcattggacacttaatatgggctaggcattgttctcggctcttgggacatgtcagcaaacaaaataaagatccgcaccttggcagagcttgcatccaaccaggaggagactagagaataaacattaaacaatacaaataaatagtatagtatattagaaggtaataggtactattaaaaagaaagaaaaagcagagcaagaggaagtcagagttcacccactttaatcttcctggtgagcatgtcagcaacacccaaacatcactaacatggattattgcatgtatatttacacataagataagaagtgtttattctcataatagtctttgtcatcattcttgaggttaagttcaattctgctttatgtggcttgttggattgtcccagtccttgtatttaacaacatttgcagaaaatagtaccacattaaatcaattatagattatcccttatccaaaatgcttaagaccagaatgtttgagatttaagaaatttttcaggttttggaatgtctgcatatatataatgagatatcttggggatgggacccaagtctaaacacaaaattcatttatgtttcataaatgaaacttaatgcacatagcctgaaggaaattttatttttcccttagggatgttgaatcaactgttgtgtgccagcatgttgacaatgacctgtcacatgaagtcgggtgtggaattttccacttgtgcgttcatggcggtgctcagaaagtttgggattttgaagcattttatatttcagattttcacattagaaatactcaagctgtccttgctcacagtggccaaaaaaaaagaaagaaagaaaagaaatactcaaccagtagtccagtagtagttatcactagaaatgaatgaaaatctattgcagtattattgagtttttcctaattattccagtgcagataaaaagaaaagaataaaaaggaagagaataaaaacagagaggcaactctgatattttagtaaattctatttatagaaggtcttgagtatttcttctgcttcctcccttactttaaggatgaacattgttaagacaactgcttcatttctctatactgtttttctaagtttctggaagtggttgactactgcagggccagaatgggccagagaaatgacttgacacttgaaggccacttccttcccttttgagttcccaatgaagctgtcacatacaaggctcttggcttcagagttgctctcctgagtttttgattctcacccctactctctaacacatcaaataggaaagaaagaacaggagaactgacaatgaaaaggaaggaaaattttcacacttctctgaccagttctaatttaccatagtcctgtttttacttgattattgctcatgcatgtgtcctgtatgctcaggttccaggtgcggctacctgtcctgtaatggcagagatagtgatggctagtagctgactaaagggcttttaaatgtctcaaaatgaagcagctagagattctatttctagttagaaaagaagtctgtatcattaactgaatcacccagctttctcagtgtgacacctacaaaatgggcatttgacaagaaaaaaaccctcagtccagttatggtaaagcagtaaagatcagagccatcagtatggatgtaaaatagtgtatgttttagacaatcagacatctattgagtacccacctattaactataaggctctgggaagaagagagaaaactaccctggaggacaaactatttgatgctatttaggtgttacataatgaatgaatgactcagttcctatctttatatatgtacaaaatatatcctacttctcaaccagattacacatgttttgagtggatggtttatatttctttatattcttcatgttgcctagtagaaggacttgaatttaatagaagtcctagggccaggcatggtggctccttcctgtaattccagcactctgaaaggcccaggcaggaggatcatttgagcccaggagtttgagaccaacctgggcaaaagggcaagactcagtctctgccaaaaaaaaaaaaattagttgggcatggtgctgcacacttacattcccagctactcaggaggctaaggcaggagaatcccttgagccctggaatttgaggcagcagtgagctatgattgcaacactgcactccagcctgggcaacaaagcgagtccctgtctcttaaaaaaataataacagaagtcctagaaaagtttgtgtgttgatttacttttacattaaaagtatatggcatgttgagcagcgtaaatatagaaaagtgtagggaagactgagcaggaagtactcctttgggactgaaagacctcaggaagtcttattcctttgatggcacaaaattctccaagtatggaattattagctatgataaaaatgttttgccgctagtttggggggactcatggtagcagtttcattaccttgtaatgcatgaacagaacagatggacatccattcctggctgtattcatgtgttgttgttgttattgttttaattgttcttatttacatgcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtggtaggtttgagaacaacaccaaatttcctattctattctacaagcatgttaactagagtctttgatctcctcagcattgtggatcttgatattcccaaaaaagaatctaaaagtccccctcaattatatcaacttctgttactaattattttctcattttgcatgagtaactttgctgagtatgaagtggagaggtatttacagtatgctctcagccacgctaataacaagagtatctcagtaattcatatttggctttagtatgccgtatgagatgtggaggagaaaacagttttttttctttgtttttttttccactaatgatatttttcttcaactgctggtaaaaatcaatttatattttcctgcacatgtgtgaagttacagcaataaaaaaacttgtcggccaggtgtggtagctcatgcctgtaatcccagcacttggggaggccaaggcaggaggatcacttaagccccagagttcaagcccagccagggtaacatagtgagaccctgtctttacaaaaaaaaaaaaatttaattagtcaggcatggtggcacacacctgtagtctcagctattccagaggccgaagtgggaggatcatttgagcccaggaggctgaggctgcagtgagctataaatgcaccactgcactgcagcctgggtgacagagtgagaccttgcctcaaaaagaaaagaaaaaagaaaaatcatcctgaaaatattttgtgcggcagagaaaactttctgcagtttaaaattttctgcaaatagtctgcagagtacaaatgtaagttatattcatcaaagttttctgtatgaggtataagaaatcaaaggcaggccatgcacagtggctcatacctataatccctgcactttagggaactgaggtgggaggatcacttgagatcaggagtttgataccagcctgggcaacatagtgagaccccatctctaaaaaataaaaataaaaaataaatcaaaggcagagtcataatcaagaccatgacaccatgtaaattctgtgtctgctcttgactctattataacttctaagatttttttcaagatgttttcccttcatccttatcacttaattaagcatccgtcacttccttcctgtggtttcagtgtataaaagaatttttacaagcttttctcccttcagcaataacaggtaacatttcgctaagtccagttgtacatttaagcatataacaacatgcttaattattagatgcttacaagctttgcttggcataggtgtaccatgtattattctatgtctttccttcccactgtcctatgatagccattaccttctgaaatctcagtaaatgatgcactaccctattagcattctctcttctgttagccctccttatgagagttattctttccctcatcccactcctaaaaattcatttggcctttgtggagtatttagatcaagtcattattaaactattccccactagaattattaatagttgataaaatatggaaaatatattattcatatgtgagtgaaagaacacttaaagcataaaaaagaactacatggccatatattgcatggcaataactatattagcagcaataataattgtaatagtaataataataatggctaacactttagaagcttctgtgttaggcatttccgggtgcttttcatggtacagaagctcatttgttcctcatactaaccctcttcactactctgccactgcctctcaagccatggatatgtgcactttagagtttttacttaaagtaaaaattcctgtagaatagatggtgttgaccccatcagaccgtgatgcagttagaagtgcatcccgtcttttacgatggccatacaacatcacacaaatcaaggtaaacccttgatccccaaattctcaatgtattaataatgaacagagttacacaagaattttagcatttaaggaaacaggagagacgataatactggaaataatttttcagaatatttctgttcggattgatggcagagtgcaggccatatacattgacaattattccagaacacaattattgtttggagctaaaaggatgcaaaccctgcctcttggcttatatggatttatttatgtttaggccattgaaataatggtagaaaggtaagtatgatatgctaattaagaacagacttcctttttatattttaaccaaagaactcaatatcaacaaaagactagtcagtggtattcaccctttttgatcatacacacctatcagtgaaagctttgactactacacaccctaatttattatctttatttgtaaattgtgtgcctactttggtgtaacaggtacatccgtaaaacatacacatacatagaattttaaagattggaataaaagttaatacaaatagaattccaaaactttcttaccacctacctagaagttgtaacattttcttcccatagcccagtgaattgccttgcacctgctttggcgaccaataggaagaaaggcaatgatatcatggaaattgtctctttggctcaacagccacagcattttgcaagtgtttctttgaaaacttgcttcactgtgtttttcaattttttttttaaacaacacttaatactgccagacaacaattcagacagtgtgctttttgtttataaagaacaaggaagggctactggaatctcacttgtcctttgaaacttttgctgaccaagtgtagaagtgagggcatgccttctgctcacccacaaaacacaccctgtgctccactggaccttcaaaccagtggaaagacccaacgctttttgttttatctagccaaaatttgcttatgcttacccaaaacctgaaaagaaattatattcttaatataaatacaatcacatcttgaaatcactttgaaattttctttattttccttttttctttccccaacatatgttctgaagtacacaggctgcatcagtcagccatttgtcctgagcaatagtctttcaaaactagaagaattacttgaaaaaaagaagactattaaggaatttaaactcaaataatttattgaccacttgctaggttgtacagggtaaatttttttttttttttttttttttgagatggagtcttgctctgtcacccagactggagtacagtggcaccatctcggctcactgcaagctctgcctcccgggttcacgccattctccctcctcagcctcctgagtagctgggactacaggtgcctgccaccatgcccagctaattttttgtatttttagtagagacagggtttcaccgagttagccaggatggtctcgatctcctgacctcgtgatccgcccacctcagcctcccaaagtgctgggattacaggcgtgaaccaccgcgcctggcccgactaattcatttattcagcgagtgttttctgagcacctactatgtacttgccactgttctaggcactggggatacaggaatgaacaaaatcacccaaatctctgccctcccaattttctggtatggagagaaagttcttttgtagatagggatgagaatcccacagaaaactcaggagtgatgtaacaatgcaaatgctcacaaaatctctttcctcatctttcattccctatttggaaggaaaggtttcaaagacattgatgttgtataaatgaccatcttcttcattattttataaacatttgtcctgtgcagagtaaaaacaactggactgcataacaaattatacctattgagagttgggtaaagagttaccattggatccagtccaccaacccaaatgtttttctacatgtattagctgagatgagctcctcatctcaggagaagcctattcccactgcaggccttcttgagtctgctgtgttcatcattcccaccaccaacacaaaaatacaagattggctctggaaatccttcacagagaaggaaggaaaggaagatggtgaggttggctttttagctgtgatcagcaaccaagctggtctttgctatgagaatcagtgggaccatgatctcgatggtcatctcaggaagggagggctaatgaagtggtctctggccatgattcctaagaagagagaatggacagcaaagatcgcagcacctgccacagcccacctgctgcagattcagaccccctggtggggccaggttgttatgactaacccctagcactgtctacatttagtggtgatggatgccaaggagggggcagtgtccccttggatctgattgtaaagcttagaaccaaagcatatgtggaaagttgtagggtcatgagttaagggacagaaatgagcaagagagaagcccttggctcatatattcccactgcaggccttcttgagccctctgtattcatcattcccactgtctttcaagcccaagctcatgctttgttctcatgggcactcatttttaggatatcttttgtccctcttgactttatgttgtgtgataccaactctttagtagttttttgtattatttaacttcatgtgtttatctgctcttgagtctcgagggcaggatttatgcagtttacttctgtttattcctcttagcccttgcacagtgctgtatacatagacatctactatatttttgttaaacagagcaaagaatggctggcaattggagaatgcagagaaaccgaaaaattttaaatttaaaaatcacaaataaaaacagcaggatgaaggcaagaaagcaaaagggtggaaagtgattaaaatgaaggtggcagaaaaaacagaaagcattcctctttgagtttgagtctgttatagtgtgatctcttctgtgtatgcatgtatgtgtgtgtaatgtatatgtgcacacacatgcatgcatgccttcgttgagtttctattccgaactaaggaaatgcaagcaatatactgttttacttattttatggcagggcttaacactttccatttgagtgagtgacttttaagaatgacatcgggtaagtataatggtgagcccttataattaatacattggtgaagaaaaatatactagtcatattaaggtaagtttcatatttctaaaacactgtaataaaatataaatattttgcttttcagctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaaggtaatttataaatttcatgttctacattttaaataatattttctttaaaaaaaatgagttccacaaaatcatggaatacttgaatttgaaattcaagtgaccagccaaagctgctcaatatttactttgagacagggtctcactctgtcacccaggctggagtgcagtggtatgattacagctcattgcagcctcgacttcccaggcccaagcgatcctcccaccttatcctccgaagtcactgggactacaggcatgtgccaccatacccggctaatttttaaattttttcgtagagacaaggtctcattatgttgcccaggctggttttgaactcctgggttcaagcaatcctcccacctcagcctcccaaagtgctgggattacaggcatgagccaccgtgccaggcctcatattttacatataaagtaaactattgagactcatgtgatcattcctctcactgtcaatgacatacttctgctatctgaattagtgcaagatcagtccctataggttttgtttaacaaatgcagtaagaggcctttcagtgtgttagctgggcctggggccccaggctgctaacagatgagatgaacaggtgaaggaaaaggaacttagagaaagagagggaaggagcaggtggagggaaggggagagttgctgcacttggaaatgcttgctagaagggatcgcctcttttccaggtagaggctgtaagggaagctttacctagaattaaggttggaacagacactgcttccaaatagttccttgctcactattttccttattgtcccaagatataatgtgcatttccatgtgtgtgaaaggttatgacatttcatatacaacaagcctcaattctggagatgcaggaaatttcaataattctcaggcagcagctgccattcggtcaccagcacaggctctgattgtgctgtccagacagtaagtactagccacatgtgcctatttaaattcaaatttaaattagttaagcttaaatacaattaaaaacgcagttccttggtcctactggccacacattaagtgttcaatggctactgtctaggacagtggaaatgtagaacatttccatcatcacagaacgttctcttgaaaagcactgttctggaaggtacttacccgttatgtacttttctgagttggtattcatacctagaagacctgaggtttatcacaagacatagacttggaccaggcgcagtggctcatgcctgtaattccagcattttgggaggccgagataggtcccctgagcccaggagtctgataccagcctgggcaacatggcaaaacctcatctctactaaaaatacaaaaattagctgggggtggtggcacgtgcctgtagtcctagctacttaggaggcttaggcgggaggattgcttgaatccagaaggcggagggtgcagtgagccaagatcgcaccgctgcactccagcctgggcaacagagtgagaccctgtctcaaaaaaaaaaaaaaaatgcatagactttatcctgtatttctcatgctatttatttattgacatgcttgttcaagagaaaccatcactaaagcacaaaaccttgatcataacatagtaataataatcaaacagcaaaaataataatagtaataagaatgttctgtggtgatggaaatgttctatattttcattgtcctagacagtagccactaaccatgtataggcatggaacacttaacatgtggctagtaggaccaagggactgaatttttaattgtatttaatcttacttaatttaaatttgaatttagatatccacacatgtttggatagcacagtcagagcctgtgctggtgaaaggatggcaggtgctgcctgagaattactgaagtttccttgattattattagtttaataataataatcaagatagtaataataatcaagatagtaataataatcaagatctcagctgggcacagtggctcacgcactttgggaggctgaggcgggcagatcacctgacgtcgggtttgagaccagcctggccaacatggtgaaaccctgtccctactaaaaatacaaaaaaaaaaaattagctgggtgtggtggcacgtgcctatgatcccagctacttgggaatctgaggcaggagaattgcttgaacccaggaagcagaggttgcggtgagctgaatcatgccactgcactccagcctgggcaacagagcagcacttcgtctcaaaaaaaaaaaaaaaagatctcaaatgaattgggattgtattaagtaatgattaagtaatgtgattacagcaatcctcaagaaatatttcactgtggccagtaacaatgtgtaacagacctttaaacttctagagattttcctacaacatgtgtctcaggctgatgtgttttatttagtgcttctcttggaaatgtcttgcccctcgatactttatcattaaggtctttaaggcagggatcatgactctacttttttttttttttttttttttgggacggagtcttgctctgtcgcccaggctggagtgcagtggcacaatcttagctcactgcaacctccgtctcctgggttcacgccattctcctgcctcagcctcccgagtagctgggactacaggcggctgccaccacgcccggctaattttttatatttttagtagagacggggtttcaccgtgttagccaggatggtctcgatctcctgacctcgtgatccacccacctcggcctcccaaagtgctgggattacaggcttgagccaccacgcccggcctcatgactctacttctaatatctcatcatgtgctcttccactgaggcttctacttagagctacacaatctgggcagccatcctcagtgccttatctaccaacatgctcaatatggctttgcagggttcactgtctaccagcagggttcactatctaccaacatgctcaatatttctttgcagtcaggcagagcaggctttgcagttcaggcagggcagctggctgcaggccccagctgactcctggggatagaatgccaatatttcagacattgcagagatttgaggcaatgtacataaagccctccacatataactgatgcacaataaatgacagttaatattatgcaacaagaatttcctggggggttttataattaatttttatttgtgtgaagttttttccctcccttttactttaatcctttttggggggaaagcatcactagtcacagttcacggcagcctcgacctcccaggctcaagcaaccctcccacctcagcctcctgagtagctgaaaccacaggtgtgtgccaccacacctgactaatttatttttattttctaatgaaacagaatcttgccatattgcccaggctgatcttaaactcatgggctcaagcgatcctcctgcctcagtcttccaaagtgccgggattatagatgtgagccactgcactcagcctttttttttttttttttaattgtagatagcataaaacctactgttttaaccatgcttaagtgtacaattcagtggcattaagtacattcacagtgttgtgcagccatcgccattatgctgcattattttcagaactttttcattattctaaactgaaactttgtatccattgaacactaactcccaattcccccagtccctggtaacctccattctactttctgtcactgtgagtttgactattctaagtacctaatttaagtggaatcatacagtatttgtccttttgtgtcaggcttatttcactttgcatgatgttttcaaggttcatccatgttgtaacctgtcagaatttaatttcttttcaggatgaaataatgttttattatatacagtcacaccattttgtttatccattcatctattgatgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatgtaagtatatatgaaattaagaagaaaaatttaatcagagttgtcactgcttctcaagaataaatcttcatatgaggttgctatatgaccaccaattatttaaaaccagttattttaagtaagaattaattaccttttcccaaaacattgatctacccatgcaaagaagacaatgcatcctgaaatgctgatgcttaagatagcagcccaaagtagtaaaatacagttaacagacataggaaaccaacactgttctgaagactgagtttttctttgcaccaaatgcagatggtagcttctagaaggctgtttgcctatattcttactcctgttgaatattgttgccatatatttagaacttcaagttattttctaaggaaaaaaacaagatatttctaatattctaaggtaaactcagaccagtacaagaattttcagtttttttttccaaagatcccaaatgtgaaataaaacaacaaaaagcagccagtgtcagatttctatgccatttagaaaggagttagtttaaaaaggaatggaagtaatagggttttgtgcatagatatctcgaattaatattgctgttgataaaagtgattttgctaagacccagcactgacaacacttggccactttgatcccattttaagtacttgtcagaatattggatctttgaactcaaaccattttgggtttttggggtttttttgttttgtttttttttgttttgttttgtttttgaggcacggtcttgctctgttgcccaggctggagtgcagtggtgcaatcatagctcactgcagccttgaactcctaggctcaagcaatcctgctgcctcagcctgctgagtagctgggactacaagtgtatgccaccatgcctggccaatttttaactttttttatgagaagggatctcactgtgtagcccagggtggtattgaactccagggcctcacactgtcctctcacctcagcttccaaaagtactgggattacaggcatgagccaccacaccaggccctgttgttttttttttaaagaaatttttaactttagaccgagggtgactgttgtcaaggtttagggttaagatgttttacctagattatgtgttgaaatgttatagccaattgctttataagttattgaataataattgtattttctttttttttttttttttgagatggagtctcgttccatcgcccaagctagagtgcagcggtgtaatctcagctcactgcaacctctgcctcccgggttcaagcgattctcctgcctcagcctcccgaatagctgagattatgggcgcacgccaccaagcccagctaatttttgtatttttagtagagacggggtttcactatattggccaggctgttctcgaactcctgacctcgtgatccgcccgcctcggcctcccaaagtgctgggattacagacgtgatccaccgtgcccagcttgtgttttctttttaaccaaatggaaataacctctgtagcatgaaagcattttattattattgcagaaggctttaattgctgatacaagtagcaagactttgtaaatgggattgacaattttctgttattcggcagctacctatactgctaaaaggtccaaaaataatgaaatcatctttaagaaatgttgcatcaactagtggacattctttgtttttgtattgtggtgttttgttttatttttatagcttcactcaattccgtatcattttgggcgatatcaactttgcagagattgaggaagctaatcgagttttgggaccaatttatttcactacatttgtgttctttatgttcttcattcttttggtatgtacatttttatttatagtgaggttcaatttaaacttcgtaaatccttgtcttctcttttctctcacactttatgtcctatcaattttaaataaagacccaggaagtagaaaaaagtgtggatgttggaaaacttattttccttttattaattcacagttttgagactcatatcaaatgtcttttctgtggtctttcattgatccatgtatatgtgtctattcaatgcaaaaaaaattagatctcttccatggtctttcatttctctctctatatatgtatctattccatgcaaaaaagaaattagatcaagtacaaatttataaagatacctaaaatagtgctttgcctaaaaagtagaatatgcttacatgctttttaaactcatatgtcagcactttcgtagtcacttgctagcatgacttttctctctttcttcttttctttttaaaaaataagaacggaaaagcaagctagatctaagatgtcgagtaatagttgagtgaatcattgcatgtcaaaattaggatattctgttttaaattatttatatcccattcatctagagactgcctacagagaatattcaaataattaagtttaaaactaaatgtaacaatgaatggaaattgcattaaaattattttcaaaaataatttttttattctcttgatttggtacaaatgaacatttttaatgtttttgccctaagtcaattaagtttttttaaggtgttttgttctttttcttaacatttatatattcaattgtctactgagaaggtgttaagccagcttaatttaggcaatatttttcatctaaacactaacagtcatcttaagaacaattttcttaagaaaataacattttttccatttcagtaaattgtgtaaagatcccttgaggaaggttaagtgatcacattttcagtaattcagtgtaataactctaaagtcagtccaggtattactggttaagtatatggtatttattgattgggtattagatgtactgtattaatttcctgtttaaaaaaaattttttttccggggagacacagcctctggtgtaaaacaaaggtgtgttccctagctgtactttaacaggactgaaaaggtcaggaatatcattcaagttcatatgtatcttgctgtatgcatggtttatggctcatttttaaacttacacctcttaagcttcttcttcctatcatatattaaaacaatggagagaagaataagcctctgttactctaccattgatagtacttcggattctagagtacctgaatctctactaagaaggcaaaaaccaggaattgagagtcctgcacctgacccttcagttgatctcaggccacctagttttctccgtttatcaatctgccaaacaaggatggatagagtcgtggcaactggaaaggctcaaatgtggaattgtttgaatgtggtcctttagtaggcagccatcttaccagatctagagtattcagtcatcttaccagatcagtcaccagaacatgaaaagaagctcttagtttctatctttatactaaaattgtttttttgtacgactgcacaaaaaagaattgctctccttgcacctcccagagatataggtggatagatacatacatacgtacatacatacatacatacatacatacatacatacatagacacatacatagatagaagtctactttcaatacaaacctgtcttttaaggaaatgacaagctgagcatagggttggccacctttctgagccgattgcctggtattagtttattgcccctgtttagcaagaaggcacagtgttaagaagtggctcagctgaaccaggataaccccactcttcccccacatcaacaggaaagacatcctggtgcagatgtccatctgataattcagggaacctcgggagacaggatggagaggagggtgagctagcttcctcttcccacaccttcaagagcctttctcaagcactttctattttttgaaatctctttagaggtcccagactttgatctgtttcaattaaggtattggcaggcattagttaacagccacttggaagcaaaaatagaacattagatccctgagttggaagagagaaggtagaaggtgttacttggactgcaattatctgcacttggaattgagcatttagtcaaaaacttatatgtattctatattctattctcatttctgctacagaattgtaaacaatattcttccttaatacagaaattcatagcccactaaaataagagcgttctcatttgttcatttctcaatcatttaataagtatttactaagccactatatccatatatatatatatatcatatatactgtataatacacactgtagtgttttttgtggattgtgtactatgaggtagtatgttagatactgccagtactggggtaaggaaaacagcctgattaggcccttacgaagattcctcagacttgtggggaaaacagacattatcaaatagaaatacttgcaaaccacagttatgtgttaaaaaggaaaaacaaagtaaaaaaaaagttggtgggggggaacctgatctcctggatacagtgcttcgagaaagtttgttgttggaaatgcaaaccattactactgtggaagggaaaggtcagaaaaatgaactcaccattactgaatagtaatagtagctatcaattaggtggcacttacctgcatcaggacctgtcctgagcactttacatagattgtctcactaaccagcccaacaaatatgtaagggagatactattatttttcccattttattaatgtaaaacaattaaataattctttaaaattagacttagaaaagtggagcaacaatcttagcagtgctaggactgaaatccaagtttgcttgactccaaagtctatctctcttccagaaactttttctttactatctgcctagtaggcctgctgtattcctatttgcaacagccttttaaactctttaaaaatgtgtcctgtaaatttcatatatgattatacaaaaaaacttggaataagcatacaattctacttatctgtgttaactgttgaaatttgaagagctttttggaattctatacccttcagtagtgtatgtaaaagtttctaaatatagagaacatagataagcaaaaataatattaaataaaataatcgcaccattagtaggtaaatatactaatattttgttgtattttattcttgtatgttttcacaaagtatatcataaaatttttcctgtggcatgacttaacggagaaaataatcttcccaaaacatgtggcagcaaaactgttaatttattacatcaggctgggcacagtggctcacgcttgcaatcccagcactttgggaagccgaggcgggcagatcacttgaggccaggagttcgagaccagcctggccaacgtggtgaaacactgtctctactaaaaatacaacagttagccaggtgtagtggcacatgcctgtaatcccagctactcaggaggctgagactcaagaattgcttgaacccaggaggcagaggttgcagtaagctgaggtcgcgcccctgcactccagcctgggcaacacagtgagactctgtctcaaaaaaaaaaatttttttttaaataaataaataataaatttatgtcttcataaagcactcagattaggaaaaaaaggataaacaaaaaggcatgtgtcatttttttgattgataattccaaattatgtttcttcctttaatttttgccctcctttcatttacaaacagaatatgtttttggctatcatcaatgatacttactctgaagtgaaatctgacttggcacagcagaaagctgaaatggaactctcagatcttatcagaaaggtaggaaaaaccttaattctcagaattcttctgtttctgacataaaatgagcattgtttcacccagattttcaaatcaacattgatccattgaaattgtttgaaataaagaatacattgctatatttcaggaataatttaaatgttccctatcttggagtcttgatggatatactgctatcttgaattttaattctgggaatccttttatgccctggaattaaattctcaacaatcttttgacactttaagagctgagctgaaggttcatcaccttcattattttgacatctcctgtagctggctctcacttcaggatcctgagttgagaataaactagaagggaagattatataaagggatttccacctcttctgtctcaattaccattttaaaaaaataaaaagttttagaggaaaacacttagtagttcaccctttacccttgaccttccacggcagttttaaaataagcaaaggaaaagattcatgaattcaggccatagcctggggcctgagaacttttacttatgcaccttctcaggaagggtttcattgttaaatagaagggcaggacaggaaagttgggcctctttgttcttctcaatgtaacttctttatttggtttaaagtataaaatgtatacaacaacaaataaccacatttaaaatacacagtttgtttcccaacatcattttgctaagtcatagtggctccttaactgtaatttttttttttattagtccaagccttaggattatgttatctgtgatatatgttataatagaaaacttaagcctcttaaaacaaagtccttgggatgggacctaagattcacattatcttgattccgcataacagttgcttacattttagcaaatctccagtgtgtatgcaagcactcctcacttggcacaattctgatacacacaaactttggttaccccagttttgttatgtaacaccaccttcaacaacacagttcaaatttcagttatcatagtatattaactctgagtaacagcacaaagtacaaactccactgctagctcttcagtgtatagatcagttacctgagtaacagatgtgcaggctgagcaggctcactggtcagtcatgacactattttcagtctgttactaattggtcactgagcatctgctatccaattcacaaacaaagaaagcatgtagtgttgcttccttgtgttccagtaataagcccatgtgacattttacaaaaatggataattgaaaaagagaatgggtgcagtggctcacgcatgttgggaggccaaggcggatggatcacctgaggtcaggagttcgaaaccagcctggccaacatggtgaaaccccatctctactaaaaatacaaaattagctgagtgtggcgacagatgcctgtaatcccagctactggggaggctgaggcaggagaatcgcttgcacctaggaggcggaggttgcagtgagccgagatcgtgccattgcactccagcctgggtaacaagagcgaaactccgtctcaaaaaaaaaaaagaaaagaaaagaaaagaaaaagagaatgggctagcaaagaaatgaaaaatggtaacactggaagtgaaaatcaaaacagagtaatggatttatagaagaaatagctgagtgaagaagaaataggagtgttgacactgcgatcattcaagagatccagatatggagccagaagaacttagggcaggtctatcaacttaaatgaggaaaatagctgtgataaaacagatgaagatgtcttgaggaaatgatgcctgcaaaaaacttcacattaagggaagtcttattagagatatttcacaataatgaaagtacaaaagaaaaaatgttggggctggacatggtggcttactcctgtaatcccagcactttgagaggccaaggtgggtggatcacttgaggccaggaagtcgagacaagcctgatcaacatgatgaaaccccgtctctattaaaaatacaaaaattagccagacatgatggtgcacacctgtaattccagctactcaagtggctgaggcacgagaattgcttgaaccagggaggcggaggttgcagtaagctgagattgcaccactgcaatccagccaggtgacagggtaagactgtgtctcaaaaataaataaaagaaaaatatgttggaagctcatccacatttaagaaggaatatgacaattcactaatgcatagaaaagaagttcactccacattgtaaagtgtacagtgtaatattatacaatgaaaacaaggcaagtgctgtttaaactactctggatacattttttacaaagaaataaaacactttagtttttaatgtttctaatgttttacattttagtgtattaaatcaatattagttttcttcttttttaagctccctatacatttataactgacactaagggagtgtttaatgttttgattaaaagttgtaaagatcacagaacaattgtaattcttcccactgattattcagatcattttgcacaatttcagcttgcatggtcacttacagtgccgcactatgtgcaaagcaaggtcaggtctaaagttcgctaatgaaaaatcctcggccaggggcagtggctcacccctgtaatcctagcactttggaaggcgaggcaggcagatcgcttgagctcaggagttcaacaccagcctgggcaacatggtgagaccctgtctctacaaaaaaaaaaaaatagcaaggcgtggtgactcacacctgtagtcccagctacttgttgggggctgagttgggaaaatcacttgagctcaggaggtcgaggctgcagtgagccagaatcacgccactgcccttctgcctgggtgacagagtaagatcctgtctcaaaaaaagggaaaatcctcatctacatttcactgggttttttgtttgtttgtttgtttgtttatacacacttaaggaaattactgtctagaagatagataatataaaaaataaaaatgcaattcatgattcgggtttcttggtattcctaagaactgttgcacagtactttatgctctgaggcagacagctatagcatatatagtaatttttgtttctatcacataaacttgaatacacatatgagtaaaagacctttagttcttcatgacttactgaaagaccctgactttttccatgtaactgttccacaagtgttttatggaaaactggatacattaattcttcattcatccagcacgtacttgttgaatggccaatgtacaccaggtttgtagtagttactactgtgaatggaaagtaaaacagatgcaaaaggagaatacactaaaccaagtcttttattttttctctctctgatagggctaccataaagctttggtcaaactaaaactgaaaaaaaataccgtggatgacatttcagagagtctgcggcaaggaggaggcaagttaaactttgacgaacttcgacaagatctcaaagggtgagaatcatgcttcctgaggttctgaaaaattcctgcttctaaagataaattcctggtgataagagtatttctagcccaagggctcatacagatactttttttttttttttccagaggcaggtatctttctggaacatgttataagaggaaaacttgcccccatttggtgatttctcctttcctcctgcattttgatgtctctgtgttgagggtgaactgggtacaaggaatgatttttatctgtatcctctctctaatttcaggaagggccatactgatgcagagattgaggcaatattcacaaagtacgaccaagatggagaccaagaactgaccgaacatgaacatcagcagatgagagacgacttggagaaagagagggtgggtctggtttaggagaaccggatttgatttggtacctacaacaccacagatgtatcaaacactatagaagtagtgggttattgagtctcttgcccattccccaccacactctctctctctctcagtcggtttatgtgttagtaccctgtttattccagaaagaatatataacacaattatgtataaaaatgggtggttagcatgatataaaaacgtcaaaatgaaaagcaagcaaaacaaaagtaaaaataatggattattaatgaagcttaaaaatgcattcataaaaacacatatgcttattaagattgggctacaaattgggccctaagcttgctggtaatcagcttgaaaagagaagcctgattagctgcagagtccacaatgtccgtgagagtgaagaaaacaaaaaatgacttaccaagagatgtgaaattattctggttagttagtggctatttaaattgttaacttttttttcttttttttttttttttgagatggagtcttgctctgcctcccaggctggagtgcagtggcacaatcgcgactcactgcaacctccacctcccgggttcaagcgattctcttgcctcagcctcccaagtagctaggactacaggcacatgccatcatgcccggctaatttttgtatttgtagtagatatggggtttcaccatgttggtctcaaactcctgactgcaagcaatctgcccaccttggcctcccaaagtggtgggattacaggcagtagccaccgtgcctttcctaaattattaacatttataataaaattaacagccgccttccatttgaatactttttacaaaatagttaaaaataaacataagtgggcttttatagtcagaaaaaaaaattcaaagctttaccattaactttcaaaaataaatggttagacagcaacaacaaaaatctgtggtaactgaggtacagagaacacagatgaatgttattacaaaagccactttcctatgagaagtctaggacagtggtttctaaatgccactccacagacagtgctagtaggtgacagacttctccagtcacagtgaaatttaagcataaagaaaatgaggaaaatttttacaaggctctatttagacaaagttcttattctgacattacatctttcctactttggagctgttgaatgtattatcttttatgaaaagaaggcgatccaggttgagcatccctaacccaaatatgtgagtctgaaatgctccaaaacctaaaacttcttgagcacaaacatgatagtcaaaggtcatgcttaaaggaaatgctgtcattggagcagtttggattttgggttttcagattagggatgctgaaccagtaagtataatgcaaacattccaaaatatttttgaaaatcccaaatccaaaacacttctgatcccaagtatttcaaataagggatactcaacctgtaatatatttcttcatttctttatttattttattattattttaagatggctcatggcccactgcagcctcaaactcctaggctcaagtgatcttccgacctcaacctcccaggtagctcaggtagctgggactgcaggcatgcatcaccatgcctggctaattttttaaaaaattttttgtggaggcagagtctcaccttgctgcccaggccagtctcaaactcctggcttcaagcagtactcctgcctcagcctcccaaagtattaggattacaggtgtgaccactatgcctggcccatatttcttcatttagttttttctttgcctgctgtgtttttaatgttctttcttgttcaaacaaaaagttggctattccttgctgttagttaaatttgccaatctatgaaactgaaaaatgcaggagtcccagcctggtgttaaatacaaagaaatcccaggtaaatggcatgcacccagttcctgcttgcccaagtccttggtgaggcttctgtggggtctcagtgttctgctcctcactcagtgaccccttgttcttcaggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtgtaagtataaaggaattggcagaatttgcgttgacaagagtccacatgagaccaggcagttccctcatctctctgaattcactcctttccattactaatcatccagcttttaaaaataacttatactggccagacgcagtggctcatgcctgtaatcccaccactttgggaggccaaagcaggcaggtcatgaggtcagaagttcgagacgagcctggccaacatagtgaaaccccatctctattaaaaatacaaaaaattagctgggcatggtggtgggcacctgtaatcctagctacttgggaggctgaggcaagagaattgcttgaacccgggaggcggaggttacagagagccgagatggctccactgcacaccagcctgggcgacagtgcaagactctgtctcaaaaaaaaaaaaacttgtcaattggtgttttgtttcttacataatatgtttactataaaaattagcaaataagagcaaaagaaaacattaacatttcacatatttctaccaatgaaaaatgtttattaatatatcagtgtttgtgtctctatttgcatgtgtttatcaatgtttctatatatttttatggcctaacatatggttcgtcctgaagaatgttccttgtgcatttgagaagaatgaatattctgctgttcaagtgttctgtagatgtttgttaggtctagtttgtttacagttttattcaggtctcccatttcctggttgatcttagatgtgcctagatgtggtattcacgtttgaaagtggggtattaaagtctccaagtattattagttggagttcatcccttcaattctgtaaggttttgctttgtgtattttggaactctgttgttgggtgcatacatatttataactagtatattttcctaatatattgaccctattttctctctcaacttaatgaggctaaagaaaaaaaagaattgaccctgttttcattacaagatgttatccactttatctctagtaaaattctttgttttaagtattttttgtttgatattactgtaaccactccagctttcttttggttgctgtttgcatgataaatctttttccatccttttactttaaacttatttatatctttcagtctgaagtatgtctctcctgtagacagcatataattggatcttatctttttatccagtttgacaatttctgtttttgattagattgcttaatccattcatttaatgttatcattgatgtagttgatttctgtctgctattttattttttgttttctagcttacttttttttgttcctctttcactgctttcttgtacattaagtgaatattttcaagtataacatttaaatttttttaatgatttttcattttttttagtcaggagttgctctaagacttagtttatacaattaagttatgaaaaattacttcagatatatattaactgaatccagtgagatatagaaatcatttctatttagcttttttcctcttccctctttttgtgctatatattcatctatctatatgtatatatagtcatctacatatgttgcaaatcacattgttagaacaatgttacatttttataacacactgtgtaatatatagtatataattttatatctcttaatgaagctgagagaagaggaagtatatatttataaatgtgtatattaacctacttttttaccatttctaattctcttcttttgctcctctggattcaagttatcatctgtcgtcattctctttctccgatacagctttgctactgcctacctcctattattgtcaaatatattacatttctattatagaccttcagatccaattatgtacatatttttacacaactgctttttaaatcagttaaggaacaaaaggagaaatgtacatatatactatattttatacctacacagttatctttaccagtgttctttgccttttcatgtggattctgattactatctggagtcacttgctttcagcataaagaatttcctttagtattttttgtaaagcaggtttgctagcaatgaattctttcattttttgtttatctgagaatgtttttctttctccttcatttcctctggcttgtattgtttctgatgagaagacaggtgctaattttactgtggtccccttgtacatgatgactcaattttctctcaccactttcaagatttttttgcttttgtctttcattatttttactgtgatatgtctgggtataaatctctgagttcatcctacttagaaagtgttttttctgcttctttcactttctcttctcctttgggacccgcattatgcatatgcttaggggtatcacatatttctcttaggctctgttcgtcgtcattttttttccctctctgttcctcagagtgcatagtctgtattgatgtatcttcaagttcactgacttgttcttctgtcagcttgcttaaatctctgttgagctcctctagttatttatttatttatttatttatttatttatatatatatatatagagagagagagagagagagagaaagagagagagagagagacagggagacagggtctcactccatcacccaggctggagtacagtggtgtaatcatggctctctacagcctgaacacctgggctcaaatgatcctcctgcctcaacctcccaagtagctaggactatgggcacatgctgccatgcctggctaatttttaaaaaaaaatttgtagagatggcatcttgttatgttgcccaggttggtctcaaactcccggcctcaagtgatccttccgcctcggcctcccaaagtgctggggtcacaggtatgagccaccgcacttagcctgaattttttatttattatacttttcaactccagaatttctatttggttctttttagcaatctctgtctctttattctgtatttgatgatatcctgtatttgatgagacaatgtcatcataacttccttttttttttaagagatagggtctctctctgtcacccaggctagagtgcagtggcatgatcctagctcactgcagcctcgaactcctgaactcaagcaatcctcccacctcagcctcctaagtacctgacactacaggcatgagccactgtacccagctaatttttattttttgtagagatggggtctaagttgcccaggctggtctcaaactcctgggctcaagtgatcctccctgctcaggctcccaaagtgctgggattacaggcatgaaccactggacccagcctcctttatttctttaaccatggtggggttttttattatttgtttgtttgttttaacctgtttgaatatatttataataggtaccttcaggtctttgtctgctaagtctgacatctgggccctctcaaagacagtttcagttgtctttttttttttcttcttgtgtatgggaacattttcctgtttttttgttttgttttttgttgttttgttttgttgttgttgttgttgttaaagattggacatgttagataatatattgtaggaactctggctagtgattccctttcctccccaggacttgtttttatttctctttgcttgtttactttttcatacagtctgtttccccacagtgtctgcctctgactttattccttagagggcgcagctgtggccatgtacgtagtcactctgggaagacagtggttttagcagcgtgctcattaactttctctgacctctttgttatacctcctgcctctgtggatattagacccagttattacatttcattgtttactgattggtctattgttttccagaatgccttgggatgtaatttgctccacagtctgatccacttaaattcaggcctctttgcagggctagttttagaggccagtctttttttttttttttttttttttttgagacagagtctcactctgttgcccaggccggaatgtagtggtgcagtctcagctcactgcagcctcaatctctcaggctcaagcaatcttcccacctcagcttctcaagtagctaggactacaggtgcacgccaccatgcctggttaatttttgcattttttatagagatggggttttaccatgttgccccggctggtctcaaactcctgagttcaagcaatccacccacctcagcctcacaaaaggccgggattacagatatgcaccaccacgcctggcccctgaggccagtctttaactgtcttcttagctgtctctttccctggttctctctggtgaactagctggtaatttgtttatctcataaggctaccagattccttgtaaatgcttatccccacaatctccattgttttcaagagcatcgttagtctttaatttcctcacgcttcattccaaataaagtccattcacttgagaagagttctatattcctatgacctgtgtctccccatgagcaaaactgctactgctttacagagccagggacagtggcccacctctctgtggcatcctgctttatgaacaagtcactgggctcagatggcagtctctgattttctcaccttgcttcttctggcatggaaactccaccctacaagtgggaactgagtggaagaagagagccccattccccttagccactcttaacaggattagaacctctgcaacatgcatttaagaatgggaacaggctgggcacagtggctcacgcctgtaatcctagcactttgggaggtcaaggcaggaggattgcttgagccaggagttcaggaccagcctgtgcaacatggtgagaccctcatctctacaagaaatagaaaaattaactggtgggttgtgtatacctgtaatcccagctactcgggagcctgaagtgggaggattgcttgaacctggaggcagaggttgcagtgagtcaagattacaccattgcacgccagcctgggcaacagagtgagactctgtctcaaaaaaaaaaaaaaaaaaagagtaggaacattgaggctgggcatggtggctcatgcctgtaatcctagcactatgggaggccaaggcaggagtatcacttgacgctaggagttcaagaccaacctgggtaacatagcgagactttgtctctattaaaaaaaaaaaaaaaaaaggtgtaaaaaacttttgtaacaagagtgggaaagccgggcacagtggctcacacctgtaatcccagcactttggaaggccaaggcaggcaggcggatcacctgaggtcaggagtttgagaccagcctggccaacgtggtgaaaccccatctctactaaaaaatagaaaaattatctgggcatggtggtgcacacctgtagtcccagctactcgggaggctgaggcaggagaatcacttgaacctacgaggcagaagttgcagtaagccaagatcacgccactgcactccagcctgggcgacagagcaagactctgtctcaaaaaaaaaaaaagagtggaaatgttaggatgagaaatgctggcagcctgcccctccctgggagatactgtagccctagactggaagttgggggaggagggagccctgtgctcttagctgcacccatgtgaagttgtgcttctatcacatgagctggggacaggagagaaggctcagattatggcttcagtgccacagaatctcttcatactaaaatttagtagattttcttgaataaatgctttttcatttgctgtacacccttaaaagtttctagaaatttttaatatttgagttttaaaaaataattttcaacagttacagttatttcactaaagagagagtctacagaaccctcttgccaccattgcagaggttgtctttggcttacgagtttttaaagtatttgtatacattttttaagttcaaaataatagaattgtaagtgaacatgctgttttcatactgtttttcaagctttatttaatatattgtaaatctaattctattttattaaatagtctgccacagtataatgtctgatgtctccttagaattttattgtatggatgaacaatgattatttaatttcctaccaattgttgggtgttttttgtttgtttgtttgtttttgagactgggtctcactctgtcacccaggctggagtgcaggagtgcggtggaatgatcacggctcactgcagcctcaacatcccaaggctcaggtgatccttccacctcagcctcgcaagtagctgggagtacaggcacatgccaccatgcccacctattttttagagatgaagttttgccatcctgcccaggctggctcgaactcctggcctcaagcgatctgcacacttccgcctcccaaaatgccaggattacaggcgtgagccatcatgccctacccccccatcaattgtttgatgtagccatttttcaatgatccgcgattaagaagcagcactcttttatagccaaaaattacacatatataaaattttcctttagaaaatgttctaaaaatggaatgtctaactaaagggttaggcatacattcttaagacttctgatacgcgctgacttgcaggaaagttgtttcagttaacactcctaccagcggcatccgagagttaatctgtaaagcttgagacaacttagaaagtgtttcaaatgattgtgttgcttaagaaaaaaatcttagcacttccttttgaaaagccagtggggctgaaaagacaatgacaagcactttgtccctctgtactgtgttttccttgcagcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggtcagtagtcatgagctgaaaacaccgctgctgagcatggtgttattaatgaaaatatatgttgctgacagttgtatttgaagtattgaagaagagtaaaaaaaatttacgtttatagaaattcacaatgatgtttccatttactctcattttcagatttttttctctgaaacagaaacactctttctataaaatctcttgctataaaacatcaatgtagtcatattgtctaacccttaggctgagatgtttatctttctccataactacagataaaattataatctggaggtgttactttcttaatactccatatgctaatggtcctgccttcactgcagggtagaattaagtgaaaaattactccagcaactctgagatttgctattatatgctgtaaatctccagccttaccaaactacagattatttggtccctggacttcctaaggcatttccttctactgcccccaacaccagtttctttttccctttttaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcagatgtgagagttgtctgttttctaagtagtcacaggtaatgtgccttttatcatgagactttgactttgaaaaaggcaccttctctatgtccgaaaacattaattggtacatttctctgtttattacacgagctacacaattcaggtacccagttagcctttaagcacagggctgtcatttatggcatttttgtttttattttcctgaaacgaagattccagggcaggtggtttatttgagaggtgtaggcaatagggatagtggagtgggaaggacggggagaagagagggtgccagtaaagggcgtgtcgtctagctgcataacagcataggctgccaaagcctaattcctgtggtaaaatgctgagaaacagtttaggacaaatgagaacaaacaattcagacttatcccagctgaagggccaggactttggttgaaagaccactctgggagaatgatagcaattccctagcacgtccagtagacaaagcagcctttgctggcttctgagcaagcctgtaggcaaagaaatgcagacactggtagatgaaaaccagcaggcatacactgaagtgccacatggtcaaggtgcccacgttatacactatgtatgatcacgcattgttcaatcctaagggattccatccccttagaatactacaaatggggctccatggagttgtgccacatggtgactctctatgcagaccacccataaaacagataagtttaaaagcataaagaaacaagcactaggctaagactctggtccccactctatacttcctagtcatgtgattatgccaagacaactggtccagtttctctgaagactcttatttcttcatttgtcaaatgggaaaatcaatacttgtctccctcataggattttgcttgtgcagtaagaatatatatgtatgaaagcactttaaagctgaaatttccattacaaatggaaggcggtactacagtacctagcccagtgacttgctcagcaagttacaatctgttgaatcagcaaaaaggaaaggaattcttgacaactgcaaatttgaaaggtaaataaaggagaatgatgttgccaaatgataactcaatacttacttaaaagtcttctgtgtttgtatttcaaaattgggctattatttgtacagttttgtgtacggctttttcacttcatactgtatcataaacattccatgaaaccctgatttctattaataactacagagtgaatcaatataaattaatattatttatgaaggccggacacagtggttcacatctgtaatcccagacctttgggagactgaggcaggaaaactgcttgaggccaagagttcaagaccagcctgggcaacatagcgagaccctgtctctataaaaataatctgggcatagtggtacatgccggcattcccagctatgcagctgaagcagaaggattgctggagcccaggaatttaaggttacagtgagctatgatcacactaccactgcatttcagcctgaactgagtgacaccctgtcactaaaattaaaaaaatatatataatatatgaatatgtgatacatgtcaattaattcataagttgttatacatttttaattcatatgaattacccaaaatacatctgccctgttgttggacatttagattgttcccgttttttattattacctctaatgccatgactaacatatgtcgacataaattttttcacatatctggttatttcttcatggaattctgtatggagaaatatctggaaatgtaataattaggttaatctatatgaacacatggttttgacacatattaccaatttttcagaacatttataccaagtcatattataaccaaatttatgagtacccatttgtccacctgcaaacacagagaacttttttgtaaaaagtgtttatttttatttaaatttaaacagaagaaaattatgcacaaaaatgaagaaattgctgaatctcagatactg

SEQ ID NO: 11786 - DNA, 15108 bp, Human
tccttagggcctgatacagcgtaggtgctcgataaagattggacagtggggaatgggcaaatggtaactaatgaatgctatgatgatgatgatgctatcaaagcccttccagagaatcccaccagttagtatcagctgaacccacagctagtgtcacaccaaaagtggcatcagggcagcactcacaaaggatgccccaaaccatcccaagatggggctggttgggattccagtgaatgaagcactaaatgccagggcaatcaggccaaagcatacattaggggaacttacctacagaacagctactgcacatccttgctgtggacaatgggacaaagggtgttctacccaggtatgttctcaaggaggggttcggggtatggtgtttataggagtgtttaagaaatttgaagccagtactatggctcacacttgtaatcctggcattttgggagaccaaggcaggaggaccacttgagcataggtgttcaagaccaacctgggcaacagagtgacaccagtctctacaaaaataaaaagtcagcacctgtggaaagaaaggaaaaaaatatttttaataaataaaaatttaaaaagtagccaggcatggtggtgcacacctgtagtactggctacttgggaggctgaggtgggaggatcgttggagcccaggaagtcaaggctacagtgagccatgatcacacgagtgcactccagccagggtgacagagtgagaccctttaaaaaaaaaagaaagaaaacaaggctgggcatgatggctcacacctgtaatcccaccagtttgagaggccgaggctggtggatacttgaggccaggagttggagaccagcctggacaacatggtgaaaccccatctttactaaaaatacaaaaattaggccaggcacagtggctcacacctgtaatcccagcactttgggaagctgtggcaggcagatcacctgaggtcaggagttcgagaccagcctgaccaacatggtgaaaccccgtctctactaaaaatacaaaaattagccaggcgtggtggtgcatgcctgtaatcccagctactcaggaggctgagacaggataatcgcttgaacccaggaggcagaagttgcagtgagccaagatcacgccactgcactccaacctgggcaacagagtcagactcagtctcaaaaaaaaaaaaaaaagaaaagaaaagaaaaaagaaaaacaaaattagctgggtgtggtggtgcacgtctgtaatcccagctactcggtaggctgaggcaggaggatcgcagaggttgcaatgaactgagattgcgccactgcactccagcctgggcgacagagtgagactctgtgaaaaaaaaaagaaaaaaaagaaaaaagaaaaagaaaaaaggaaggaagggagggaggaaagaaaatttccctgggggtaggagtctataagtttagcaaaatagtcgatctttcagtgtttccagcaacaacctaatcaagtttatcagtgtctgagaatgttcaaggtaccatcttgggttcaaacatgtaggcgaaaacatgcagctggccaggttacagagtggtgaaggcactctgcatttcttggttgagacagagaaaaaaagtggtcagaactgggtaaccctccccccaccatattatcacagtgatcccttttgtctttcttcaggctccagccccaccctacagcccctgctccctggattcactagagctaacttcagtaaagtacaaagaaaatggggccatatgactggccaaaaaaaaaatatctattcacgtggatgaccagatagtatgaatggattgaaaatttatcaggaaaaaaggatgagaggaaatgccaggagatgagggcagagagcaggccgttctgggggagggattctgtggggacagggtggcctactgggtgtgccccttttctcttctctgtctcccttagataagaccagcagttttgtcatcctctccctctcattccatggtcccgcagccccaggcccacactgaaagcatgtcgatccaggagaacatatcatccctgcagcttcggtcatgggtctctaagtcccaaagagacttagcaaagtccatcctgattggggctccaggaggtaagaaggggagacagaagccatggaacataggaggaaaatgagggtgaaaactaggagccagggtggagggcataaatgatccacatcagccactggctaggtgggttttggagaggaacgtacgttcttcagagcctcccgtgtgttaaattatggaccctggcctgggtcttttccaggccctataggcaggccagagccacagcatgtaagccacggggcactcccgtggttcctggactctggcccctggcatacagggcttccaatggaacaggagacagtggtgacactttaaccagtctgcagaactgatccccagcccagctgggcctcatgcctctgacaacccaacagtgtggagcagacccacagagagggagacccagagaggtgtgcagtggcatggaaggtgcggctggaatcgggggctcctctgaactgggatgggtcaagctacagggacctctgtgtctgtagcagctttgagaagcctgggagactcagaggatggggtggggaagccagccagtagccaggggttggaagggagaaaacagagacctttggagcaggaactgggtgattctgggtctgcatagggtgaggctgctggggactagacatcaaggggtggtggggttgagggtcatcagtagctgcaggtcggggggtcctgggttgtgcggggtcagtataactgagtggtcaagaacttgggctagagttagtcagacctagatttgaatcctagctgatccatacttagaagctgtataatattggaccatttatttcctgtttctcagcctctgtttctttatccataaaattggataattatagaacatttaacagtacctgctttataggatccttgtgacataataaaataatatatgcatgatgcccagctcataagaagggaaggaacagagggtatgctgagagacgaaggcatggggaggaagggcaggtgacatgcagtccctgagcccccttctaccacagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcggtaagcactcccatccccctgcagccacacagggcctattggtatttcttgaggtgcttcttcatcttttgtctcctttgagacttctccatgtttgacacagtcattcattcaacaaaaatttgttgagcatatagtagacaagattttgggccctgggagtagatcagtgaaaaaaacagacaaaaatccctacccttggggagctgacagtctagctgagtatgacaataaatagtaagcacaataaattatttaaaataagtaaattatttattccgttagaaagtgaggccgggcatggtggctcatgcctgtaatcgcagcatgttgggaggcccaggtgggcagatcacttgaggtcaggagttcgagactagcctgaccaacatggagaaaccccgtctctactaaaaatacaaaattagccgggcatggtggtgcgtgcctgcaatcccagctactcaggaggctgaggcaggagaatcgcttgaacccaggaggcggagactgtggtgagccgagatcacaccattgcattccagcctgggcaacaggagaaaaactccatctcacaaaaaaaaaaaaaaaaaaaaaaaaaaaaagtgggctgggctcagtggctcatgcctgtaatcccagcactttaggaggccaaggttggcagatcgcttgagcccaggagtttgagaccagtctgggtaaatggcaaaacccatctctacaaaaaatacaaaacttagttgagtgtggtggtgcatgcctgtagtcccagctactcaggaggctgaggtgggaggatcacttaagcccaggaggtcacggctgcagtgagtcatgatcgagccactgtactccagcctaggtgacagacgagaccctagagagaaagagagaaagaaagaaagaaggaaagaaagaaagaaagaaagagagaaagaaggaaggaaggaaggagggagggagggagggaaggaaggaaggaaagaaagcaagcaggcaagaaagaaagaaagaaaagaaagaaggaaggaaggaaggaaggaaggaaggaaggaaagaaagaaagaaagaaagaaagaaagaaagaaagaaagaaagaaagaaagaaagaaagaaaggagtgaaagttggccgggcatggtggctcttgcctataatcccagcactttgggaggctgaggcaggtggatcacctgaggtcaggggtccgagaccagcctggctaatgtggtgaaactctgtttctactaaaaatacaaaaaattagccaggcatggtggcatgtgcctataatcccagctactcgggaggctgaggcaggggaatcgcttgaacccgggagacagagattgcagtgagccaagatcacgccattgcactccagtttgggcaacaagagcgaaactctgtttgtttgtttgtttgtttttaaaaaaaaaaaaaaaagctgggcgcggtggctcacgcctgtaatcccagcactttgggaggccgaggcgggcggatcacctgaggtcaggagttcgagaccagcctcaacatggagaaaccccgtctctactaaaaatacaaaaaattatccgggcatggtggtgcatgcctgtaatcccagctactcaggaggctaaggcaggagaattgcttgaacctgggaggcggaggttgcggtgagccaagatcgtgccattgcaccccagcctgggcaacaagagcgaaactccgtctcaaaaaaaaaaaaggccgggcgtggtgtttcatgcctgtaatcccagcactttgggaggccgaggcagactgatcacgaggtcaagagatcgataccatcctggccaacatggtgaaaccccgtctctaataaaaatacaaaaattagctgggcgtggtggcacatgcctgtagtcccagctactcggaaggctgaggcaggagaatcacttgaactggaaggcagggagcagagatcgcacctctgtcctccagcctggtgacagagcgagattccatctaaaaaaaaaagaaaagaaaagaaagaaaaagtgaaagttttaagtgctatggggaaagaaatcaagtgtgataagggcatcaggagtacgagggtgaagacaggttgcagccctaaatagggaggtcagttattattgagtaaatgagaccaaagggaagacttgaaggagatgagagaattagccatgcagagacctgggggaagagaattccaggaagaaggatcagtcagtgtcaaggcctaagtcaagaaggttagaagagctagaaaccatcaagggggaagagcggcagacatgaagagactgtgtacggacaggaagatcaggtgcagctttgtaggccatttttagaatttgagttgcgttttcctccgagtgaaatgagaaactgctgcagggttttgagcaggggaatgacaagctcttatttatgttttaatagagcctcccctcccctgctgctgcactgaaaatagatggggggtggggggaagggtgcccctgcagtatttctggctcagaccagttggcggcagtgaggtggtgagaagtggtcagattctgaatgtattttgcaggtagagctgacaggatttgctaattgatcggatatggggtatggagtgtgggcgagaaagaaaggagtcaaaggtgacaggtgactctgaggtttttgccataaggaactggaacgatgcattagccactgagcaggaaagactgtggtggaaggggttggggggagagcagaagtttgcttgggacatgttgagtctgagatgcttattagccatccaaatgtgatagagggggcagtcaggtacacaactctgggtttgggagaaaggtctggattggagagacatttgggagttggctacatatagatggtatctcaagccatgagactagttgagaccaccaaaggagtgtaggtgaaatgacggagaagagaacagggtatctaacgttaaggggaggaacaaggaaaggagactgggaaagagcagctagtgaggtaggagtcaaccaagagagggtgcagccctggaggtcaggtgaagacagtgtgtcaaagaaggatgtatgttcaggctgctgatgggccaatagaggaggactgagcattgagcattacatggagcaaaaacacagaggttcttggtgaccttgacaagaacagatgcagtggagagatggaggccaacgcctgagtggggtgggttcaagggagaatgggggaggggaactagaggtagcaagtacagataactcttgcgatgagttttgctgcaagtgagagcaaatactgggactgaggggaaaccaggagattaagagaatttttttttaatgatgaaagaaataacagtaggtttacctgcggatggggatgatccagtaaaaaaggaaaacatggctgggcacggtgactcacacctgtaatcccagcattttgggagggcgaggtggatggatcacctgaggtcaagagttcaagaccaacctggccagcatagtgaaaccccttctctactaaaaatacaaaaaaattagccaggcgtggtggtgcacacctgtaatcccagctactcaggaggctgaagcaggataatcacttgaactggggaggcagaggttgcagtgagctgagatggtgccactgcactccagcctgggcgacaagagtgaaactccccccgtctcaaaaaaaaagaaagaaaaagaaaaggaaaacatgggtgtcacagaggaccacagaatggcttaatttatgtccttgagcaggtgagaaggaggagacctagtgcacaagtggaaagacagatagggaccgaagaatgagccaacctgctctcggctagcagctgccccatagcagtgcaggcatgggatagaactcagctctcctcagtccatgaggcctcctagctctaaaagcccgcacccaaacgccctcacctggctcccagcccctgccctacaccccataccctggggtagccgggcaagcagcacttacatacccatgcccatacagtgcccatacatgcccatacagtgacctcaggcctggcggagggcactcccctccgatttccacactgctgcctccccaaggggatggatgttggcttgagagggaaggggagtctgtgatctgtgggcaggggttgcatcagggaataaagatcaggtaacaggacgcctgtggcgtgaggcgttctgagaatggtaatgggttgggtttggttgcctctcatgttctgggggaacgttgtctgaacgtgaatctctggttctagggccagcatctcgctccgtggagcgcctcaaggagatgatcaaggccgggatgaacattgcgcgactcaacttctcccacggctcccacgaggtgcgggacgggccgccgggcagtgggtggggcaggaggatgcctcgaggtcctggccaccttcccctgaaaccctcgctccgctccctcccccagtaccatgctgagtccatcgccaacgtccgggaggcggtggagagctttgcaggttccccactcagctaccggcccgtggccatcgccctggacaccaagggaccggagatccgcactgggatcctgcagggggtgagcagtggggctgggactcgctgggccagggccggaaaggcggcgcccgtagggttgggcccaggcgtgggcaggggcgggtcccggactccggggctcagaactcacatctcctctggctccctccttagggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggtgcggacgcgcctcccgccctgaccacatccgtgcgctgggcacattcccttctccttggctcccccatcagccctcagaccgatcacaccttcccctggccacgcgtttttgccagcccgtcccaggagtccccagcgtgtagactctgcgctcaccctgggtttgggctggactatgggtgggtcgtttcttccacggacgtccatctgtgcctcttccgggcgaagcccagaacaagggcggagagatgaggaggacatggttcctgacctcttgcgggtccaagccccagtgtcctctctgctgcaactgtgccccgtcctcacccctgaccgcagctggctctttccatgtccgcaggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtgaggcttgggctctgttccccttcggccctgtcgctattccccatcacctttcttctcctgcctgcctctgccttgattctcccaacctctcaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacaggtctggagtgaggccttgaggttcggcactctgtgggttttagggacacctgtgggtgaatacccacactgtaggggtttattttgttttgttttgttttttgagacggagtctcactctgtcatccaggctggagtgcagtggcgcaatctccgctcactgcaacctccgcctcttgggttcaaacaattctcctgcctcagcctcccaagtagtggggattacaggtgaccgccgccatgccaggctactttttgtattttcagtagagacggggtttcaccatgttggccagactggtctcgaactcctgacctcaggtgatctactcgcctcggcctcccaaagtgctgggattacaggtgtgagccactgcacccagcccacactgtaggtttatagcacatttggatgaaaagtgtttgatcctcaaacgacaaagttaaatatactttgacccctattttcaggggttgtgaccaaacgacaaagttaaatatactttgactcctattttcaggggttgtgactgtgaccctggattttgggacactctgagagtgtgggtgtcagagaagtagcttgggcagggtccccagtcacagtgtgagtcctacaactttgacatccacgctgtcccccagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcggtaggagctcagaatgaaaagcaaatgggccagggaaccaaatcccttccataccccagtgccccttcccagactaacattctggcacctgcagattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccggtgagggggatattgggaatgtccagatggagctttgggtcaggggtgggctgggacgggccccaggcttgggtttagtctggtcaccaggggtgaagagtgtccacctgagacaagaggagaggcagcaatgacagctggaggccaggagagacagaatgccagtgagcttctgggggctggaaggggacagcggcatcactgggcacattggcttcaaggccatttgggcttctggggctcagaggcaagtccattcggcccacagagcctaccaatactgaggtattacagaagggtccagtaggtctgagtttaagtctttactcagaaatgtagctctattagcctgctctctttcctcatgaacaggacaaggtaatgatttgttcttcatggggttggcaggattaacaggagatattaagtactagatagtacttaatatctatatagtaaattaagcacataatggactttctcaaaagggttttatactcttgggtttttgtttgtttgttttgttttgtttttcttttgagaacggcagctcgctctgttgctcaggctggagtaaaatggtgcaatctcagctcaccacaaccttcacctcccaagttcaagtgattctcctgcctcagccttccgagtagctgggattacaggcgcatgccacaacgccctgcatattttttgtatttttagtagagacagggtttcatcatgttagccaggctggtctcaaactcctgacctcaggtgatccaccctccttggcctcccaaagtgctgggattataggcatgagccactgtgcctggccagcttttatatttcttaaagagatttctccttattatctcatttgatatatctgtattatctcatatctttcttgtgtggtagggagggcaggcattctttctttttttttttttttttttcttaatgcagagatggggtctcactatgttgcctaggctggtctccagctcctgggctcaaacaattctcccatctcggcctcccaaagtgctgggattacaggcatgagccaccgctcccggcctgggaggcaggcattcttacactcattttacaggtgagaacaccaaggcccagagaagtatgatgacttacccagggtcacacagcttgttagtgacacctggaactggaacaaagattctcctttcctcgttcaccactttcttgctgttctgggctgaccttctctgcctcctccagctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggtgagctacctagaccttccctgccactcctaccatttgtatcaggagccccccaacccagcttcccatacccactcaaagggccttgcctctctcctgtggtcccaggttttccctgtgagagtcactaagactgagatatcagtctggcatatcacaaatacctcttccatcagcatagccacacaggcagacggccgtgctacttagcaacacactctgccctagcccacagatactcctgcacctttttttttttttgagagagagtcttgctctgtcgccaggctggagtgcaggggtacgatctcggctcactgcaatctctgcctcctgggttcaagtgattctcccacctcagcctcctgagtagctgggactacaggcatgcgccaccacgcctggataatttttgtatttttagtagagacagggtttcaccatgttggccaggatggtctcaatgtcttgaccacgtgatccgcccgcctcggactcccagagtgctgggattacaggcgtcagccaccgtgctggcatctcttacacctttaatatactgcagtggtcacattccctgcatgccacccgtgggacatacttcactgcctcattccctacaggatggccttgatgtggtgaaaggtggtggctggttctcgttacagggctggcctggtccctcaatgactaattttctttcttttcttcttttattattattattattattattattattattattattttgagatggagtcttgctctgtccccaggctggagtgcagtggtgtgatctcggctcactgcaacctctacctcctgagttcaagcgattctcctgcctcagcctccctagtagctgggattacaggcatgcgccaccacacccagctaatttttgtattttcagtagagacaaggtttcaccatgttggccaggctggtctcaaactcctgacctcaggtgatcctcctgccttggcttcccaaagtgatgggattacaggtgtgagccaccacacctgtccaatgatttgttttctttccctcccccaggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttccccaggcttggataccttgggcctttcccttattcctgcaccaacagcaaactcagaaggaaaaaacaaaacaaaactctaaaggtaaacacggtccttctccctctctcatgtggctcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatgaataaataaacaagcgaagaaaaaaatatcacacaaggattcagccatttgcccctccaccgggggggatctaggctggcatattaataaggaggtgccaactaccccttaacttttagggggtcacgactggggcagagggtacagggaagaggaagctcgcagtttacaaaaagatggtctaccacaggacagagactgcagggaacttagaagtatgttcccactcagagggtagacacagagtgtccacaggtggcagtgagcgggtaaaagtggatacccacactcagggacccaagacatctgctgacagcaatgggggcacagatgattggcagtgcctggctatgctacaggaacaggaagataaccagaccgggcagaacctgcaggatcattggcagggaaacagagacatctagttacttggcagtgatggcagtggcaagtacttgtgcttagtaaaggtggggtcatgggcctgggcctgcacctggcaggaccatagccaagggaatatccttgtcagagggttttgagtcacttctacttggcagtggagacatacagcgcctggcatattaccttgaacatggtagctgctcagtacacatgatgaacgggtgaatggattatgatgggacaagctacaggattcttgagctgaggacacagagaccgtcttcatggcagtatgcggaatgtccgcacagggtcgacatttccatggggcaatgtttcaggtccccatggccttccccaagaggcatctgcccttgggtacatactactgcaccccaagaactaaggctggatgtactcaaaggttttacatgttggcagaaagctggagaccccggggtgtggctggctcaggcactggtggcctggggggctgggctgtccttggaggtttggccaggagccctgagggaggcagccgctcacttcctgatcccttacgcccaggagagccatcgcctgttgcccgctga

SEQ ID NO: 11787 - DNA, 50878 bp, Human
cccttctatatcctagaataggaaaattatcgttatttaaagatgtaattaacatttattatggctagcatattaggttttagataggccaaatgtgtgatacaatagaattgtatttttatatgctgctgtgtatactttacagtacattggggcccttatataatcggtgtgcactgtactttaatgtccattttataggacttttataagggaagctggatgatgtggtggaatgagcactgtgccaggagtcacaaggcctggttaggatgcaggctttgccacatattaactggggcattgcaagcaagctacctcctctcctaatcagtgaaatgcagtgcttggctggatgaagtccaaggctctgtccagtcctggcggtctatggctagaggcagaatcttacaatatgaagtgataatagaggtttacaggtattttgtacacatctatgacatattttttatcacatctctggtttacttgaggttaagttcttaggaacagcgccctcaataataaaactgtttctattggaaactataatctgctttacaataatctgctctgcaaattgctactaggaataccttccttgggaaagctggggctccccgcatgtaacacccacatctcaggagttgcgtgagtgaccttcatgtacatggtccctgagacagtcattcagtcttcttgatccttcctcgacataaaattcccaaaaagaatagatctctgattgtcctttcctctgtagattagaagagcaaactaaaagtaaaatatgtgagctgtgagcggcagcctcaaatgacagcaagagtgacggctgtgatagtgtcacacactggtggaggccccaaaactaagaaactgaccggacagcacgactacacagttcagtaatggatgtccagaatgagaaacccagggcatcaagaagtacagcaaatatgttcagtgttgtttgctttaggaggcaaacagaatgcgataccttttagaaagatttccatcaaagtaaatacttaaaaaaaaaaaaaacactcagctcctgttacacaccaaattcactgatgtgggctccctccacgcctggagaggatgctacatgaataaagcttcactgcacatgtgtccccaggggtgagtgtatataggggaatgcacacagtggtcccagaataataagtccagagtgaaatttcagggtaaagcagcttttcaatttttcagtgaggatctggttaggatccgagttagatttaatttaccttaaattaactagcattcacgtattcacctatttaaaatattttttattaagcgcctaatattatgtgtgccaggcattgttttagaggttatagtggagtttcagagaggatccgctgttcacgtggtgttttaccggggtatactcatgaacaacaaataaccaccggttttaccaaggcatacccactgtgtggtctgatatcccaagtctgctccttgatgtggccttactgcccctaccccactttcttcagaggaagctcctttagagtagactgggttacccccataagatggagcactcctttggagcaagagctatggttctgccatcagcccgggagcctccaccgccggggttggtctctgctatgacctcagtacagagggagatggacgcctggctctcctgggcagcctggtcaagaaagactcctttctttcctagagagaggtctccctcggttcctgagctgagcacatgctttctcagtgagccggcagaacaggacagaggggcgtctccctggggcctcaaggcttgcgacgtttcttgctcatggggagagggaagggagagaaaaaaaagagcgagcaggaaggcgcccagcgtcccacacaggggactcgcagccctgcccccaagagcgctggctccgcagcagcagtgccctgcagctccgcgtctgagcagcagcagcgcgcggcccggtggagtgggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggtaaaggctcggcccccgcgtggtccgtgcgcccctttccagagcaccctggcccagtggcggggaccaagagacgcacgcatccccggggatgaggggaggcgaggggctgccggccccaggcagggtctacgcacctagtgcgagcagccgagctcccagccggttctgagctggtgtaaacgcgacccgaggctggctcgacggccccgcgagctcgatggcgcgctagtgggcaaggatgggtggttcaccgggacacagccaggagcatgtcccagcgtgccaggaggttgaggatcccccgcgagcggttctcctgtccctgagccctgggtctggacggctttctctttcggatgctgctctagggatctgccctgcatcctgtctggccccggctgtcctggggcccatggtccccgcgctcgcaaacggttgtgggccacccttcacccttcctgggcttgatctcctggccttcagctggaggccgatgcccagcgtccaggccaaggggaaccccagtccctgtggggccgcgcatgagtatccgcgagcggggtgagggagtcgctgagacaggagtgcagctcaggagaggcgctgcgggacgggaaagtggcacagggagcagggacgagggcctggaactccagggcactttatcgagagcctcctgaaagaggctagcctagttggaaggccgccccagggccagtgggtcccttgacgacagggaagggggtcagggatgctttctttcccgaatagccaatgcagaaatcctctttcccactggattcttcttaccccacccagcttaggtagaaacaagtgtctcatggggagagtacggaatggcaggttggaaatccccccgggccccagggagacctccagctgaaccctcacgggcacttttccaagctggatcccgggcctggcaccccctcctccagcctctgagaggccagatcccatgactgggggaacctgggagaaaggggcagcacccaggaaactcaaggaggaaggggcagtacctgacaggggagagcttatagaccaagtaaacactttaatacaaaggatgcctggtaagaattacacacaagtgagcaaagattccacttgtttatttatttacttattttatttagctaagtttagtaaaatgctaataagactttacccattaccaaacagtacaggtcaaccaagacgtatgtattaagacaggccttaggagagagtgaggggcagggggtaataaggtggaaggagacaaaagaaaccgaccctggcccttccaccacacacacacacacacacacacacacacacacacacacacctcacacttccttctacctgtggcttctgtccccccacctactccctagcccccattcctgagtggccccttgtagagccgagggaaggaaaatggccggcagaggacttcctgggccccagacctaaaggcctttgcttctctgtgtgctctttgcctttgtgtgggctccaggctcctctcgtcacatttccactcaagatcatgccacctccagagcacttgcctccttcccttttatttggtgccttggtaggtgcctcctagcctctttagaattaggtttggaataacaaagtgcccccatttctggctacagcccagagcacagctcaacctactctcctctctgcacaagacttggctgtccccttcccactcccactccatcccagcctgagctcttggctcacaactccagaaaactcaaacctgccctgggtgccccaaggacccctttttcctcctacctatcgggatattggctgagtgtctgtcagcaagaagtgcactttctgggcttggtctttgtggggaacttctatctgataaggtctcctttgttccctctttgtttttcctcccaaggtcccccagggggcttcactgggggagggttgatgctgatggctacctctccagaaactccaaggtctagccctgtgggcgtgtcccctctaccctcagactctgcggaggttcctaaaggaggctgcagaggcatccttgctggaagaggcggtttggtcacttggagctggtgtttctggtttatctggcttagttttcatcagatttccttgtcctctccatcagaaacacccaaacgtcccctatttgctctgcggccacctctactcactctgctccctctttcttatgctggtttacctgtcaggagcctgctttggttcctggaatggaatgagctggtagctgtggaaggaccatgccccaggcgttttccctcgccccctggacagattcaggttcttgtttagtctcttccaagagcagagtcagtttacctagggtcttcttgagccccttgaatcccatccaaagtttccctagttaagaagggccaaccataccccacaggttgcctggaagagtagccactgctccttgtaccccaggaaggacagtcaggaccagccatccttggtcctgtgatagaagtggcttctcagttcctctccactagtgctcttttctctcttgtcactgagggagtattgagccactgaggactggaggaagggcccctggagcctgtcacaaaatgcctgtctgcactcatgctctccctgaaatgccacagatcagacaagcaccttgccctggtcatgaaggccccgggcaggaagaaggtggcttctgtggcctggagaccttgcagaaggaggttgctctgaacctgcctacccatcttgaactgcccctgaagtattgctcccctgtgttttcaggctgtccctgtgtgcctcagggtgtctggcctccttttcttcccagactgtgtggaaggcaaggggaaactgagggggatgtcaccacccagcaaaagatctttgccagggaaatgacctccctgaggatggggaaggaaacacttatccaccttccagatctttataacttcacttggaatctcttcctaaagctgaacctgaatctcacttgccctaacccaagcgctcccccgccactgtgaatacagatcatacccagctcagtgaaaggagcttcctttcacctgtcctgtctccttccagggaagtcctaacaacaccagcaccattgcctgctttgtctcactgcctgcttagccatctgtgattttttatttcagcctttggcctgaaattctctttctcccttcttcatagaagtactgtttcccatctaaaattgctaagcctctatttctctctgatcagaggtaggggctggaggcaacattgagccaggggaggtgcctgctccctttctgtagttcctgtgtctattcagccctcatcaggggagaggggggcatgcttgtacgaactccgcagcctgcacagtgaaggagctcgcctcaggagcccccactttgatggctttttgtatttgtgtttgactatgtctcagcatgagcttctgcccgagtgttctgctcattagagtttctagaaagttgtcctttcctgaccacaggcatcacttctggggttgttttcttgggaccgaagctgagattgcagatggtaatggctatgtgtgctttagcttgttccattggcgaaacataccaattaaacttcaaatgaaccaattcttgtttctttacaatgtaccttggcttgaagttggagttttagccagaatttccattggcctgttacaacacatgcaaaaatgctgggtattctagggtgttttgcagcaaatgctgcttctctggatcctgctccttgacagagattttttaaaagtacaaattcctcccccgaccccataccattgtaagtatcattgtgccaattgttctaggtttagaaatctgggaagcgcttctgcgatgggccgtgacccttacaagatgtgtaatgtttgaacaaaataaaatggacgaatattagatatcttcatgtgaagttccttctaggcatacgctggacacatgcgcacacatgtatacacacataggtcacacatgcatatatgcatgtatacacaatacaccccacacatgaatccacacacccacacatgcacacacgtacacacacataacatgcacacacttatgttatgtgtgtgtacatgtgtgtccttgcagctgtgctgtgtcaggagcccagcctggcatctacctggtgtgcgatcttggacaagtcgctgcctctctttgggtctctgcagctgtcagaggttggattagatcatctccaaagtgctttgcaatgggaacactctttggaaatagattttataactctctagctctgcaaaccatttgcccagaccgccagcagctgttctgccaaaaagctcttccccttaaggcatgccactcatcgtgtctctctcgtaaacatcctaacatattaaaaagtcttctcatccactcttctcaaacttggctacatattggaatcacctggaaatttaaaacaacacaaatgcgtgagtcccacccccagagattctgacttagtgagtatgaaggatggcacgggcatcaggacttcagaaactcccaggtgattctcatgtgtagccaagttggagaaccactgttctagtccctgtccttcactcacacagatccagcatgggggagcacccctatacaatgacatacacccatgtctttctctcatacacacacacacacgcacacttaatgtagtagttgctggcgagagcctttgactctgaaccccacctgaacccgtcaacccttgcccactctaacccaccaccctgccccctcacgcccatcctgtccccacaggatgctcccatgctctgcccagtcctcaggcttggtggtggccatgaacagatctgctgaaagagcagcaggattgtggcagagctaggtctgaacgcgtcccagcagagcctgagggagtcacatgggctggagagggagaagagagaacacaggccacagcaacccagtttgtttcagcatttctgttcagtacgtacacccaggaaaaggtcaagagccacaccaaagtgcccggtgaggctgtgctgaactccttgccctccccatctcctagaagctgccaagttggggaggcatgtccacggtgctcccagcagcccagcagagggggcaggaggctggccagcccagtcctccctccaggagctggaaccatcccgcagacacagtccactcctgcccactccgaaacacctctgagggtattctctcagcagtagcttcctggcagttcttgttatctcatttaaattcctattgctgtgggcctagcttttctgggcaccatgggtgaaagagatttcagagggtgaagtaaaggcattttcaagactaaaagaaaatgagcttcctttctcaagcttttcatgctgaaggacaggtgggctttattcaaatgtagaatatgctagaagaagcatcggccttaagggagacagagtaagcaagaatgtgttccgagcagcttgccctgtgacgaaggagaaggatttgaggggagggaaagtggaaaaagcggatttccctatgacctctgtctgcaggaaggctgatgtcctgagagccttctctatgtagaacctgggcctgggattgggggtgtggagtgtggatctaccaaaggtgaagattccttgcttcagggagctcccagcttggttggggagacccaggccctaccttctgggaggagtgcacacacacacacacacacacacacacacagtgtacagaagccacattccaaggagcccacaagccagtgcagagtcagccgctggattgagtgctgacatggttatgctggcaagtttggagtgctcagagctgggtgcggtcatctttaggagaagctgatttttgtgcaaggttttgaatgcagggggagggttggagaagaagagaaagaatgtttcaggtgcagtaagtgtgacctatttgaaagcttggaggtggaagaggatgagtcatccctgcaaaggctcacctgcccctactggagagagatttccactcatcctaaagaaggagctgcctccagtttcaaaggttttgaggcgagaaagcttgagttgcaccgatgacacaagaaagaatcagcctgtcgttgtctaaggcaccaaagggaagcagtgtgccaggacactggtgacctgagcggtagattttctgagatggttttacaccctaaaacgcggatgtaaaatcagacgagctatgtggacagagcaggttgtgttgcttgtatacctgggaaagtggcagatgctctgaggcacttgctccttgaccttggggttctgtgggtgggcagatgcttcctgaggatggcacacaggttgggcacactgtcagtgtcaccgagaagccaccacatccctgctcatgctgcatgcacccatatggggagaagaggggcaaagcagatgcttagctggagggtaggagtgattctgtggggtgagctgggaactagcccctcccccattccccaggaactaagaatcctcctcaaagaggtggccttgggtatttgagagctgcagcagccctcctctcttcctggtttaccccactcaccagggacctctttgagtgggaggagagcctgaccccattctaagcctctaagcaccaggcatcagagcacgttcaccacaagggttgggcaagggagaagaggtcattgacgcaaagagccagctcaagccagtcaggcccagacccagctggggcaatgccctgaactcaaggtcccagggaaagaaagacatggttcgcacttcagagagtgtccaaagtacatggtggtggagacttgtacgggcgtgagatggagatgggagtaggcatcattcatcaggaaaggcttcctagaagtgcattctagagacatcggggaccaagtggaagagtgagctagcaccattacactcattagaagcccatgctcttgctattgaacttgacttttagagggcattacttaccagtcagacaccccagggtcaagagagggaaaatcacttttgttgtgggagcagtgctcttacagacagagcacacctgcccccagtactccttggttatctggcacactgcgagctgtgatttcaggtgtgtgacaactatggacttttcccctctctcaccacctccgccccaaatactgtcaccttctgccagattagcagtgcaggcaggtgtgatgttaccctcattctcaccagagccaagcagaccccaactacagataggtcttaggagatgccttcaggaactgcctggaagggcctgcaggccacaagtgagtgacagtcacacctgcctttaccagagttcatgctggacatggggactggctttgggaactgtagggcattctggcctctccctccatgtgtctgtgtgtccactgccacctccatggcagagaggcctctaccttcatacagagaagagtgtatgagagggaggcaggcaggtgcagggtgtggcgggaggagatggttcgtctgatgacccatggggagagcagcatcatgctgacaggttctctcccagaagacgggcaagaaggccctggtgcaagccccccggggctgcttctcatagcaggaggcctccccggtgctccataaagttctgtctgtcaccaccccaaattttccacccagaagcagctgactgacccacacctgacctttggtgagaaatacctgctcacagggccagatccaaatgaactctatcctatcaaaccttggaagaatgatcaaagtgggctgggtggaagggaggcagacaagacctggtggttggccacctagggtcctgactatgagtgtgcctggctgcagcccccttccttgggagcaccagtcctgagtgactgagcccatgagattgcctccagcctcttcctgataaggacagtcttgccagaggagcggttgctggagaaaggtggaggaagagctgtgtgcactctacagggagcttggaggaagccagaggttcaatgggccacatggcagagtcccaggatgttgctcataggcggatggcccttctggagtcagggctaggcctggagtataggggaggcctctcagaggaccctgaggcaggtggcaaacgaggcggtagtgtggcctttgatgtctgcccttcttccttgtaagctgagctgtgtctctggagaggaggagtcggctcctctgaacgcagtcaggcacgtgtcactatcatcacaccaccacagggcagtggaactgtacggggcctatgggaggtaagaggccaaccctctcttttgacagaagaggacactgaggctcagagagagcaagtgacttgcccaggtgccagaaccaggacaaatatcaacaccgctaggcccccagggcaagctgtgtctgccacagcttgagacccctaatgtccatgatggaagggtgcagagagttgggcagcactctctgctgtgggctatgggtggtgacctggcgctggacaggggaggtggcacgaggtggggatccctgcctcattccaaagctgccccttggctattccctctactcccagctcagatattccagccctgctcccccaggcaatggccggggagcctaagtgggtgtggcagatggggaggagctaccttggccgggtgagatcactgcccaactctcttccccacagacagggtttccgatgggggagtctgaccatcgctttagagaaaaggagtgcatatccctcttaggaggctctcactggatcccactcaccttcatcccccaaggccatcacttaacaagagtgtgggccaggccacggagccatggcttgctcttcgtggagctcccagtatagctgagggaatgggacgcagggcagaatgagacttgggctaccaagagcaggacagtatgtgtttagaggcaggagagattgccttgtgcagaactgatcagaaagggcttcctggagtgggtgaggtcttgagcttggcttcaaaagatgagcaagattagaaggtagtggccaaggagggaaggcaggtttggcatggagggagatgtgagtaaagtggtgagcctgtcaccattggccatatttcaaggacagcaggacagtgaacagaccagcttgtgcagagttgatgctatcccttagggtgtccctgctggccagtgaaagggagatgaggggggtggccccactaggagccccaaatccagttctgttttctgtgatgcaaagccactttgccactaataaccctaatgacactctgtcctcctgcggagcctgtcatttgtgggtctccaagcactccgaaaacattaattaatcctcactgggcctttgaggttgatcgccgctcccccttcaccagccagagcatgttagaggtgaaagaatgggaggaagtttggtcactggtaggggctgggctgagatttgaatccagagtcctgtcctgaatcaatctctaatcagctgttgctgctggactgggaatgtcggaatcctgcctgtctcccctgagtgggaatcttatccttgtggaacatggagtgatgattccctgggctggaatggccgtgctccaaggccctccagaccaagtcctgacctgtaggtgttaacctacccaagcagcagtggagccactgggctcccaggaaggggacagatgagagttttagagctgtccctgcaggagtctgtggtagcccttcccttggtcccggctgtggaggatgtggagatagatggagatgacattccccaccttctcctccaggagctcagacctggtctcctccatgggcatagtggacctggatgcagaagtgatgccctgaggaacaggggtggatgaagatcatggccatccctgtcctaatcccctcctttctcctctaggttccatgtatgatggcttggctgacaattacaactatgggaccaccagcaggagcagctactactccaagttccaggcagggaatggctcatggggatatccggtaaggaactgcttccatcctaaaagacctggagtacttgtggggatggtttgaggtttatagtggagaaaaccggcaccagttgctaaaaagagtgatgtaggctttggtccgtgagttgaggctcatcaactctgactaggtctgttgacttggccattgtttcataggtggctctcgtttgggctgactggatatttttgaatgtctcaaatgataatattttaggaaaagcatttttaaaaggcatttaaaaacaagtccatttcccagtaggtctgatttgatcatggatttgggaaatgtttgcattcttgaggtctattaatggaccagtttagatgtttctaggaaaatcctaaagggtcatctctgttcgttctgtgcctatggtcaaagagccaagagaacatgtccactgcattgactcctgcatatgacactgcatgctagagtggagcctccctgacaacccgacacatttgggttcaaattttaactctgctactcactgagatgtggctttgggcaagttacttcaaactttgggactcagcttcttcacatggaaagtggatataacaaagaacttctggggtcattttcaggattaaatgaactaatgtacatgaaaaaagattacaataattcttaagattatttgttaaattaacatggatagaggttattttagatcctgtaatcctggctctgtctgctttctaagtgatctcaatccactatacttcatctatccatttactgaacaaatatttattgagccctaattctgtgacaagcactgcagtagatgctcaggatacaaccacaccagccagtgcaggaattttctgctgctctaaagtcaggagtaccgggctagatgacacccaaggtttctcctagcctccaaattctatgactttcatttactttcgctgatgcaacattagcctgcattattcttgggaattcttttgtaaggccctcaagacattgtcagatggggattaaaggctgcttctctgtgggaatctggggttctgtcttggtggggccttaggatgcagcagcatttgctttaagacacagatgtctcacagatatcactcctgattgactgtcaaaggtcctgggtcctggggagaggagagggtgaggagtttataagtttggtgttcttttgtcatttgcttgattcttccattcctgagttcttttgggggctaattttggaggctatgtctttcttacatattacagcttggggatgaaaggagacaattaactagatttgctgtgaatttacttccctcgcttttttcctgattcttgatggcaaatgacactcttagtgcaaaataaacccagcacactgagcccggtaaactgacagatcaagcacagatgtgaataaaagggcttttacacaaagggtgatgaccaaattgagaaaatggcttaggaatgcagcataaagggattagatgaaacccaaggaaggcagatcactgcaccagcagccggaatggatgattatgctgacagtacagatggtacgtgtctttacttaaatgacattaccagttcagagcttaggaggcttaggttctagtcctagttctgcccctctctggctctgtgactttagatagtttaatttctctgggcctcagttttctcatccataaaaagggaatgatgatactcgtgtgtctacttcactcacgggttgatatcagatgacattaactgtgaagtattatcaaatgggtaatgtaaccatggaaatttgtaaccaagaactgtaaaggaactctttcggggaaggtgtttctaaagaaaaaaaaaaaatcttcatttggcccatgttgaacatttcacttctggttaattaactcagtcctcagtcatctcactagcttttaatgctcccaaactgtcctcacccctccctgtgcccatttcctgacaaccagtgaaaatctctttccttctccccaccctaagacccaaccctccttactccctcgctggcaggactgcagacatgactcatggcagggtagctgctgaggcacgtcccatctcctttcagttcaggagaggctgtgggaagagggaagaactgagcacacatgaagatttggcagagggaggaggccaagtagggaggaagtggaataattgatattggagccagacatataatcagatgaaacctgggcaaaaccaaacgaggtccagacataaggagaaggagagcaggcgaaaaggcaatagagatctgtggcatgagataatcctatgtccgtgggattttcccatggatggtacaactggcacaggacgatgttattcctcccctctggtgaaaccaatatggcagcagaaggcagggagggtggggaggagggtgtagtttgtctgcacaagcatcatcagcatattttcaggagcttctgagagctgatgaaggatcatttgctgcagatactttatattcactcggtcagccaacttgtattgagcaattgctggggcacagcagtgagtgaggtgcgctacagaaacacagttgaaaagaatctgactttgccctcaatgaacctgcagtcaagttagaagcacagaggtcaacagacaaataagataaaggcattagtttctgtactggagcataacaccaatactgccattgctcagaatgtttctagaacccctaaaagttcagaactgtcttcagcatcatttcaggagccagacaagaaaaccagtctcatttctttattgtcatgacctgggtttgaccagaaacaatattactcacttggagcacctcactcctcagatctggctctagttctaaatatcaaaccattctcaaatagcaaagctttgtcacctcctatacatatctcatttaaatatgtaaaggatctgtaggcaattccaaaaagaaggctctaaaaatatttaaaaagcaatggtcgtaccttatagttttaccttatagtctatatcaataatagccttgtaattaaaaaacaatcatcatactatttataatctatgattattcacatcacaaattgaatgtagagagactttcttataataaaataaaacttaaaacaaagatagtgtgacacacaaaaagcatctaggggcttaaggaaaataaaagactgctccaaagaaagtcattggcccagtccatgttctgctctctgctggccaccccagcctcctcctccttcaggcagaaggatctgctggaggacaatgttggaacctcagagccccacagacctcagggagaggaagcagctggtgagatggagcaaaagatggggcaggttttagcctcgctgcctggtttctcagctgcatactcagctatgctcttctggttctcagcaccaaacctgtagaatattagagcccaacactgtttgcattttacagttgaggaaacgcaggcccagagaagagaaattactccttgaaggccacacagctggttactggtacagcggactagatctctgacctcgtaactcctaacctagtggagtttgttttcattaccccagacatttgcacttcttatgactgccattctgtgggtttccacaatctcaatatttgaacgttacaactaaacactaaacactaaagtttagggatctgcaagacactcatgagtctgaatccctccatttcctcccttcccatcccctccaaccaggcctactctcaccatggggagtcagcctagctcaaaagaggcaggagagaagctctgtttttcccttcctagactgaggctgggttcacttgggtataagcattaatgggtttcagggcagggttaccagataaaatacaacaaaatacaataattgagacatgtcttaacttagaaattatttgctgtttatgtaaaattcaaatataactacatgccccgtctatctatttgttaaatctggcaaccctctgtcaccatgtctccccactcattcctgtgataaaaacaacactcctttacgtgctcctctcctaggctagggacccagcagaattactttaggctgcagcatttctggtgagaaaaggaggatttttgtcccatcttagttgtccttgtaatatgtcccttgaatatcttcctctgggtcagcaaagacgaggatgcggggaatagagagctggagccatggaaaggcacagcccttcaactccaaagctgaaaacaggccttgatcacatgggtttgtcctcaatgaagctgaggcgtgtggacaattttgatttccagggaatggttctggattaagatgacactccttttgtctatcatcttcagctccaaagggtttacttatttttaaatcaagaagtgcaccctgagcacttcttctgggagtcctaccaagtaaaaagttcttaggtggcagattgccctacaccaccctgctcaggatctaatcagtagagaggaaaaccactgaggcatcatcagagggaggtctggaacagggtgaccatggtgactgccacattgaatcactcagttaaatccagcctggcatgcctaagagtgagaactcccagaatataacaagggagaattctgtctttgtcttggcattgtcctattcattgaccccatttctcctctttaacgcaggacttactagcaaatctttcttccagcttcttctcagttgtacttgcctaactgatatgtctgtatttgacgatcccattgtgacagagtcttgtggacaatgtgctaggggcccttaccctaaggagaactgatcttggccaccctagacctgaagaaatgtggatgaagcctctgttacagatgagaggactggggttgcatcacactccagcaggggatgggaaagccaagcacagtgctccccaggttggtggttcaccctcagtcacagccatgctaatcgagtgtccacaagggcagagccatgggccaggtactgcagaggggctgccggggagaaacacggtaggactcctaccctagcagcagcagaaacagactgtccttaccaatccgcagtcaacagaggccatgcccagagacagcccggagtggaggaataagccctggactttggccaggaacttcactagccatgtgactcttagtcaagtctgctccttaactagctgtgtgactctagtcaagttcttaatctagctgaacctcagcttgcttatctctgaaatggatgaaaattcctgtctcaaagagcagtatgaagtttatggatgtgacataccagatcagcagtgggaggcgtggattccagtctcagctgggctgctacaaactgagggatctggagtggacttcacctctctagaccctggctttctcaattatggagcaaggcaattggactaaagcacagccaaggactcacttagggttgcatgtggcttgagagctgactctgagtagctacagggagctaaagtctgtgtgctggtccctccagggtcagaggtagtgttaattcctccagcccagatttttgcttcaagcctacagatggataaaagcttcttaatttcctctttgctttcatctgagcactccaggcaccaggaaaacagcagttagttagcccttgcaacaggatgaaaagatggtaggacttcatttactttagcttcacagacagggaaactgatgcacaacaagtagctctgctgagtaactaccctaacttaaaacagacccaactccctctttccaaaccatgtgtctcagctccaaatgccactttctaggtgtatgagctgggttccttcggcagtgcctgccgggcctctcgtcttttcttgaaaagtccaggtgagggactgatagtagaccacagcctcctactcccaggcaggcatggatcctgctccaagagggagcaattgatgtgtttgccaactcagtgtccccgctgccaactcatgactcacccccacccagccctgggagataggagagtcctacaagggccccaggctctcaccccaacaagaagaggcaatgatcctacttgccaagggacagaatgtgcctctgagagaaaatggaggcaagtgagcgggagcgggcgggccggctccaggggcacccctccctgtggaaggagcatgccgtgtgctttcacagacaaactgctgccactgggacactccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggctctgcctcctggctgaggactgggtaagccagggaggcccctttagagcccagagagaatgtggagaaaaggaagaaacattggtctgaggcctggttccccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacggttccagtgaacaaatgcaagtggtgtcctccaagggcaagctccaggtgcaggaagtcgggatcggctcctggaggagctgagctttgaactgagtgtgcaaggagagagggctgcccttagcagacaggatggagggcagagcaggaatgcccctaggtctggactgtggtctgagagtaccttgctgactgttcacaaagcataggcatcccctgcaaggagggcaactggttccatgttgccagctcctgaggtctcctaagcctcccaggccttcatcacaaacccacaacaatgctcctcagggccgagtgagcacgctggcccctccatcctcctgccccagggaggagcaccagacccaggagagggcagactcccaccagtcactgtcctgatagtgtggacccttgtagaggaatggagagggaaggccagggcaatttggtcaggatgtgcagggagacttgtcactgctaagggactcagtgtggcagctgcttagcaagtggggagcaccaagctttggcagcccaggatgcgatcagcagcggatccttctcaggatgtctgcaggaaggaactccactctccccagagacaacagaagccagttctccttcctttagcttcactaatcaacaactaatcttcctccatcatttccattcatgttgtgtagagctctgagttgatggctaggctgggaacacttatgcttggatgggcctggggctcgatttcttccattctgatgagatactgtgaggcagacaattccctggccacagagaatggaattctgtcttctccggagaaggaagcttctggatgagtcggctgttgctctctccccttctcccctaatatgaaactttagagagaagatttgaagaatcaaggataattataaacttttttattttgccccagcagaaattggtggagtttcattttgggcttttttttttttcttttggccctgacaaaaactaatctactcaaccaaccagtatttaaagtccttacgctatagttgaaaacaaataacagacaaaacaacagcacaagaagatataattaaaagctaaattttgcagcacacgctaacttaaacctctccaggcctcggtttcctcatctgtcattgaaggcatgggaccagatgacctccaagccttgcttccccagcttcagttctgagtcttggacatctggggagggggtcttgggttctggatgagccgcaggtggtggctttcgagcctgtttcagctgcgctgtgtcctcagtcagctctcaagggagaagtgctccaacccgcggcacctggttatttaataatcccttgaattagtgtagcattttgaacttgtacaaactgcttgtgttttcatctcctgacttgatccttcagtctttgtgagctcagtaggtggaccaagctttgttattctcattttatttgcagggaaatcaaaccacagaaaagtgtaggggcttgcctgtgacctcacagatagatctggcagaactgagtctggaccccagtggactttgagcggggtgtgaagagcaagaggagggagggacctagaagggcagggggagaagtgggccaagcctctcctgctggccaagtttcgaagccagcaagcagggcatgggattaagtcatcaaaatacagtcctgggggtatcttctggtgccttatttctgctttgagagttttccttttgtcactagactcagcgagacaaatgcagcagaatttcccaagcgggtggaagagccgtccccaccctttgcaagggtgaggctctactttctcccccagggccctggcatgtctctacggaagcctgcctgccccaggagagcaaactcagctgaaaacaaaatcagctcaggcacggggaggggacgggggatctgtagagacacaggtggggagaaaagcagctctagacccggagcccctcccctcccgcccccacagcgtgcccaagggcgaggcctggaaggggatgaagacaggctgggaaggaggccgcttgtgacttcagcaaggggtgaatcacagactgccgaactgccgaactgccttccttcagaagaagccttacagggcatgctgtggttggggaaactgaggttcagagaggcgaggcgacggcctgaggctgcacagctaggcaggggagaccaagactggagcatggtctcctgactcctggctcagggctcctggtcacactggcacatcatggtacttttgccactacgggcaatcatgtttcccagacattcgtcatttgcattctactgtcacaatttttgcaaaatcataccaactattatttacttatttttaagggaattacttatcagttccactgcacttatttatttattcatgtatttattttagagacagggtctcactatattgcccagggtggtcttgaactcctggattcaagcaatcctcccgcctcagacttccaagtagctgcaactacaggcacgtgccagttttagagatggggtctcactatgttgcccaggctggtcttgaactcctgggttcaagcaatcctcccacctcagacttccaagtagctggaactacaggcatgtgccaccatgcccagctattccaatgtatttattttgaaaggaaactttatatcactcacccaaatgacaaaaaccggtatcttttgccacaaatgaaggctaaccacaaccttggtaatcaattataataaatagaataaaaacataacattaattctagctaggtacttttacctggcagaaaagttttatttttttgtttgtttgtttgttttattttgttttttcttaaaaagagaggttggcaaatattaaataaatatattaacacccagctagactttctccctgtggtaatcaaaatgggaaaaagaagtcctttctatgagtttcaatgttagatattgctgtgtccttgatttccctggagtcaccccacagccaccagtagtgtgttgccagcacttgggggagattccgggtcatatgctaatggctcaggataattttcccaaagcaggcaaggtaggagagctgaggtcctaagagcagagccatgaagtagagccctctcccctcaccgaggtgacctgccccacgcctggctgaacacttttttaactggcacatttaaggtggatgtttctgactgagcacctacagttctctggactcaccagggtctgctgggtgctatgccctgtgggaggattgccctctgtggccaacctggagagggcccccaggaagtccctaagcttctttcatatctacctagggtcctaatcagctctcaggaggccccacagtgctgggatctgagttggggtgctcacgggtagccagggacccattcctccctcctcctccttcctggccacgccagaagctcagcaagactgaactaattccagaagatccagggctcagcttcaggtaccagctttaacactagtccctgttttctcagccccagttgtgtgtgctcagtggtgcgtttagagtaccactaagggtggctggagaggaaccaaacagtcacattcccatcactcactgcaccttcattctcatggtcctggccaggacagaacagttatcatgaccacaaggtctccttgcccacaggcctggcatcccttgggacagatggtcttccagcccaggtctttgggcattagaattgtgacacatagctaagcaactacacacttcttaaatgtcttcaagaacctcccacagttggctcaaagaagaagggctggcacctcctgtgtctagaaccactggggatggggtcttccaggagtcggggccagcaactggccagagatgctagagtttctgtagagggccccctagctatagagactctttgccctgtaggctttgtttgtgtcaccagactctggtagcagagtggctggaagaaaatcactgtaagagacaccaaagacctgagtcctggcttagggtctgccccatcttagctgcgtggccttggaccagcctaaagttctctgagcttaatatgctcacaaacagaacaaagctgctgctctctgccctgccacctcattggccagctgggagataatcacaaggtgatgaacggggaagccctctgcacactgggaagtgccacaccagtgatggtgttcaggatatgctcaagcaacttccaaagaccttccctacctgagtccactttgggcatgggatgtgtgtcccacgtgggcaggtggggagtgcatatagaagtgtgtgtccgtgtgtgtgagcatgcatgcacgcatgcttctcttccaaaggtgagatctcttacccaagcactgaaggtcccagtcaagtgtctctcccttcatgtaaaattcttgactaacaggccaggcacagtggctcacacctgtaatcccagcactctgggaggctgaggcaagaggataacttgaggccagaagtttgagaccagcctgggcaacatagggggaccctgtctcataaaacagttaaaaatcagctgggcatggtggtgtgcacctgtggtcccatctgcttgagaggctgaggtggaaggattgtttcagcccaggaggtcaaggctgcagtgagccatgatggcagcactccactccagcctgggctacagatctgtcttaaacaagcaaacaaacaaaaactgtaaccagcaggagtggtttctttccactgttgggtctccagggacctcttttctgggccaggtaagcacctgcccttcaggatgctgccacctcccagcctttggccctcctcttcccagggctgggaagcacctcctgttccagtgcatggggtggctctggggccagccagcctctccctccaacttcccagtatagggtggggggcatctggcccagtgggatcttcctgaccctcaagggtgctcttctgaggtgctggctcgtcatccaggactccaggagttatttcatatcagaacggccccctcagctttccctcttcatgatgaaccatcactgggacaattgaaccagcctctgggtttgaaagccaggagctatgacctcagaacatggagctcctggagggcagaatgaccatgccttccacttctctggggccatggaagggagatggctgagggccagtggtcctccaccactcgggctgtgagagctgcgtctgaagtggcaaacgcctgccagggatttcccttccaaaaggaaacagacatgtctgtgtatgaaaccttaggttcttgtttccaaacccatcctagcagtgttcagagctgagaaaaacctatttctcaggtgtagagggggaaaggtaaaacagaaacatttcggaaaacctgttttttccacagtgcagtaaataggcaaggagcaggaagtggagacagagctgatgcaggagctggcatagttgcgtgttgatggagcaccaggtgtcggctaggcgctgggctgcacaagtgcgtgttgtccccacaccaggcttaggaactgccatggacctgacctttgcaggcaggcttagagcctggagcccaagaggctaagatgccttctttatcccagaattgtggcctcactggagaaagaagcatcttcccaaaagacccgcaagctacaaagttttataggatattttctacttagaaaagttgtcctcagttatccatagacatttgttaatactggcatgattgaagtatgctcacagtttctgcttttcaaagcttataagggatactgaccattattaaccagatctctggggaagtctctactctgaggatgggcaccaaaacttttactttttttttttttgagacggagtctcgctctctcacccaggctggagtgcagtggcgcaatctcagctcactgcaagctccaccttctgggttcatgccattctcctgcctcagcctcccgagtagctgggactataggcgcccaccaccgtgcctggctactttttgtttttttgtatttttagtagagatggggtttcatcgtggtctcgatctcctgacctcgtgatccgcccgcctcggcctcccaaagtgctgggattacaggcatgagccaccgcacctggactacatttttttaacatttaaaaaattcaggtggcaacatgtacctgcactgggcatcaaggtgtttatggcttctgctgtgccttctctcagtggacacttagcgacttcagttcagtagcacttagcaagtaccttctggagttctcacctgggtgggcactgctggtctcggggtgctggtgatggcattgtgggtgcagctccctctgcctttgaggacccacagtgaggcacacccaccacacctcctccaaggccaaatgggattgctctgtgtccaggcgtcaaggcttctgagcaatggggctgctctgcccaaagcagtgttccaggaaaagaaaggagggccagcccagggtggaaccccctgcttctcagagaaggagccgtgcccagaggagtcaggaggcagggatcgacacttcccctgctgaagtcccatctgttgtgactcaggcctcagtggttcccatgctgactcagactgctgaataagcaggcacccctacccctttgggaagattctcgaccgcctggagccctgtgtgccccattctcggcagccttgctcggggagcacctgtgctctccaaacccctagagagggtagagcagagccgctaagccacttgcgaggtgccccttgtgatgggtcagctctgcccaatatcccagtcctgactgaaatcccagcaagatgaacaagggtcactacatgcctactacatgagagcccctcatctgggcactgagtggggagtggcaggtactaggcaagtcgcaaatggaacctgtctttgaaagacttctaatcaaggttctttctccagcaagccctcaccaggcctgagaggcacgaggactccatgaaactgtgcgtgcactccctttcatgaaaagggccttgggagatcacgctgctgaagatggccctgttggacactgctgggtgtgtgacttggcaagcagaccagggtgtgtctcgctggagaaccggtttggccggccccaccctgctggcagaagcttggtttcaaaatgggctaatagctggggacacagacactcttttcatcatacccagctcccaaggagtccagcagcttctgtctgtccagctagagttggatagaattctctgggctcaaccacccagctgctttgctcaggtcaagcggtaaagggaagcattctggacatcacagctggaccccatgccgtgcaccggcacaggctgcctcaccctgcctagaacggccctacctaccgccagcccactttactcatggtgccttctctctcttctgtgccctggaggccatgggaactgcagtgctgtcagcatcctgaatctccacccctagcacaaattctcacagtcacagtccacctttcactgagctcttgctgtgagctcagccctgttttaggcatctttgccctggagagctcagggaaatgacagaaacctacattagcaactagaaaacaaacaagaccagaggcccctggctttaagggcaaataattccaactctggtcattatggagacagggctgggttagaacaggccttttggagatgacaggtggagaagaggccttagataaatgtaggatttgggaggctgcaggtgaggaaaagctgtccagggtggaggagcatctgaacagaagcagggagcctgggatgtggctgaggtcatggggcagcttagaggggtgtgctggggaggggaagagatggctggacaggcagggtggggctgggctggggagtttgtcttgtaaggagcagacactgtaggttctccagcacggcaagagctgatgaaagctttccctaaggaaggtggagtgatggcatcgcaaggcagggaccagagccctgggggctgggcaggggccagtggggggcactggagtggcctggtggtaagctgatgggacccggagtcagagcctgggcagtaggggtgtaaaagaggggagtcagtaaggactctctaatggaaggacaggaggatgccatctctttttgaatggttagttactgccctatccgatgatttgggcaagctggagcttttccagctttgggggccactccacactgaatggctctctcaaggggcaactggtcatattcagttctttgaggccctggatctggggcttgtattgcttcactgagactgtctccttgcctataaaggaggggttggcctctgagagcttcctgacttaatgagggacaggaatagaggggagctttcagtgtggggttaaaacaccccacttctccaagaaggaaggggagaaggggaattacacaagcaggcggcaaagcggggactggctggggggctcctagctaaaagcagcttttcctggctcacctcgggctgtgggacccctcaaaagccccactggtctcccaagtgaagaaacatgtctctcagaatgctctggatttctgtctggctgtccagtctagcctgctgtctggcagagtgaccaactctgctctcaggaaattgagtttccagcctctggaatgttctgatccatgggataaccagacaagaggttgtgtgtgtgtcactgtcctttgtattcaaacagccagacgctgccagcagattgctatctgagtgtgggggtgtggctgggagagccggcattggcggtgaagctctcccacctgcagcgggcgcacgtgcactgcccgtgcatcctcttctggctgcagctgctctctcgggacctggaagacagtgtttggaaacgtgtggggacattttgcaatgactgtgaggcattactagcatttagaacctggaggctggggcactaaacatcctgccatgcttgggacagcctatacaaagaattgtcctgcctcaggtgccgacagcacccaagtaaagaaacactgcaccattcatcataaagcctggcttcactcgaagtgccccatctgggcagaccatgctcctccacttttctgagacatatttagacccattctatgtctgtggggtgagactagcacggggctctgatactggtgcatacactttcctgggctgtcttggcttcctgggttcatcctctctcttatgacacctggtatcccatttaggtatgtcacaggtgacataaaatctctcctttaggagccaagtcctaaggcagccagcctgtgcccaatctaagagtcagagggatatgatgtccctaccgagcaaacactcatatcgtggactgtcctgagtgctttactaacattagttcattggattctcccaacaatcttctatgttggctacaattatactagttttacagatggaaaaactgaggcacgttgggcttaagtaattgcccaaggccacccattgggcaacgacaaggccaggcaggctggctccagagtctgtgttcttgaccttgggtcttcctccagtttgtagatctcagcccagtgagctggaggaagcacctggattcccaggcagttgctgccgtttcagccttcaaggctgcaggcttcatccaggtcccaggccaatttgtgcagggagagctggtggcagttcacctccttgtgccttggagggaatccaggccccctcatggtacttggggaggacggggtctgagaggaggctttactcctgcttgtcaaagtgacagcaaagggccatgatgatgggagagagtcatacccagctgtcgtcaggcagcacagcccaccagcaccatgacactaggagctggggtggggttcccaggaatgggtgacgccactagggtgtggctgatggtggtaggctgggaaatgcagtcccacggggatgtctctgccttccccaccttgcccgctcccctgcaggtgcagccaatgcccattccctgtgggcagcccacccttgctgagacttggcaaggctgccagctgctccttttcccagcacaggaaagcaaagcccaaagcctctgagaggctcaatcagcatgatcacatctttgctggttttgggccaggatgagtgtttggacttctcattaggtgtctgagatgacgtccaggcgtgtcgtttatggagaacaagggtgctccttgttgcatttccatttaaggcttagctggctctttgccctttggcaatgctgggcttccccctccatgttgtcatctgccaccttccttcccctgagaggagaatggagggtgtggccatttgtaaaggctttcatggcatattttgcctgtaatctgcaggacacgcattccatacccagatgctcagaaaattgcccagctgctctccccatgccttgtgattgtccatctatgcctctcccaacaaccagacaccaattctctttggagtaggttggttgacccagtttggggaagaaaattatgcctgcctgagtgcacagctgggcgtgtgggtgaaggggatgagcaggctattgccaaggttaacagtctgtggcttctgagttttgaatgcaacttctgactggtggtttgacacccagtctttctgggagctcaaaccatgggagtttcctgctgtctgtgactccctgcagagatgaaaaaggaccaagtcgagtgccagcccctccccagcttgtgtggctagatctggtgcagaagggaattacccagttgcctaacgacctcccctacacacacatactctctctctctcagggaggggcaggggtgggcgggcaggccctaggttgctgggtttggccctggcccatcccagcaaaggtgagtcccaagtcagcacctgtgtggagatgtttttttatcatacttgatgttgatcctctactatgagaacaagttggagcaggccagacccaccagcttgtgagctcctgggaaagtcctcctcagacagttctgttccagaactgattcgcaccaagtctccaacctcacaggcccctcccaaggaggccgactccccacttgggctcacacagagctcatgaggcacctcattgtctgttgtatgtttttgtgccggattgagcctctgcccagcttctccccattgccagcctgacaacaaagcccaggaggccctccctgtaccccaccttgcagccccaggcctgcctccatgtgtgcacgcaggcccctagctcacagtcccttgtaaaagggcccagggagcaggaatattgtccctctttggcctttgaggtgacctgttaccctttgcttcttgccctggaagaggggaggcaagatgaagagtttagcagaaaagaacagtagaaaacagtcctggccagaatagaagtttctgtgtgctgagtataaggggcccaagaaggctggctgtgtgagaagctgctggtgtctgggaatggcatagggcttggagacccagactcaagtccaggttttgtcctttcctcaccgagtgactactagaaggtcactcttctctgggcctccaactccccctcctggactgtaccatgtgggaccagatcagaggttgtcaaacttttttgacagcaattcacagtaataaatgcgaaggattgttctgcctcaggtgccgacagcacccacgtaaagaaacactgcaccattcgtcataaagcctggcttcactcgaagtgccccatctgggcagaccatcctcctccacttttctgagacatatttagacccgttctgtgtctgtggggtgagactagcatggagctctgatactggtgcatacacctttcctgggctgtcttggcttcctgggttcatcctccctcttatgacacctggtagctcctttaggtatgtcacgtatgttgcaacccagtacccatacactgtttcacaaaacaatgtgtgactttactacctgcactgcactctgatattttatattccaggatatattattctattccatctttttaaaaatgatggccatagtcttctaaattgattttataatccacaatgggtcacagcctgcagttagaaaagtaatatatcagatgatggctcaggttccttccacgccaaacattctgggattctgtaagcgttattatgggggctggggagggctgtatctcatgccctgctggatccaggacccccatttaggaaccttgactgagcttttctccctttccctggccagatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagtgagtgctgctgggctgggttggggagccaggagggccagtggggagacacacccttagcctgactgcaccctgcaaagggctcctgggatgacaggagagacatagcttctgtccctggggagttcattgcccctggtgtaatggactccctaatggggagaacctggccccatgggcccttgaactcaagaagttcttagtgtgaaggtgaaacagacattgactgtgtaggttttaaaggtcacagtttatgaacagaaagaggctaatagttctcaaagtgtgttcctccaaccagcaacatcagcatcacccaggaatttgttagaaatgctcatttggggacccacccagacctattgtctcagaaacactgggagaggggcccagcaatgcatatattaacaagcccttcagtgattctgatttacactagagtttgagaacctctgatcttaggcatgtaaatctctatccatgttctgaaagagcaaaggaatatgccccggtatggacgacgggaatagaatgggtttcaggttacgttataagacaggtaaatccaaaggacaaataggacaaatagacataaaaactgagggacatggcctgggtgtggtggctcacgcctgtaatcccagcactttgggaggccgaggcaggagcaggtagagggcgcttgagctcaggagtttgagaccagcctgaacaacatgatgaaaccttgtctctacagaaaaatacaaaaattagccaagcatggtggcgggtgcctgtagtcccagctactcagaaggctgaggcaagagaatcacttaagcccgggagggggaggttgcagtgagctgagatagtgtcactgcactccagcctgggcaacagagtgagaccctgtctcaaacaaacaaacaaacaacaacaacaacaacaaaaaccctgagggacttcatggggcttcatgatctactgctacagaacagagcacaactcctgtgcatacatgtggaaggccatcacccagaggaaacaaaggagaccaaatggggtgccccgttaggagccatagacgcagaggtgtcgtgagtgacactgagcctgcccttcagggctgggggctccctgaacctttgaactgtccttcatcaccacctactgctcttgttatttatttatttggcaaatgtttgccgaccatctactacatgccaggctctttgacaagtgcgggagacacagccatgatagggacaacccagagctgttctggagctacacaattaactccttttctgagagcctcaggagctttgcattcttcatctttaatcctcacacccgccaccaggcaggcatgagtattcctgaggagaaaacaaggcacagagatgttaagtagtttgtccaaggccacacagctggctctccatcctgtgctcttccctactggtaccacactgttctgaaaataagcagaaccccgttatagagctagacgtttccgaactacctgatggccgtaaggcgtatttaggatgatctggagaagaactaagaaacctctctgtcttggaggctgatcagggcagcctctggcttcagctcattgtcccaaccagaggccctgagtggaggttctaggtgagatatggaagggatgagtgtcaagccattttggggtgacattttactgatgaatgcagggtgacattctctcaatgcaggcagcagtactacttacccagtgccagagaactctgcacctcgggtggttttcctagaaatgaagttgggctgctatagctaaaaccatgggtatttattgaccaccaagtatgtcaaagcataaggatagggctccctctttgaatgctggacacagccagtcaccaccctgtgactctacaccaggggagctggagaggttcttagaagagaggtttcccttccctaggaaggcttcacagatgtggggcatcagcagggccagtggtgtgccttgaggcatgcctgagacctggccagggtacagtgaaggggacagtcttgctggagcagaccctggataggggctggggaatgttcatagtggagccgggttattaggttaaaacatatgaaatttctggttttatggctgaaaaaaggttgactacagacatttcctatgattcaacctaatacctgcccttggacatcaggctaagctgtttaaacttgaacctgaagtatggagaagccgctgatggtttctgagctagagaacaacacagtgaactgggttttagaaccacttatctagtaaaaagggtatgaaattttagatgggggaacttgaggaagaaagccaaatatggaagtcccttgctgcctttaaagtgatcaagatcaggaaattggtggctataagaatgggaagaaaggctagatgtgaacatttttgtgtaagagccagctggacttggggatggatagatggatggataaatggatggatggatgcatggatggacagatggacggacagacggacggatggatggacagatggatggacggatggacggacggacggatggacggacggacggacggatggacggatggatggacggatggacggacggacggacggacggacggacggatggatggatggatggatggataggatcatggccattgtcttccattttcctaataccagacacaaacaagagagatggcaaggtaggtgggaagcttcccctcagggaatagggaggagtttttcctcagtggagagataacatacctgctaggacattaactgtgaccaggggctcactattctcacatggggcaaatccagtgggtgtagccttccctcctctggaggagaggagctgttcccaggggtattctccaagtgggcctgggctgccttgttctggctctccagagggcagatgaggctgtggcagcttagtgtgctgggaggaattctgagccccctcagcagggctcccagcccaccccgtaaccacccccactgcctattcttcacaggatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtagctggttgcataccttcctccttggtgggcctgcggagggcctgggtgtgtcagcctgactccgcttttagagatgggtgagggcatctgcagttggcttctcttgccttgcccagctgccaggagccttcgcattgcccaaggttagagctgggcatcttaactttctgcagagcaaagccctctgtttaagtggacattaggcaggtacaattcctccattggtcatggaagagacttcaatgccagccacgggttcaacagaaaccccttttctcaaatcccactaaagaacatgactgctcctcacctctcaactcctgccctcctacctgcttcctctctcccactccccttctctctccaggcatcttacggtagaaaacaggcctgttgatgcctccaaagctttgctggcaggaaggacactacagggttcttcagttcagcccaaggatgtagtgtcaaaaatgagtttcccagagtcccggataagtttgtatgcatttctatgtctgtgttctgctttagggttttgaaatgtatttacatccactctcttatcaggtcctcaccatcattctccagaggaagaaagcaggactcaggaaagaggagggaccctagctgaggttctcccagctaggatatgggagctaggatatgggagctaggatctgaatccaggtcttttgcctccgggtctgggtcagttatcatgacctcacactgcttatttattttggttgacttgaatatttctgaactgatagattttttggtctgaaaaaaaaatcagctttgagtagagaataactagatcagcctcatctcccttgaccaggcagtgtggcaactctttcctggcaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactggtaggacaacacggccaccgagagccagcctgagggctgtgcaaggccactggctatggccccaggctggggtgcaagcctgtctctccaggctgggccaagacacagctgtgcagatttggcccagggctaatatcctgagagtttagtgacactggccttggcccaattaggggtgtccagagggtgaccttgggtggtgtgcacacacaaggggtcaccatctttttgaggttaaagagcaaaaggaggaaggctgatgtccaggcaagatccatattccacaagccctgggattcccaggtgatggaaagagagtaagactgaggggagaaggggttaacaggccttaagcacctaccctgtgttcaagaaatatggtaggcactcaaggtggggggcacaagaggaagaggtcaccgtgaagacctagaattgggctgggaagatcagaccatgtacagagtaatgactgataagtatttctggcataactttcagatggaaaagagacagcgttagaagactccaagtgctaaaatttatactaaaaaccactgatcaatcaaacgttttttgatcactttccacatgcataattttggccttgacagagaactccgagatgttccctgcctgcaaagaaccttcagtctggttggggcattgagaaatagcctcatgacacagacagacaataggttctacagaccagggctacctggaaagcgacatttcagtagggcccatttgccagagtccaggctggggctgttacctcggtccctagggcatcctgagcctggcacaaattgggttgatggtctctgacccccagggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggtgagagaagaggatacatggggtctttttgtcccagccttgggcccttccccaggcagccccatctcagccaacattcagccagtgcatagaacataacagacaacccggcactccctcttatgggcaggctccaagacacagggactcaggccttcctaacttccctggaactggataaggcccaggaccctaccaccccctttgagagaatgcagcggacattagtcagaaatctgagcttgaaaatgcctagatctgaatatccaaactggttcaaccatttccctcctccaccccatgaaaaaaaatgcatttcttgtgctatcttgaagagtgttcttttagacaaaagtctaccgatgggttgctaatgagtcacttcccagctgtggtgttaaaaccatttgccatgttcattggcatgaagatggcactgcttcacccaaagttgcctaagttccataccagggtgtggcaaagcccctgtggggctggtgggagggcttgttctagaagcagtggtttacaagctggcgaaatgggtgggtgtggaggggcggctggtacagggcttggaaccctggagcaggatcccttttagggtctttaatggggtttgtcttgctttaatggggtttgtctttcccaactcctgagaatccccccagagtggtgggtgcagctggcatgtgcctctgtgtctcaacttgtgtttctccctgccagcctccggtagcagcctccaggaagcagagaggctggggagatgaaaagtgaggataattaagagttttatggggttgatgtgctactggtagcaacagcagccacaccccacctgcaccaggctgatgagcccacattgcttggggatgagcccacattgcttgggagtgagcctactgctgggggcagaacacagcttgggtggagagggagcttctggtgcccagcccggccacccccagctccacttctgatccagcatcaacagggcttcttcctgtcccacagaaagagactgggcatgcgggagcttctggctcttgttccgcaaagggccactagtagcagggtgtgagccttgggatgcagctgcggagggaccgttgccacatggagccattgccagttataaagttactgggcagagtgaaggaggagaagaactgagtgcaaatgagacctcatttcagcctcagccagggccaggcggaattggctaaatggtttctctttccttccgttttcatcttttcctctcttcattcctttcctccctttcctcttctccttccttccttctaccacaacttccaatctccaccccgtcgtctcctctctgccctcccctctcctgcctgttctctctcctgcctgtcccccaccacactctcttgtccccaccttccccgttctctcttccccctttctctgccctcttccaccctcttctctcccccaggaacctgagctcggccgatgcaggccgccagaccatgcgtaactactcagggctcattgattccctcatggcctatgtccagaactgtgtagcggccagccgctgtgacgacaaggtgagtgcatcccctggtggcaccctgacccctaggcccagccccctacattttctgggtgcctttgaggcctggcccagtgacaagacaggagcacagactcaggggtggtagaagaggcatctggatgcagggcccagtggtggctacaggagtgggctctggggacagcgtgcccatgcaaatccactctccctcacttagaagtggagtagatgcagctgcttccctaatctctctgtttcccggttcactcttcactctaatggaaagggtcataatcatatcaacctcaagggttgtctgaaaggcttgattagttaataagcaaaacacgaagagggcctggcacagaggaagctcccagcgagcatctgctggctgtgcttcattggtggtgctgaggcctgtcctgtgaccctgagccctgccccacagcccagaggaatccatactggtgcccccagggcttagtgtcccccctgagatgaggctccttctgccactgctatcttcccactgcctcccagaaaagccattggcagtcatcttgctgccctctctggacttctggacacacagcacagacaaacagaaagaaaaaaagttgtggagggcagataaacagaaggctgagatgttcccaccatggcaggacagtggctcaggagatagtgaggtccagcaggctccagatcgccagggaacgggctggcatcacagcacctgggttctcagcacagttgccgtaaggagggattttatctcctgctccctccactggaagcaacagcagggccacagaggagagccttgtcactgggctgctcagcctgcttccaaagggcaagatgcttttctgctctgtgtgcaatatctccaacacctgtgtaaccccaagccctggaagtcagattcccttagaccccagcaagggccaaacatcattaggagggtaaatctgctgcccccaaaccctagtcctttggaggtttgccaaaggagattgacaaagatctgagcccagctgccatgatgaagccctgggctccaggtgttgctgtgttttgtgtggacttagcaccgctgacattgacagctaaggactggccccaggaagaaagaatgatgggggcactagatggctttggaatctagaggcatggggcttcttctggaggagtttgttctggaaaaaaaaaaagacacattcttcaatatcccagtctgcccattggcatgttgtccatagcagtcctaccacacactaggccctgtgataagtgctttctctgtatcatcttccaaatagcctagtgaaatggacaattgtagtctcattttacatttgagatagctgaggcccagagaagtgaggccagtcaagttcatgcagccaggaaatgacagattcaaactcaggtcccagaggtggccctggaagacttcccaggctgagagtgtggtggtgcctgcgctcatctttcccgatgcagcccaggtgcctctgctctcttattagctagggtaggtggtaggccaggagcctgtcgggccgggcagaggctcaggcccatgcctctccttggtccccagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatggtgagcacagcatcagcagggcggggcctgccccatcaagcacccccccaggagccactgcctcatctgccctttcctctgggccctcctggagcctgaagccagccctaagggacaggcccatgctgacaccttggcctggggctcagggtgcactctgggagctgggtagaggccattcatcttgcacaagggggaatctgttcttggaactgtaggggctcagaccaccttagaggtcaaaaactccagccttctgtttgcaggccttggtctttcttcctgtataatgggtcaagtctcccccatcttctcccttgcccttgaggatctgaggaaagccagaactctcactctttctggccttggttcccaccatctcctgagccctgccaggtttccccagaagcagaagcctaccagggatgggttgtcaggtctccttcactgggcccagctgtggaatccaggtctcagaccaccctctttggcccagggtgggtcaaacctactgtctgagtatggaagaggaggaagcatcatgatgggagagcccaaagcagccccacatatctggaaggtttgggccaaggctgccctggaacacagctcccaagatgccaggatgctctcttctcccacatcctgggacagtctgggggaccatggcccattcctgcatcccatggagctgctgcagtgcatagaggaaaggggtgcagcggggctgtcctgggccccctgcctctgcaggcgcttcctcagcttgccctacctggaaccacgaccctgaggctggggggatggggacagaatgcctgggttgtgtcctctcacaaggctccccactgacccccctgaccggctctttatcctcagaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctggtgagtgggactgtaccttctctactgcagcagccccatcctccagccaccgtccagcctctgctccctccttttccccccagcctgtcccctgacttcggagcctcccatgagcagagtgtgcctggcatatgctgggctctgggctgggcaatggggaaacactcctgccctttaggagctgctgggggatgcagagagggtgggcccactgatgctggattctgtccatgcacacacaatccccttggccacatggctcccggtccccagctggcctcctgggctctgcttgaggtcggggaatgcggcggagaaggtgtttggcaaaaggagtttcccatttgttgaactgacaaaggtggaaaaagagggtttggggtccaagcaggtccagagaagatgtgacagaatccgtgcagatgttgaggccaaatgtatgtagcttggagggcacagtggtatggggcagagccagaggaaacctgttgcaatcaagaagagttgagatgggccaggcggccaactgttcttcagctttacttaggaaaagggaaccgagcagcagcagcactagagtagaccgagggcagagaacttccctggctgtgaggagagaggctgggcagttctgagaatgccaaacccacctagacctgttacacccaggatagctatgttgcttagaggcctgggcgaactggcctacctctaggggaccccagttctctctccatgtgggcccagaccctttcttagccctcttttctcaggcaagccctcaacaaatatgtgttggattctaaagaggtaggaaagttggaagaagatggccagatgtttaattgacaaatacccttgaccatatagtttcacatgggcagatagcgtggggagatgtaatgggggcagcgctgagacagtggggtgagagagcagcattggacgcttgggttactctggaagctaactctgggtcactatgagtaggggaaatgagacttccctctctccacccatctgggctgcaggctgatccaggagacaggatcagggctgggaaaggggaggtgcatgttagcctaggtttctgtagttgcccacatgtgagctagtgcttccaatatgaaagagaaagggttctgggatgtctgcctttggggctccttgcccctttctgcctgccatggtgcctgggaagccacaggctagctcatcatctactccttctctcttagatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatgggtaaggtccctctctctcctccccctctagctaagacatggcaggctccctacaattcaagcctgcttgaaggtcatcctttaagccattccctgggatgagcattccaagaaaggaagctggccaaagacaggtatggagacaggagaagggagcctgtcacctgagggctgggagcagatctgcaaaagtcctatctgggtctctgagccctgagttggagctgccaggaagccctgagggccacctggctcagagcctggcagaaggctatcgaagagtgtggccccagagggaacccctcagcccttccttccccagtcatcctgaccctgtgccccaactcgttcctctcccagggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcaggtgggcggggggttgctcccacgggctgcaccccaatcagagcccctcctcaccctgcacagcaggaagcagtcccgcagctctccatggagtaggggaagcaccaagggcagggggagccagggacgggggaggcttgaatggaggagaagttccagaagccgagagtgcgtggagagaagggtccagcatccaggccccagggctgcatggagggaagaggcaacacacttcctggctgggggactcgggggcacaaggtcctcagagggccagcaggaggcatggggcagcaggtccaactgaatagggactttatcctgctctgtggggctccctcttccccggacaaggctggggactggagtggaagagcactgccacctcatggcccctgaggagagtcctggggtgctctaggtgggcaggggcatggggttgtgcccactgggtagggtgaccaggctcaccacaccccaatggggctcctctcttttgcacacctgaggcctcctctgaggcctcccctgtgtccaggccctggcagtgggggtgggagggaagagggtgctccttctcacacctcctggaatctcatctcacaaatgcacttctcacctgcccagtgcctcacccaaggccgcagaagctgcccggcttctcctgtctgacatgtggtccagcaaggaactgcagggtgtcctcagacaggtaagagcccaggacatcatcctcttctgaggttcttcctgctcatgagcagagggcctggcatatgctgggctctgggctgggcactagagaaacgcccctgcccttcgggacagtctgagagacaaagacagcgtctacgtgaaaatgaatgtgatgaacgttctgatcaagtctctgggctctgagatctgcgagggatgctgagaacatggagggcagaggaaatcaaggaaatgtgtgagaggcctggggtgggatcctttaggagcaaactgaaaaacagagtggacaaaaagcacacaagtcttttgagggcatggggttcactccagctagaaaagtaggtgtgggctaggttacaaaacccttctaatgtcaaactgaagagcttggacttgtacctttggcactggggaaccattcaaagttttgaatagagggtttcatgatcaaagcagcaccaaagctcaccctgtgagcaaggcagagtgggctgagaagcctggaggctgctgtccttgtcctgtggtggccttggcctcctctctgtcctccacccctccccagctagccaggtacagagtcctctagggtataaggtcttgttgtatgacatcttcacatggcctcttctttcccattcctcagtgataagcatggacataaaggacaggaggtggaagaaatggagcagtggggctgattaggctggagcttttagcttggagactatggttatattcacaaagacacatcagatgaggagagcctgagaaggcttttaggtgggagtaagaggggtcccaatttggagaggttgagtttggaagacttggatgggagtccaggctggaggtggtgtgggccctggcagaggggccagagctaccatacagagtggagctttgttcaggcaggcgaagccatgagaacaggcaagaccaccatgggttgcatgtgtatggaaaagtcttgaaggacagggcagaaatatgaagaccatctgctggggacaagaaggaggaaaggccagggaaaagaggaactgtgcagggtgccagaaggggctgaagacctggtaagaagagaaagctctaaggaaggcagggcagcagttcccagggctacctagaggaccaggggatggacactggaaaaggccctggatccggtgcttcggaagtctctggagccgtccaggagcactgctggccaagcaaggggagccccatggggcctgctgcagtgggcaaggcagtggatggggatggatggggagttgctgagaggagatgctgctccctgcaatttagcctgcagaaaaaggagcaaaacagtgggtaaaaagagatctgtttaaagacagaggagactcaagcatctctgtcatgggaggagagggagtaggcaaagaagggagaaagacagggatggaggacagggaagcctggggattggttgagcagcgtggggcagaaggaagcccagctcttcctccagcatggcaggggacaatagggagactcatgaacgcacggtgtccaaagatgattggggaaatctgaaggtcacagcaaagggtggcccttgttctccatgtgacaatccagagctcctttccaacagcactgcattgaagatgggcttggcaaatggcaactgccagatagacaaagggagacgaggaggcaggtaaggaggactggtgtgagcttcctcccgctgtgtaatggtggtccaaagcattcagcttaccccaaaacacagagtccacccccggcctaagacacacagagaatccactgacatcgctctcggtgggaattcccttctacacatgcctttgggaaccagcgtccccattcagtctccactcctccttccagctatgcttgacaaccatcctgggcatgatctagttggtgcgtctgttcccaaagggccttcacatccatcatgcattgagttgtcacaagcacaggtgagacaggccacatggcttgtgtccattttgctgaatagggaatcagggtccaaggagtttgtcttgattcagtgagtcagggcatgagccatgctcgacaggaatgagcatgccaatctgcagaagaaaaatggcatcatgtaatacatgcccaaagacaggaggggcagggcttcgaaccggctgctgtttcggatcccctatgccatctcccctcctgttcccacaggtcggtgatggctggcttggctctcagagctcagggctggcagcaggaccctcttttcaagggcaccttggcctattgctgcattcaaatcatgctgtccacattcacttggaagcatgtattgggcacctgctgtatgctgggagaaataacaggaataagactcactctccatccagcaggcactcaggggctagtggggctggaggtgaagaacagacaagtaaacagaaccttctagcacagcggcttcttaccagtgcgagccccctgctcctgtgtttgagaaacaatgggcatgtcctctctgcccaagagctcttgtcagaattgtttaaaaaaagaaaagatagaggtggtcagagggaagaacaattgacagcttctctaatctgattttgattgttgctctgtttaaaaaataatactagcctaaatcctcacgccttgactcaggtttctgcaaatgcaagtaggaaattcaaatgtgtcagtggaagttcaaacacattgcaccgactcatggagagttattatgttttgttacacagttactgaggccagttttcgccctgacacatgtacttagtgataagagagaggctgtgtgagccgaggttgctctgggagggcagtggacagtgtctgaccccacagcaagccccacacagttttgtgtcatttggttgctgtttctccctttgcagcaaggtttcgataggaacatgctgggaaccttagctggggccaacagcctcaggaacttcacctcccgattctaagaagagactgtccaagcaagttaggcttgcaggtaagaatcaccccaccctcagggatgcctctgggaccactgcaacagcctcagccagtctcagagacaagggctaggcctgtgctcccagggacacagaagcatccttttgcctggctctggacaacacaagcagttgtgtagactgcttggctgggggcgtagtttgtcccaccctcaggacgttaggggtgtataatgtcctgggagtttcagaggggtcagagggtctgggcaggactgctaggtacaaatgtgtgggttgtacactgaacaacacaggtggtgcccttcacatggactacagtgagttctacaatatggataactggagttctagaatatgtcattctggacttggccatacacagctcacttttttatccttttataattcactttccactctctgcacatgcccagtgtggacaagtttatttccagctgatgattctaggcccccaaaactcagaaccaatcctatgacgaaggcttgccaacctcagtgttcattggaattatatgggttgcttgctaaaatgcacacacttggcccagccccagctattctgactcaatagccctggagtgggatccaggaaagtctatttttaaacaagcgtctaaagtgtttctgatgcgggtaaactgagaatcacaaatagagatactgcagccagatgtcatcacccctagagaggggcctcaggggcagcccagcatggagccatctgcaaatagcctgggatcaagacagggtctcctgagctaagggggacctcttaaccaggctgtctgccagcaccccccaccccaatccctggtggggagagaggattgtaactttggtctggatgaaggttaaataagacttcagatatcctctcctagtaaacaagctgcaacaacttgaaggcagaaaaggggaaagagattcggtttggcaaatccttaatgaacaccaccttctttcttagtgaggaagacggtgggcaggggacagtgtggcagggtggcagacaaagctgacaagcttctgaatccacagggcaatctataaatgtgtctagggcagccttgaatccagtctcaggccagggcacacttgagggccgacgtgagaagagggtggcagtacaggctgggcttgtggtgtggaaacatctcactgtaaacactaactggaggactttctccttttccaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccag

SEQ ID NO: 11788 - DNA, 17629 bp, Human
ggcggttctgcctattggaggaactactgtttccgaaagtgcaatgtttaacaaaggcagtggtctaccccggggggttgagacctctgaaccctgacgtggccataaagccaactgctataggactggcaacccagaataagaagagtgaaggaagccaacagagatccctggaggttgtgttagtttgcttcggctttgtattaggtactttgtggcttacacaacagacattttattgtctaacagttccagtggcagaaatcaaagggcccaacagggttgattccttctgagggctgtgagggagaatctgctccatccctctctcctagcttccagtgttttctggtaatctttgccattccttggcttgtagaagcttcaccctgatctctgccttcatctttgtatggccttctcccagtgtgcctgcctgtctccaaatttcccatttttgtaatgacatctgtcatcttggattagggcccatcctagctgccctagtgatctcctcttaactaattatatctgcaatgaccctatttttaaataagatcacattctaaggtaccgggactccaacacaggaactgagagcaggaaggaggaccacagtccaaccccttacacagtcgagcactggaggtaaatggtattctcgagaggaaagctgtttgatggctcttgggatagattaggttatgctccagcaactgcccatctcaattatcatcagcttaatacaacaaaagtctatttctcactcacactaagacccctgtgagctgcaggactttctaggacaactgtcttccgtgccatgattctacaccccagattgctttcatcttctggttctaccagtggggcagggaagggctggggagttgcatctcatagtccccttgctggagaaacctggaagtgacccttcataccagtgctcatgttttaccagtcagcagcagggccctaggtctccatccctgcaaggggctctagagtgtagggaacagatggaatgttcacaagcaccacagcccctgccacagtgacttttttaggactggtatcgcagagtgtttacttaaggcggtggaagctaaattcttagcatgtgctggagagcaatgaaaaagatatttactttatgaattaaagctggagtcagtgtcagcccgaaggctgaaggaaaaagagcaacagatccagggagcattcacctgccctgtctccaaacaggtgaggatggggaataaagtgaaggcagtgctttggtgggaacttcaaggatagcctctggctttttccaggtttagaagctcatatgagacaggggtggaggaaaagaagaaagaagaataagaagagaaagttgaggccctggcccaagttagtgggaagggaaatccacccccattaaactctctccctggtggactgtggggtgcacacgtgaggcctgcacaggtgctggaacatggtagaggcccaggacatacttcctgtgaatgaatgattgagcggctgaatgaatgagtaccactaaaagccctcttttctattcccaaatgccacattgagcagaagggagcaatccttgctcagcaattggtagtccctttgggtgtgcaaatgagtccacagcctgcaacagcagacagtctctgccccccttagaggcgattgcagggaggtggctgaccgttgatcacacccagagctggttatgggaatttactccatggaaagactgcaaaactgcctgaaatgtgttttggcatcagctactgacacgtaaggtttcccaatcctcaactctgtcctgccagctgatgaggggaaggaaagggattacctaggggtatgggcgaccaatcctgagtccaccaactgaccacgcccatccccagccttgtgcctcacctacccccaacctcccagagggagcagctatttaaggggagcaggagtgcagaacaaacaagacggcctggggatacaactctggagtcctctgagaggtaaagagccagcgaagctgatgtcctgtcaagagcagaattcctgctcattcgctgcctttgagagtggctgtgttgtgcatgcatgtgcatgatttgatatgtatgagagggtgtgtgtgcatgagtgtgttgagtgagtatgtgagtgtagtgtaagagaggatgttggcactatcaggtaagtacgagagtgtgtgtatgtgggcataggtgtgttaacatgtatgtgtttgggaacttgtgtatgtggaaggggttagaaggcctagaagagagaggttgatgctttcattctggaggaaaatactgaggccgagcctccatgggtgccttggagactccaagccttgaatccagtgtggggatatgcaagctatgtctagcgagggacacatcctctgacctcaggaacctcccaggtagttgggaggaacctggttccaacctcccaagaactctcagtctgatgaggtacaggggaggtctcattagtgtatcatggggttctccacaggtctgagggcctgatgtgtgtgaaaccattctgcagagctgggaacgggtcaggaggtggttgtgtgtgtgtgtgtgtgtgtgtgtgtgcattgctggagggcactccttgtgtgctctgagtgtgacagaggaagtcaccctggacttaggttggatgggagagcatgtctgtgtgtctcagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggtaagagctgaccctgacctctgagcatggggggacagccccagaagggaagcactcttgtcccttagttttctctcccattgcagtgatcctctctcagggggaaaaaagaagccatttgggaggaaggagagtagcagagaggggcagagagggagggcacagaaccccatgccccatcaccagacaactcccaaatttccttccaggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcggtgaggccacctatccctccctaccctcctagactctggcccaggcagggctgggagctgcaaagacagtgccggttcctgatgggcgcagaggtctcaggatggcctggctggaaaagcagccggcatgttggaacttctgctctagactgttgcaaagtcactgggtctctgcccagggtccaagggggtgagaccacaggcaccaggcctcctggagctgtgggacaagagccccaacagggtgtctcctcacagctgctgtgtcactcatgactgttgctacaaacgtctggagaaacgtggatgtggcaccaaatttctgagctacaagtttagcaactcggggagcagaatcacctgtggtaagagtcctacctcaccatcgagtggccctcatttgtttagacagtgctggggactgtgctgggcaccaaagatagacacagagggacacagttcctgcttcaggaagctcacggttgagtgggaagccaggaaagtgaaaatccaatgtagtaaagactccagtgggaagtaaacaaacagataaggcattaacacagcctgaggcttgaggaaggctcctggaaggggtgacccctaagctgagtctgaaaggctgtgcagagagtcagggaagaggagggagcattcccagaagaggacacagcatggtcaaaggcactaaagggcactgtaagccattctgtactgcccagcagaaacatgaggaagaggagcagtgctgagccatgatgctggagacataggaaggagctaggtcaatccggccctccaggccgggctgtatttaggttttgccctaaagcaataggatgctattaagcaaaggagctacagggtcagatttgcattttagatgactcactgtggggacagggtcgatggagacaagtggaaggggggcagagaaagctattgccatcatgcaggcaagagggagtaacatcttgacataaaacaatggaggtcaggatgggaaaggtggagaaaaaatcaagatgcatttgagatggaatcagctgaactggtgactgagttgggagggatggggagagggagttgttggatggatatgtggctgcatggatggcacaactgtgataaagaccatgggagcaggtcatggtggagggtggggaggagcagttctatttccagcatgttgagtttaggggcctccagcacccagggaggggtccagcaggcagctgtctatacaaatgcagctcaggggagaattcaggactgggacacagattcagaagccagcagcagagacctgagaggtgggtgtgatcactcatttgctgtttaaaggcccagaaaggagacagagaagggatggacagagagggagaaggggaactgagcgagaaggtcaaggagtcagtaaggaaatggttagcaagggccaagtgaacagggagtcctccatgaaaagggccaacaaggctcccctggatgttgaggcagaaacgcatgagggactcaggggaagctgtttccatggagtcgggagggcaaagccagattagaccaggtgggggctgatgggaaggcaaataaagacaggaggcaaagacaacattctggagaaagtttggccctgaaggggaggagaggtgggtggcactggaaggctttgcttggtgtccccagacagctgactcatgagtgggatttggaaaaagcgtggactcctgcccatggcctgagtcctttaagatcagaaattatgtctcccatcatggcctctccatagaggcatgtatcttcagcaggcgttaggtcacaagccacatgatgccaagctgacagtggcttgcataatggggatatgtgactgtcgcataactagaattctggaagagtgcagtgccaggcttggggcagctttccagccatgtcattaagaatccagccttctcctggccttcagctatgccacgtggccagtgtctacacctgggatgtcaagagacaggctgcaggtccaccctcctggcctcatactatggaagaggctttccttttgggcatctctctttttggagggaggaaatagatcgttcccagaagcccccagcagacttccccttgttgctcattggttggaacaaggttacatgatacacaaagaccaatcactgcaaaggaaaaagggatgaccctgcctggcttacaccaatcacaatctattcccagacccccgaggctagggctttgcctcctggacacatctgttagcaagaggaagagattatggctgttaggaaggcctttgagaaagtatcccagtgcctggctgtgtctccaccaggctggaggccagcatcccaagggcaagaattctgtctccccattggtcagaaatatctggagcgcaggtgtttgtctccaactaggagcttctggaggacagggctgtgtcttctaccccagggttcccacaagaagccactgaatattaataaactcccatcttgtgtttattttcttatgatttcagcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatcatgtatatgtgtgtgtgtatgcattgccctatgcactgttagcatgagaacaaacaggggtaggggttaaaaatacaggctctgagtctggtgtagtgctgtgtgcctgttgtcccagctgctcgggaggctgaggctgaagtgcaaggattgcttgagctcacagaagttcaaggccagcctgggcaacacagggagaccttatctttataaaaacaaaacaaaacaaacgaaaaaaatagcttctggagtcagactggctgtgtcaaatccccgctcccccatctcactaagccttagttctttcatctagatggagataacactggtgcctcctgcatgggcatgtttgagaattagaatgatgacaaatgaaaagctttgggtctgatatgtctgatagctgccatgactactacaagcgaaacccagacatctccctccccttccctaggcaatagcagctcctactggcctgctgggagaaagcaggaaggttggtcttaatctgggaagctgtagtccaagtcttccgcatggaatgctcttctcctgtgttgccagtctagtaaggaggaaatgtggggtgatataatgctggccaccagctggaccctgggggtgttatcccgtcaccagggttggtttcccaggtgtgcaacccctgcagtcccatagcatcctgtgtttggaagggtgccacgcctggtttaatgctgcgctgtggctatctgaaaagtcttactaatctttaatcaagagttccttcccacacttcattttgcactgggctgcccaaatttatttatttttattattttttaatagagatggggtctcgctatgttggccaggcagatctcaaactcctggcctcatgcagtgctcctgccttggcctcccaaagtgttaagattacaggcatgagccactgcacccaacccagtcacacacatagtgtagcgggtcccacctttactgggatgctacttcccctcctgctgttcagggttccgctgggaaattcccacctggaccagctacagccccacctgtttctccaataacacgcatctgggctgctgggtgtggatcccttcacaaaggcaccctgcacaggggacacaggtgggagctgagtttcccacaggagaaggcccctgcacagcccagcaagttctgcattcccccagaggagatgccttcccataatctgtcttcccagaagaagcaccttttctaattctgcaccaaatgtttcatttgctgaaggcggccctggtcatgttcactttcacacatagcaagagaaatgcacattaaaattccactgagatgccatttttatctattacaatgaaaaaaatccagaagtgtgacaacttgatctactagcgaggctgcatggggaaacaggcactttcataggtagctggtgggagggcaaaatgcccacagagggcaaattggcaatatctatcaaaattacaaatgtatttatcctttcactcagtgaccccatttggaaatttaccctatggatgcaggcacacaccacacacccgcacacacacgtgtgcacacacagagtgatgtatgagcaaatttgttcactgcagcattgttctgaattgagctggaaataatccaagagtatgtgtcacgagaactagttaaataaataatgataccaactcaaaaagggacccaatgcatttatattatgagggaagctctctctgctccaatggacaaaggtcttcaggatatggtggtaacagaaaagagcaaagaggagaatagtataaacagtgtgccacaattatgtagcaaaatacatctgttaatatatttgtgttaatatttccagtaacactcaaagatcatgcaagaaattcatcaaaatggctatctttaggggacaaggctggcaagaaatgagtctggcacagatggggtgacagaaagattttttgatacataactttttatattgttttgatttttaaccccatgaatatatttcctattcaaaagaaaattagcatcatcaaacacacacaaacattcctgcgtctaagacagataactaactctcagagacaatatggtctaactcatgggttggcacactatggcctgtggaccacatctatgcactgcctgtttttgtccagcaggcaagataagaatggtttttatgtttttttaatgcttgaaaaacaatcagaagaatctctcatacaaaaatgatatgttaaaatcatattttaatggcaataaagttttctcaaaatacaatcatgctctttgggttgtaaattctcatgctggctttcacgtgacaacagtggaactgaatcattgccacagagaacgtatggtcttttgcgaaagaatttgccaatatccagtataatccagtgcttcttaaaccattcgtggtaatggaccaatttattctttattttttccaactctgtctcaaatcaatacttttgttaaattaaaaatgtacaaaatacaatcccagatgttttattattggatgcaataataaaattactctgtcaaattgtttgaaatttcctaacattctcaatctctgtatgtacctccccaggaaggggaagcagttcacagaccagcatcgccccatgaaccccaattgggaaatactggtcgaatttgaattgaggaaagacaaatgaccttaatcattttttttttgagacagggtctcacactgtcatccaggctggagcgcagtggcgcaatcactcactacagcctccatctcctgggctcaagtgatcttcccgcctcagcctcccgagtagctgggactacaggtgtgtgccatcacacccagctaaattttttatgttttttttaatgttttgtagagttgcggtctcaccatgttgtctaagttggtcttgaacccctaggctcaaaccaccctcctgcctcagcctcccaaagtgctgggattataggtataagccaccatgtctggaccttaatgattttagaattagcagtttgttttcatcctttgacttagaataagtaccatttattacaatataaacagagtcattttctttccagctaccctcatagactgccagggtgaggttgggaccatattactcctcagtgattcctctttagcttctaaacagaggcggtgaaaagctgcttgaaataaagccttagtcaaatgcttgccaggggctttacctccatcttgatctacggaaaagaaagatctaggaaaagagtatacatctctccctccagtaaagactttgcatttctgggtatttatctaagaatattttcaacatgagtctttgtgtgcaaaattttgaaggccttttattcctgaaagcattttttacaacctcacattgaataacaatttcgaaagatataatatccttggttcattttttttccattcttccttattaccttagaagcattcctccatttcttccaatcccattccaatattgctaataagaagtctgatattaacctgactcatcatctttgattggatatttgctctttccctctggaagcctgtagaatttctctgtgtctttgatgttcttaattttcactgcaatgtgtctagttgacagtttttctttatctggcctttttgtactctgaagtcctttcacttgtctttaatgataggaattttatattcattatttcattgaacatttccttccttctctttttcctgtctctttctgggacttttactatctggaagttagtacatctgtactccatatctctttggatttttttaagagatagagtctcccacccagcgtggtggctcatgcctgtaatcccagcactttgggaggctgaggggggtggatcacctgagatggggagttcaagaccagcctaaccaacatggcaaaaccccgtctctactaaaaatacaaaattagctggatgtggtggcctatgcctataatcccagctactcaggagactgaggcaggagaatcgcttgaacccgtgaggcggaggttgcagcgagccgagatcgtgccattgcactccagcctgggcaacaagagcaaaactccatctcaaaaaaaaacaaaaaacaaaaacaacaaaaaaaaagagatagagtctccctatgttgcccaggctggagtgccgcagctattcacaggtgtgatcccactactgattagcaccgggagtttcgacctgctccatttccaaccttggccagttcacccctctttatgccacttggtggtctcccactcccgcgaagtcatcatattgatgcccaacttagtgcggaacacccgatctgcacagcgcattatagcccaaaactcctgggctcaagcaatgctcctgcatcagcctcccaagtggctgggactacaggcacacaccactgcatctggtttgaattttccttgctattttctctattttctttttattctttttccctaagaagacatctcaatctaagcttctaactctatctgtgacattcttcagctagctattccatttcaatgattatactcttcctaagtaacttttatacttgggatttttttaaataatgatttgttcttgcctgatattgctaacatcttcccttatctacataagtatgtttaacacgcatattttagtttcttgctcatccactctggcaattctgttttagatggtatgtgttgacaagtacatttcatctttctagtgggtgtagtctgggtgtctcaagataaacttggggaaggggaaggggatgagtccaagatatgatgattctcatttgctgccaccccaggcaggtgctcctgctgacagggtttcatcattgaacatctgggaagcagcagccctggcaggaagcagcactccaaagctgttaccggccctccctgagatggggcagggcggaagggggaacagtgcaggatgagatgagggaatgaatggctgagggcacttgagaagcctgcatccatctgggtcaattgcttacccaagcagggctttgggacagccctaacatcatctctaggacttgggcatttcagctgttgctctaagatgaagacgcaaaaggagaaaaagaacaaaacttaaagagcttcctcccaacctacttgctgcttgccaaagcccaccaatccactgctccaaggcacagccaacccctctccccgagaaccacacccagcagccaagatcagattctaacttcctgcaagactctgcagaggttcttctgctatttcatcatccaagattctctctcaggcatgtatctattaggctggttttggcacagggagccggagcctatgctaatttgcaaacttggcagaaaacagggaaatgtatagcacaatatctgtgtaccagtttaaaagcctccacagagagtcaaacaaacactaaacatttttcaagaaaccatatatctaaataaacataggaagaataaattggtagtggagatggaagatcaaggactaaagtgaataaaataaaattggtaccttgcagaaaccaacaataacagagcgtgatgaagtgaagccgtggtgcacacagattaaggcttggtcagttataaaagcacttatcctttcactcagcaaaccacctctggaaatgtaccctatcaatgcatgatacataagcagtatgtaagagacagcgtgagagtgtatcatgtctcatgtgtgtaagagagagagtgaagactcaaacccacagctgtctccatctaagatctggtctttccaccttgacagtcagctgacaggccagccagttgcacctctgggtcctagtttataccattggaccagaatgaaatacccatttctcaattattgccttagcttggctggatgaatgatgatcacagataatccaaaaatcacttatatttcacttttgtcctcagttttaagatggagataactagcacatcctgcctagttactagggaaatcaagccaggtccataccaggtggcagagagatggttctttgagagcaaatgtcttctgtagatgatggaataggagactaaccaagtcaatgaatgagtgaatggtagactagaaaccaagcctggttcacttttagccccaggactggcctagggcacagcaggatgctgagattgtgaggttaaaagaaactggtctgggcacagtggctcacacctgtaatcccagcactttgggaggccaaggcagatggatcacgaggtcaggatcctggcctggccaatatggtgaaaccccatctcttactaaaaatacaaaaattagccaggtgtggtggtgcgcccctgtaatcccagctgctcgggaggctgaggcaggagaatctcttgaacccaggaggtggtggttgcagtgagccaagatcgtgccactgccctccagcctgggtgacagaatgagactcagtctccaaaaaaaaaaaaaaaaaaaaaagaatctaataggcacatcctacaccccacaaagactaccccatgagcctgtcagatcctcccatgcccttccactgtgcctggttcccacaccactacctgggccctctaccatcctgtgatagcgcgtgccctcacttcaccctagagtgcaaggctgagggatcacagagtcctcttcaacatctggtccagatggcctgaaggacttgaatgtagaagggaagggaagggaaggagctgcagtccctgctgctacagctgcctccacggtcttaacaatacgcatcatccccttcctctccactcatttcagatgtccttccccctccatcagcactatagcttatttcttgctcctgtagcaaacatcaccttcactcaataggataaacctaggcaggcaacccagatagattctggaagtgattcagggtcacttgagcaagaaatcccagagtcgcagacactcagatcatggtttagaagggagaccaagggctccagcaggcacatcccttggcctaggagtcctcactctaggggagacgtcctggttcccaggcccaaggatggtgctgctgcttgtcttagctcaagaatggcttcccggagaaaggctatgtcttgagaaaacatgaccttttctgtagtcactttccacaagcacatctttagtttgatttccaactcttttatttggccagcgaggcgctgggctgttattggtctctgaagaccttggaaaccaaaacccagaccgtctgagcttcccacgtgctgatgaaacccaacccaggggacttttcaagggcaaagctatggatgaattccattccctggagggaataaattacgtcaaccactttatgcagcatggatggatgaaagaaccagctggccgaccgagggatgttcccactcctcatgtgggtcatgacctgggagtaactttcatccaaatgagagcacggtggagaaaggcactccatagccaggacgggacaacatgatgacaacagcagcaaaagcatgccttgactactcccacttactggaaaatggacactgacttcatggcaggtcctgggccaagcactttaaacgtgtcttctcatgcaatcctcttaacaattctatgataatattgctattcatatcttccattcattcattccacaggacatctattgagtacatgcaacatttctggcacagaaccaggcactaagaacaccccaaaacccaaacaggcaaggcccctgcctcttggcacttacaaggcactgacaggaacagacgcagccaataaacaaatttcgagagagaaaagagacagtaataagtaatataaagagaatcaaaacagcagaataggagagggcaggtggaagacaaggcatgtattcagatggcatgatcaggaaaggtgctgcagagatagcaaaaggcactggaagcaagatcacccatgatatgaaggagtcagccctaagataatcaaggagaaaattgatccaggcagagggaacagctaaggcaagcatacagaggcaggtctgagcctgacatatttgaggacagaaagtagaaaattgtactgcagaacagaaataagaaaccaaaagaaggtgcagttagcaggcaggagagtgtagaaaatgtggaaatctaggatgtttaatgcagcttgtgtgtgagatctcttctcaggcagattacaaaaagacaaaacaaaaaaaccaattctaggagtctggaataaaatatgtaaatatatgctcagctagctggaagctttgggaaagagaaagaaaaggaagagaaggaagaggaggaaacaggtgcctctggatcaaaccataccagaaagcctccagtcatttccgttacacatgtcaataaatttcttttattatttataccaatttgagtcaggtcttcagttgcttaatattaaaagtgtccaggccagccatggtggctcactcatgtaattccagcactttgggaggctgaggtgggtggatcacctgaggtcaggggttcaagaccaacctggccaacatggtgaaaccctgtctctactaaaaatacaaaaattagccggacgtgatggtgcacacctgtaatcccaactacttgggagactgaggcagcagaatcacttgaacccaggaggtggaagttgcagtgagctgagatcacaccattgcactcaaagcctgggcaacaagagcgaaaatccatctcaaataataataataaaaataaaataaaataaaagtgtccaaattgatttgtatacatttttacatttaatatttttcaaccgccctgatgaagtagctattagtaacttccttgtataaatgaaaaaacagaggttaggaaagatcaaataattaacacaaactcttacctagttaatggtagttgggactttaccccagagctccaaatactagcacctaattccagtgctacactacctctgtgaaaccctgaaatctcagaatctttccacaccctactatccaagtgcatggacagaagacagagccaggaagtcccccaccagctaggaaaagagaagccgggcatggtggctcacgcctgtaatcccagcactttgggaggccgaggcgggcagatcacaaggtcaggagttcgagaccagcctggccaatatggtgaaaccctgtctctactaaaagtacaaaaattagcctggtgtggtggtggacacctgtagtcccagctactatggaggctgaggcaagagaaattgcttgaacccaggaggcggaggttgcagtgagccaagatcatgccagtgcacttcagcctgggcgacagagcgagactccatctcaaaaaaaaaaaaaaaaaaaaaaaaaaaaaaaaaaaaaaaaaggaagagagaagaaagcttcactcccatgggcttgaactttcaatttgcaaaaatttccaacatgtacaaagtaacaaaatcacattgtgaactcacctgtatccatcaaccagcttcaacacttatcaacattcagccttcttttatcatttacacctccaaccactctgcacctccaatgaatcatcatcatcatcattacctttagttctttcttaaaggtaaaatatatatagattgaaaagcacaaatcacagctgaacacgtttgagaaacggatacacccacatcacccacatcccatcacgagaacatttccgtctcccagaaaattccctcacatccctttcccctcaaccccctctctggatgaattagtcgtcttgcactaccataacaaagtcccacagactgggggagcttaaacgatagcgatttattttctcacaatcctggaaactagaaagctcagatcaagccattggcaggttggtctcttctgaggcctctctccttggcatacagatgctgtcttaccttgtgtcttcacatggtcttctctctcaggtgtccgtgtcctaacctcctcttgttttaaggacaccaatcatgctgcatcaggacccaccctaatgacctcactttaacctaatcaccgctttcaagggctggtctccaaacacagtcagattctgaagtactggaggttaggacttcaacatacggattttggggaatcacaattcagcttataacatggagaaaccatcattgtgattattttcaccttagttgcctgttttagaactttctatcaattgaatcatatattaggtgcacttttttttttttgacaaggtcccactctgttgcccaggttagaatgtagtggcgtgatctccacctcccgtatgtgtactgttttacatctggcctcttccattcagtataatgatgatgagatccattcatggtgttgcacatgtctgtaatctgttcttctttattgctgagtagccttccatagcatgcatatgttacaatttatttattcattctcctggtaatgaacatttttgctcttttcagtattgggatattttgaataaaactgctatgaccatttcttatacaagtatctgtgtgaacattaagttctcatttctcttgaataaatacctaggactggaaatgtttactcaatggataagggtatgtttaatgttacaaagtcagatcaaacttctttccaaagtgcttgtcccattttacattcccaccagtaaggtgtgagagttccagttgctccaccatctgtgctttaccttttaatgcacaatgacccatccaccagggaaaaaaaaaaggctcaatcagtatcctcaagtccaaccaatccgaagtaactctttctgtgacaaccttggacggcaccactcagctctcccttcaaatgagaacctgttcaaggagtgtacttagtggacagccccaagcccatgctcctttgggatctgccacagtactcatgacaaagccatgttctccagtgccgttcccatgatggtgatgacaggggactagagccaggcaattgtttcccaatggaggactcctctaatgggcactgttcacatgagaactccccgtcagattgctgagacattctcagagctgtgccacagtttgagcctcttcctacccaatcctccttcctttcctctctcccttcagaggtgtcagacctgcttcctgatctgaacactctctctccctactcctccctgcctcctttatcttttagagctgcttccctccatacatctcctgcacttcgaactgtatctcggcatctgcttccagaggatccaaactcacacatcatctcttgggggaaagcaagtagatgaatggaaaaagaaggaaaatcttttagctccctacccaagaagcctatagatctccacttttcacccttcctttagttaaccaaaaaataaaac

SEQ ID NO: 11789 - DNA, 52032 bp, Human
  misc_feature (1)...(52032): n = A,T,C or G
aggggcccaggcaaagtctccaagtacccagtcccctttcttcagccttgcccacaccctcagccttcctgttaatccaggcgacccagggttacccagaggtccaggtcccagttgttcacttgagcatctgatgtaccccaaacacctgtgtgaaacgctctctgtccaggatgcgtccatagcgcagggtgacgtagaaggtctgtttcccactgtaccgctggatacgcacaaacatctcctgaggccggtccttggtttctgtcaggggaatcacatctgccatgggacagtatgtgtcctgccgccagccccagaagttcagatgggccacccgcagcatggtgccagactcattcagatacaggataccaaccagtctccgtaagaaatagctcatccagcacagcatggtcagggcaaagcccgatatcccactcatgaggcacacggtgttgagagtgaggaggccctgggagtacaagtaatagcctggtggcaaagctaccactgtcagggcagtctgtgccaacttcagtcgtgacaggaacccgaaggttctgatggcatcaaaacggtaaaacatccagaatttctcagtctctgcgtttggtagtttctccttcgagatgggtgaactgctgcccacccacctcttaggatcctcctgcccactgcagcaccacagcccatggagaggcctttcccacacagcttttccccgaaacctacgcacagctcggagaagggcagcctgaaagggagacagtagaccatttctctcatggaactcaaccacattaatcacacggtgaacatctgcaaagcaccatactctaaggcttctgccaatcctgcaaggtaaccgttattgccagacgagggaagggtaaagccagatgctatctcatgtgggcatcacaacagctatctaagatagttatcactatttccactttaccactagggaaactaagcccagagagggtaagatatttaccaaagatcacacagtcagtgagtgcagcagagtcctccttccaccaggcaattccaaataaatacaggaaaggaggtgcggccgtcattaattcaaaacatatccagggaggacaaactctgggctggacaatgtatccacaagggggtgtgaacatttccccaagcaggaaactaaataatcagtgtcttagtggggaactcgagcaacaaatctgtgagatatttattccaataaactttctaattctctgtttgattcatatgctatcttgggtgctggagggaactgctgctttctcttagcctagtctggggaaggggaaacagcggagaaggagaaggagcgaggcagggaggccccaacacgtagcacaagggtattactaggtgggtagtgaagcagtaaaagctcttattccaattctggctccaacagtaatttgtgagcaaattactccacacccctgagattcggtttcttcgcctttcaaaatggggactcagaagacagtgaaccagaggatggtttcagagtcctcaacttagtacctaatgcactgtgagagctcggcgagttttagctactactactgtgcgcatgtgacccaaggagggcagagaaagcccgggaaaagcgaactgtaacacacgccagagcttcctcccacggatcctcggagtccgaaacccgagcgtcgggcctgcccgccccagccctgaccccgaccccaaagagcatcaccccctcaaggctcgccacccgcctccttaccatggccccaccacctgctgccggaagtaaatcccaccggcccccggaacccctaagagcgcatgctcgaatgtacaaggcgggcgtgatctgcgttgcaccctgggagttgcggtccaggaatcgtggctgccgctactcccaggcgttatgggaacggagtcccctcctcttcccgacgtgccctgcgactcagcggccgaacccggaagttccgggccgagttcctcgtgccaacgtgtcttgtaaggtgcggctagaaactggggacatggcagcgcctggcccagcgctctgcctcttcgacgtggatgggaccctcaccgccccgcggcaggtaagtggcggccggcgggctgctggcagccgacgcggagcccgtgctgttcccagttggggctatcgaccacccagggtaggcgccaaggggtggctaaggaccgcctacgtcctcacggcgctgaaccctattctgggtgcactggaggaatgagagggaggccctaaccagctcttgaagagctctggtgcttggaaagatgagacggggctgaagaactcttaagagcaggaaacttgtgctaggttggaaaatgtaatctggactcaccgctagtgctcgggactgatagaccaggatttcaacccaagatcaggcccccttatcagctatgtgccggccccaatcctgtaaccaatgggctgtgccgtgagtcatgatattaaaaacaggtttccaggtcaaaccgacctagtggagtctcatcttcacctcttgacatctgtgtgaccttcagcgagtcattaacctctctgagcctcaacatctacagctttaaatggggatgttacctgttccatatggtgtctgtgaggatcaaatgagattgtgtaagttcttgaaagtatgttggacacaacacactaggcctcagtaaatagtagccacctccaccacacccatctccagcccctgcaatggactagggagatggaggagccctaggttattacaggctgcccgctgagagcctctttgggcccttggaaacttgctttccactttcagattttgctgctacaggcacagataagtttcagttacgatcagccttgaggtgaggctctcctggccccttttcagaaattggccactgaacactggccatttcaacttgagactggaccccaatggtctcactatcctcagcttctaccctcacccctcatagttttcgcttggtggtaacaatggtgtgctccagaagtccaggtcaaatgcgtgtgaccttagacgtatcattttgcccttctcagccacaggtttgatttacctagtgatgacgctcaactcccaagttcttcaaaggctttttctgattctgaaattcagtgatcacacacttgggtttgttaaaagcccatagtggtctaaaactccggtccccaattcattttttgtaaagggccatatagcaaatacttctctgtctttgctgactatgtggtctatagtaaccactcaactttagtgcaaaaccagccataaaccctatataaataagagtggctgtgtaccaataaaattttatttatttattacaaaaacaaacagctgcccaatgtggtctgtgggccatagtggtctagggtttacattgccaccctttttcatatcactgaaccctctcaaccttcctccatctttcttcccaggtaggatagttgttattaccgttttaaacataaggaaacacactcagtgaagaactaacctcctcagtttcacacagccaacctggtacaagtctctgggcctcaggatattggttcctgtcaagtttgccatttcctatctgtgctaaggtggaagctgttctagtcactgggtatgccattcaggaaagtgcttctgattttctgattttcacagttctgactctttttttttttttaagacagagtctcactctgtcaccagactggagtgtagtggcccaatctcagttcactgcaacctccacctcccaggttcaagcaattctcctgcctcaggcaaccaagtagctggtgctacaggcaggcaccaccacgcctggctaatttttgtatttttagtagagatggggtttcactgtgttggccaggatggtctctatctctggacctcgtgatccacccgcctcggcctcccaaagtgctgggattacaggcgtgagccaccgtgttctgacttttaaaggccactcctccaattctagattctgtctaataggtccagattccactgtgagagtagaaaagattgcactctattacaaacccttctgtacaattttaatcacattcatgtattactctaaaaaagttttttaaagaaaaatcattgaactccaagtgtttatatactgaggttgaattaaatggttttttgtattttctaaatttctagtaaaaagatattcagccgggcacggtagttcatgcctataatcccagcacttggggaggctgaggcgggtggatcacttgaggtcaggagttcgagaccagccttgccaacatggtgaaacccagtctctactaaaaatacaaaaagattagccgagcatgatggcgggcgcctgtaatcctggctacctgggaggctgagacaggagaatcgcttgaacccaggaagtggaggttgcaatgagccgagaccacaccattgcactccagcctgggtgacagagcacgacttcgtgtcaaaaaaaaaaaaaaaaagacattcagtgtaaatgtacaactgagattgctcaaagtgctgagttataagacttgtaaaaatacattgtgatgtgtcttaatgtagggctattttttcatcttagtttataacttttttaaaattatcacacagtttggaatttaccataagattataccactaagaccactctttctagataggagctttgcttttagaagagactaaaaaatctagttatcttactcttttacatttttgttttgttttgggtgattgcaataaaatcaattctaagcttctcctttttttttttttttgttttgttttgttttgttttgagacgaagtctcgctctgtgacccaggctggagtgcagtggcacgatcttggctcactgcaacctctgactcccgggttcaagtgattctcctgcctcagcctcccgagtagctgggactacaggcgcccaccagcgcgcccgcctaatttttgtatttttaatagagacagggtttcgccacgttggccaggctgatctcgaactctgacctcaggtgatccacccgcctcggcctcctaaagtgccgggattacaggcatgagcctccatgtctggccctaagcttcctctttaatttcattatgttgttttattttaaaatcaacaacttaaatccataaatggagtatagtgtagcatttaaaaggaatgatgagctagatctgtgttggcatgaaaagatcaccacagcatagtgctgaaaaaccaaagtccctgcacaggacatgattccatttatgtttcaaaaataagacctatttgtatatgtgcccatagatgggtatataaatgcatagaaaaatagctgggacagtgcacaacagctactaacatattacctgtgtttaaaatttggtaaaaataacacttaagtttattctggtaaagatgcccccccagttacaactaaaatatttgaactatgtacagagctggtaacttaattggcatgtatgaaaataaggcttatagacctggcttatacctgtaatctcagcactttgggaggccaaggctggtggatctcctgaacccaggagttccagactggcctgggcaacatggcaaaactttgtctctacaaaatataaaaaaattagccaggtgtgctggcacataactatggtcccagctactcaggaggcagagataggaggatcaccggagtccagggaggtcgaggctgcgatgagctatgaccatgccactgcactccagcttgggtgacaagtgagaccctatctcaaaaaaaaattttttctttaatttttaaataagaaaataagacttatgtacttgtgttacccttagagttttggtctcctgattattgtgtggcttatgactgttgtattttctttcttgaaatttagaaaattaccaaagaaatggatgacttcctacaaaaattgaggcagaagatcaaaatcggagtggtaggcggatcggactttgagaaagtgcaggagcaactgggaaatgatggtaaatgatgggttgctaattacatctggtaaaagattaacttcttatgaggatattgttgccaagtatcataggctgccctaaaaccttgtccccatatggcgggctttctgcttccttttttgggaaacattttcttggcctttgcttttcctctgcttttaatccagtacatttctggagttactgatggagaactgggtactcagatgtgtgagtagattcacctagaaaggtcagtggctgtatctgcacatgataatctctctgcctggaatacttcttgcttgtacccgttgacagcccttctagccccagtcagaccgatcttcatattgtccctctgacagcccccctcacctccccatcactgaaacagaatctccagcacaggaccccgaaaaaccagagaggcttattgaccccttcactggagagtctgacttgataggtctgtggagcctgggaatcctatttcagtgagtacctctgagagattctagtgtacaaccttgctaatgtagcattctgtaattattgtaaactatccgattatatgtttttgaagagcaggagtatgggttattcatctccatagccacagggcctcctggcctgtaagaaattgtaagtggatgccaggcgcggtggctcacgcttataatcccagcacttggggaggccgaggcggatggatcacctgaggtcaggagtttgagaccagcctggccgacatgatcaaaccccatttctactaaaactacaaaaaatgagctgggcgtgatgacgggcacctgtaatcccagctactcaggaggccgaggcaggagaattgcttgaacccaggaggcagaggttgcaatgagccgagatcacaccattgcactccagcctgggcaataagaacgaaactccgtcttggaaaaaaaaaaaaaattataagtggagaggtggatgaattgattgttcttttaacccctgttgtccccagagtcctcacatcttggaaccagctcctctagagcaagatttctcaccttcgcactattgatattttggaccagttagttctccattatgaaggctgtcctgtgcattgtagggtctttagcaacatcccaggcctctacccactagatgcccacagcatacacacacgcacacatacggctatgactaccagaaatgtctccagacattgccaaatgacctctgtgtaaaattacccccgtttgagaactactgttctcaaagatgtaatatgttacagtccaaatctgtatggactgtatttataggatcaccattactagaagagtaatctctgcaatctctttaaaactctctcttccacttccacttcattttcctggtagatctcctacttagaaatgctataaaccgcatactggggatcacgaagccctgaaaatcctgttacctgctcatgatcgccctttctgcatctagttgtgtatttaaccacttgctcagggaagttttgtgtagtgtagcatagtgtctgcacctgtcagagacatgcaacaatagaatcaaaacattcacaggccaaaagacagttgaaggcccacctgtatcagaatcacctgggaagcttattaaaatatgagtgtggggtccccacccaacacataggggatctgcattttaacaggtacctgaagtttgagaatcccttcattaaggttgacaacatggatagtttccaaaccaaactgattataagaatcactgaagagctttttttaaaatttattttatttatttatttatttttatttttttgagacagtcttattctctggtgcagtggcacaatcttggctcactgtaacctctgcgtcctgggttcaagtgattcgtgtgcctcagcctccgaagtagctgggactacaggcgcccaccagcacgcccggctaatttttgtatttttagtagagacggggttttaccatgttggccaggctggtcttgaacttgcgacctcaggtgatctggccaccttggcctcccaaagtgctgggattacaggcatgagtcaccgtgcctggccaccaaaggtcttttagtgctttgttttttgttttttgggttttttttgttttttttttttttttttttgacgttagacagagtcttgcaccgttgccgaggctggagtgcagtggcacaatcttggctcactgaaccctctgcctcctgggttcaagcaattctcctgcctcagcctccggagtagctggggttacaggcgcacaccaccatgcctggctaattttttgtatttttagtagagacgggggtttcactatgttggccaggctggtctggaactcctgacctagtaaaaccccgccagcctcagcctcccaaagtgctgggattacaggtgtgagccacaccgcacccgacccaaagagcttttttaaaaatatatttagcctgtccctcagcaattctgattcaggaagcgagagagcaaagcttggaaatctgcattttcacactgccctggttgctgctggtgaaccatcagcatcatggacgagtatcttcctctacagacagtcaggctgaagtcagggacataagataacctgtcaccaagtccctaatctcctgcccagtcatcatcgtttaaatgtgtaaccaaaaagagccattaaaaaaacaaggaacttttttccatactcttctcttagtctgtaagatgagatagtctttcacagtccttgctggagtttagcggttttattggtggtcattgttaatcaaggagtaaaaacacaggttttgattctttgcattctaagtgtttttttggttttgattgtagtggttgaaaaatacgattatgtgtttccagaaaatggcttggtagcatacaaagatgggaaactcttgtgtagacaggtaggttcttgagtatctgaattactatatactattaaaagtgttttctaaaagggcatttcacaatgaatgcctctaggaagatgaggaacgggtagaaatgaatctttactctgtattttttgttttgcattttgaaccatgtgactattacatattctacattgataactaaatttttatactttttaaatctaatatttctctcttttcttattttgtttttgagacggagtcttgctctgtcacccaggctggagctggagtgcagcggcacgatctcagctcactacaacctccgcctacctccgcctccctggttcaaacaattcttacgcctcagcctcccccatagctgggattacaggcacacgccaccacacccagctaatttttgtatttttggtagagacagggtttcaccatgttggccaggctgatctctaacccctgacctcaagtgatccgcccacctcagcctcccagagtgctgggattacaggcatgagccaccacacccagccttttcttctttttttaaaaagatggggtcttgctgtgttaaccaggctggagtgcagtggtgcaatcccagtggcctagaactcctgggcacaggtgatcctctgcctcagcctcccacgtagcagggactaccggcacatgccaccaagcctggctttaaatctattaataacatttctatgatgataaaactagagcagactgcttcactataagcatttttttttttcttttttcttttttcgtggtggaatctcactcttgcccaggctggagtgcagtggctcaatcctggctcactgtaacctctgcctcctgggttcaaatgattcttgtgcctcagcctccctaggtgggattacaggcatccaccagcatgcccggctcatttttgtatttttagtagaggcagggtttcaccatgtttgccaggctggtctcgagctcatgacttgaagtcatccacctgcctcagcttcccaaaatgctgggattacaggtgtgagctgccacgcctgggcactataagcatttttaagaggtactgtgtagctcttagtagtagtaagatcattctattcagacataagagaatgccgaagtggaacaaatatattgtctgtcaatatctggagatattttaattgaataaaagtggcagcagtaagctctttggaccttacaggaagcatttgaacaataatgagtacaaaaatcttgggtgatgaagcagaaaatgcttttgactaaagcttttctggcttgcctaatgcttttgaccagagaaataagagaaggaattaaacagacagtggggcatgtcaccatcactgctacatcagcctactgattttcagcaatcgtggctgaagaccctgggtttgctatgaagctgttttgaaaatgctcctgctaaatcaagtaactcaagtattttcttcatctagaatattcaaagtcatctgggtgaggccctaatccaagatttaatcaactactgtctgagctacattgcgaaaattaaactcccgaagaagaggtgggtttgcttttaacaaagaggcgtcacaggaacatagcgtagtgtcacatggtgggctaatgtgggcattctccaaataggattataaaaatcacctaaagagttttaaaaacaaagtctgatatttagcccgccccttggcaattctggttcagaaagcctgagagccgagcttggaaatccacattttctctggctgccctggtgctgctggttcacagcagggttcagtagccaccatgggccagcgaatttaaatccgaatcccagcacttagtaaggaataattggaaacagtccacaaagccaacagtacaagaatgattacgtaaatgatggcttatccacatgatggaaatttatacaaccattgaagaccatatgctttcaaaggctgtcagtgagaggaaacagcagtgaagcagcatgtacaaaaagcaacagaaaccctagatcgggaagtctgagacaggaagccttcgggccagatccacgtaaaacccaaatctggttggcctgcagtgttaaagaaaatcggattaattgccatcatgtaaaagtctgattttatgtttgttttatttatttatgaatttatttttgagaccgagtctcactctgtggccgaggctggagtgcagtggcaggatctcacagctcactgcaacctccgcctcccaggttcaagcaattcttctgcctcagcctctcgagtagctgggattataggcgcacaccaccatgcccagctaatttttttttttttttgtatttttagtagagatggcatttcactctgttggccaggctgatatcgaactcccaacctcaactgatccacccaccttggcctcccaaattgctggtgtcaaaggcgtgagccaccttgcccagcctgattttatgttttaaacatctggatttctggcttctgttggcaaatctgagacctggctactccggctcccagttacctgccggcaggtgccacctgagcagctgccacctgactcatagacatttgttccagtcacagactgcttctctcattttctgtctccctaggctttctttttgtttttttgttttgttttgttttttgagagagaggatctcgccctgttgcccaggctggagtgcagtggcatgatcatagctcactgcagcctcaacctccttggctcaagtgatcctcctacctcagcctcctgagtagctgggactacaggcacatgccgccatgcctgactaattttttaattttttgtagagatagggtcttgccatatggcccaggctggtctccaactcctggcctcaagcgatcctcccacttcactctcccaaaatgttgggattacaggcattagccactgcccctggctttcataaatgtttggtttggggacctaccttctgccatgggtacaattatctcagttccatttttaaaataatagtaatactaataatgatgaacataaatgccgacagtaaatttaaagactggcaggaaatagacccaaatgttaacagtggctatttcttgatggtgaggttgcaagtgatttctttgaaatccttctcatttttacccccagttttcaacacttactatgtaacaccttaatcatcagggttggaattaagtggcaattcaatttcagggctgggtgtacttcagaggctgcttcacactattaggattcataacctgagcgcctcctgctcagcatctccagccagagtgcaggaatgtcccttagccgagggggaggcctgcatgagacaggctggacatggacttggttattgttgcagctgggtaatgagcacatgaggacttatcctattctgtttacttttgtgtgtgttagaaattttccatggcgaaaagataaaatatacaaatatcccaggtcagttccatttttactttgggctgagcactaagggaggatttaaaaaaaaaaaaggcataatcctgtcctcaaagagcgtatcatttagcgagggagagggatgtggagagccataattccagaacagtagaagagacctggtgaatccaggaggcagaactgagacccaccttgatccacatttgtccacatttgcctgacaacactaactacatgccccacgacggccaggcagatgcagtaagacttcagagagcccaggtctttagggcggaactgattgcttagtaaaccaccttcagccttgttttggggaaggctttctaaactgcatcaacttctctctgtgccttggaaatgagaagaagaatatgtccttgagtgggggggcattaattgagctctttttctgatcattaggacctttagccctagggtcacccggggcacggtcacccgtcccctagtgcctcagtgctcatacacacgtggtagaggacaggctgggcctctgccaactccgggacggcctggacatgggattattgagagagatttttaggctcgcatattttgttacatcatttgcctctttctctgcaagttgagcaaaataggagagaggatccagacgattgagattttgctgtttttactttaatgagtattcattgcttcccagtttacaaagtacctttacataactggcatgtttgatttttaacaaggccctttggaggtaaccagagcaagtgccattagcctttctgtaggtgaataagaggaggcttggagaggtgcccagagccacacagcctcctaagaggccacactgacatggaatcaggtcatcagccctgcacgtggcatgtggtctctcggtatttccaatggccaatgcccaggacatcaggtctgtgagattaaaatagtagaaaaaaatgagggaaaatgtttcataagggttcccaagcatcaacgtttaaaaactggaaaaacacttttcactgcatagtttgtcaaaaaaatgcttaaaatttcattggtcagaatgatatttactttacaagttatctgaccttttaaaaaattgggttggtttcttttttttgctgtggggtttttgttggtttgcttgttttgttttttttgagacagagtctgtctcccagactggagtgcaatggcatgctctcagctcactgcaacctccgcctccgggttcaagcgatcctcctgcctcagcctctcaagtagctgggactacaggcatgcgctaccatgtcccgctaatttttgtatttttagtagggacagggtttcatcttgttggccaggctggtcttgactcctgacctcaaggaatccgcccgccgcagcatcccaaagtgctgggattacaggtttgagccaaagaaactgttttcagactcaaactggaaaccgtggaaaaaaactctttgttttttgttttttattttttgtttgttcgtttgttttttgagacggggtctccctctgttacccaggctgtagtgcagtggtacgatcttggttcactgcagcttccactgcccgggcccaagcaatcctcctgtctcagtctcccaagtagctgggaatacaggcatgtgccaccatgcccggctaatttttgtattttttgtagaaacggggttttgccatattgcctaggctgctctcaaactcctgagctcaagccattcacccaccttggcctcccaaagtgctggggttaataggtgtgaggtaccgcgcccagccaaaagaacatctttaaacatcgtcatttgaagtgactaaactaatgttagcttctcattttctgtgatcaaatcaaacatttaggagctgtctgctactgggtaaattgaatttcctcagttattactgaggctcgttggacaattctcagagcctttttctgtgtagctttgcttggtactatcagtctgttcagaagctccgtagcaaaatagatgtctggtacatgtattttcaaactcttcagggaaatgactgctgttgccagtgctggaaatcattttcatagctctttattaaccacaaaattatctgcccagtagcagcactgtgcaacagaaatagaaagtgagctatgtataattttaaattttctgtagccacattttgaaagaatgaaaaggaagaggtgaaatgaattttaataatatattttatttagcctgatatttctaaaatatgacttttttttttttttttttgagacagggtctcactctgtcacccagactggagtgcagtggtgtgatctcagctcactataacccctatctcccaggctcatggaatcttcctgcctcaacctcctgagtagctgggattataggcatgcataaccatgccaggctattttttgtattttttgtagagacagagtttcgccatgttgtccaggctcaaaatatgagcattttaacacaaagtcaatatacaacatgattgatgcaattacattcctttttcatactaaatctttcaaatctaatctcaattcatattagccacatttcaagtcttaatagtcacagtagttcatggctaccatattacatagcacagagctgagaaacattgaccacactagcctctgctttttagaatttcccaagattttaggctgtttatctatgatgttgcccaaatgaataacgtgtttttggagaaactctgtcaccctttcattcccaggggtactttcattgaattccgaaatgggatgttaaacgtgtcccctattggaagaagctgcagccaagaagaacgcattgagttctacgaactcgataaagtacgtctttctgaaatacctttggtgaatggctgggtttatggaaataagatatggcctggtgtggtggttcatgcctgtaatcccaacactttgggaggccaaggcaggaggatcacttgagcccaggagttcaagaccagcctgggcaacatagtgagacctcatctctacaaataataaaaacaaaaattagctgggcatggtggcacacacctgtggtcccggctatttgtttggctgaggtaagaggatcacttgtgcctgggaggttgaagctgctgtgagctatgatcatgccactgcgctccagcctgggcaacagagcaagacccccatctcaaaaactaaacaaataaataaatcaataagataatcctacctttgtggccagtagttaaaactgtgctttctaaactgcaatacaagaaacaattggtatctttttgtttttctcagaaagaaaatataagacaaaagtttgtagcagatctacggaaagagtttgctggaaaaggcctcacgttttccataggtattgtatatattgcctgtgttccaaacttggatacccatttcccagagtttgttgtgggccagtgagctattgataatgaagtatgtgcagttttaggtgggcaggaagattaaatgagcagtccagtctatagacaaaaaccaaccactctcttttctgcataattagccataataggacttgcctagtcaagaaacagcttacacgctgttgggcttggttctaaattcttacccaacagcattcttcctacctggactcctctcatcaaaagaggagcactttgattactaaagagtaggaacttctcacacctttgggcagaagagaagcactatagtgaactccataagggagacatggaattgaaccccttaggtaaactagaccgatgttttggaatcatagaatgtttcaacagcaaggaaccttaggggccaattgggtggcttttacagatcaagaaactgaggcccagaaaggagaagagacttgtccaagttcacaaagctgttgtttacacagccagtgtgtgaacgtttctggtgtctaatgcagagttcttcctgcagcacggacatctcaggcttgtcttttgttagaatattcctgccaaatgctttgcacaccgatttctcttgtcagtgctaatgagtcattgctcaaagcctcctcattttactagctttcatcaaggtagaggttgtaggaaaactggaatggcaaagggattatatttaacagatgagtgggtgggttttttgtcttcctgaactgtgagatggacatctttctgacaaagctttgaaagggtttttgttgcccgtgagcactgcctgtaaatcaccttcagtgaagattctcatttttcccgcaaaatatgccggatgcaacctgcttccgggcatttccccctgagggtgtgttaaagcccgagacaagcacagcagaatgaggctggtatcagatttttcataagcatgcttcctttaaaccacacgcttgacagggcgcttaaacgcaaatgcatttctcactctgagttggcattctgtgcctcaattttagacctatgtgaaataatgctggaaaaaaacaatgtagaattaatttctagaacctatgcatgaagtagtctaagtagcaaactagagtactgaaaatcaaccttggcaacccactaactgacaaaagagtaaattgtttttttcagtgacatatcattagcccctttttcaccttttgcctttgtgtgccccgtccccacccggcaggaggccagatcagctttgatgtctttcctgatggatgggacaagagatactgtctgcgacatgtggaaaatgacggttataagaccatttatttctttggagacaaaactatgccagtaagtagagaagtgtttgtgcaccttcattgttgcatttgcgcttgatgggggaaattgacaactgggctgtttttcctgtacctacactttacccacccgccctgctcaaactgagcagtggcttctgtcctggagaggtgggtgattgagccaccttcccctctaagctcagaccccctacgcctctgtggaggcaaggatcacactgcatgttagttgaaccttttcaccttggctttggaattaaacgttggccaccctatgtgccttccagaataccagtccccggtgccactgtcaaaccctctgcgtttcaaagctctggctgtttcaacctcatttttccactgtatttgtccacccgaggcattcattctaagttgaacacgaggggccatgaacgatgggaggatagggaatgatctcatgagcctgaaacaggagaggacaccagcaacagcaaagaggccaagtgagtcccaggcatcacacacggcgggtgcttggagctgcccccaagggatgtcagaaatctcgagttcagggccaaatctaaactgagaactgagagcagagcccagtgttaaaggccagggccagcaggaggaatacatagaagaaatgcccccaggtgtcctctccgtggggcaaggtggatccccaggaggtcagagaggcgttgctgccatcaaaggcccaagaggaggctcatcaccacccagctttgggccagctccttttctttctcttttttttttttttttttttctgagacagagtctcgctctgttgcccaggctggagtgcagtggtgcaatcttggctcactgcaacctctgcctcccaggttcaagcaatccttgtgcctcagcctcctgagtacctgatattacgggcatgcaccaccacacctggctgatttttgtgtttttagtagagatagggttttaccatgttaaccaggctggtctcaaacccctgggctcaagtgatccaatcaactcggccgctcaaagttctgggatgacaggtgtgatttttagtacagacagggtttcatcatgttggccaggctggtcttgattcctggcctcaaggaatctgcctgcctcagcgatccacccacctcggcctctcagttctgggatgacaggccgcgcccagccccatcaccttttcagttactcccatcctctgggcccctctgcctccctcccacatgcaggctgggggtgttggttaccttgccatcagcaggcccgtgtcaggctttctcgccatcctgcacctagcaggtgcatcataaatgctgcatattcagagtttctcatccctctgatctctggtccactccaaaatccttgctgcactgctaagatctacccatgaaagatttgcttttcagcagggtccccacgtcacagtcttccagcatgaggggtacacagtggtagtagaggcttgttacttattttcagaatgataaaactgaaacccataaagggtaagggatttgccgaaggtcacacggctaatgacagagctggtggcaccagaagaagtctacctgttctttgtatgttttaaatagctttattgaggtataattgatcagcaaaagctgtacatatttaacgctcacagtttcgtgagtttaatcattgtgcctctttggttttgggggcggtttgggatttttttgttgctattgttataagaacacttaacatgagatattccctcttaacaagtttctaagtgtacaatacagtattgttaactataggcacttctgtttgtccaacagatctgtagaacttacacatcttacataactgagacattacacccattgaacaacaactctccatctccctcctccaccgccccgtccctggcaaccaccgttcttttctctgcttatatgactttagcacctttagatatctgatacaaggggaatcatgcagtattcatccttctgtaaggggcttattcactcagtatgtcttctcagtttactcatgctggcacaaatggcaagtttccttattttttaaggcggaataatgtttcatggtatgaatacactatattttctttcttttttttttttttttcttgaggcagaatctcgctctgtcgcccaggctagagtgcagtggcaccatcttggctcactgcaacctccacctccctggttccctggttcaagtgattctcgtgcctcagcctcccgattagtggctgggattacaggagcctgccaccacgcccggctaatttttgtatttttagtagagacagggttttgccacgttggccaggctggtctcgaactcctggcctcaagagattcacctgccttggcctcctaaattgatgggattacaggcgtgagccaggcgtgcccggtcagaatatactccattttcttgatccattcttctgtcagtagacacatgagttgtttccgtatcttggccattatgaataatgcttcagtgaacacgggggtacagatacctctttgagatcctgacttcgtccttttggccatctacccatggattaaagacttaaacacaggacctgaaactgtaaaactcctagaaaaaaaacatagggaaaaagcaatgatattttagatgtgacaccaaaagcacaggcaacaaaagcaaaacaaacaagttggacaacgtcaaactaaaaagtgtctgcacagcaagggaaataatcagaatgaaaaagcaacctacagaggggaagagaatatttgcaaaccatatatctgataaaagggctagtatccaaaatgtataagaaactccaacaactcaatggcaaaaaaaaaaacaatttaaaacatgagcaaaggacttgaatagacagttctccaaagaagacatgcagatggccagtgggtatataaaaaaaggctcaacatcagtgttcagggaaatgcaaatcaaaactacaatgagataaacctcacacctgccaggatggccattttattttattttattttgagacggagttttgctctgtcacccaggctggagtgcagtgatgcgatcttggctcactgcaaccactgcctcctgagttcaagctattcttatacctcagcctcccgagtagctgggattacaggcgcccgccaccatgcccagctaattttgtatttttagtagaaagtgggtttcaccatgttgccagcctgtctcgaactcatgacctgaagtgatccacccaccttgacctcccaaagtgctaggcttataggcgtgagccaccacactgggccaggatggctaattttgttttttttaatgttggtggctgggtgnnnnnnnnnnnnnnnnnnnnctcagtcccaggcaagcactcaataaatgttagctagcaatactataatcatccttttttggcagaataaggttcagagaactgaagtgacttgcccacgatcacccgtctagaaaacagtagagctgggtcattccactgcctccccaggggaaggacagaatatagaaaacaggccggcacagtggttcatgcctgtaatcccagcactttgggaggccgaggcaggcggatcacctgagctcaggagtccgagaccggcctgtccaacatggcgaaatcccgtctctactagaaatgacaaaaaattagctggggttggtggtgcatgcctgtaatcccagtcactggggagactgaggcaggacaatcacttgaacctgggaggtggaggttgctgcgagccaagattgcaccactgcacgccagcctgggcgacagagtgagactcttgtctcaaaaaaaaaaaaaaaaagaaaacgaaaactgtgcctctttaacaattattttttggttttattttattttttgagacggagttttgctctgtcacccaggctggagtgcagtgatgcgatcttggctcactgcaaccactgcctcctgagttcaagctattcttatacctcagcctcccgagtagctgggcatggtggtgcacacctgtcatcccagctacttgggaggctgaggcaggagaattgcttgaacccgggaggtggaggttgcagtgagctgagattgtgccattgtactccagcctgggcaacaagagcgaaactcggtctcaaaaagataaaataaatgttggcgagggtgtggagaaattagaacccttgtacactgttgtgggaaatgttaaatgtcatagctatgatggaaaactacatagtggttcctcaaattaaaaatagaactgccatatgatccagcagttccacttagagatatatatccaaaataattgaaatcaggatcacaaagagatacctgctgtttaaaataaaataaaataaagacagggtcttgctgtgttgcccaggctgtactccaactcctgagttcaagcaattgtcccgcttcagcctcccaagtagctggaattagaggcgtgcactaccacagctggtgatacctgctgtttaaatgagtgtgctttccactacgataagctctctctcagtggggtagaaagatcttgttctaaatcccagatgaactgggtactttgaaggaggtgtagcattcaggtttgttcttaatggcagttacatatggttttataaccacatccttttgttgaaatgcttttgatgcagaaatgctttcagtgcaggctttgaaaaagatcaccgtctgacttcatgtctttaaaaaaattaagctaatgaaatgacacctaggatctaagggatgcccggaagcttcctcagtccttctctagcttggtgccatttcttgtagacagagaggagagctattaagacacacgacagcagattgttctgtaatgatgacattcttgcttcatgtaaatagccatttagaagcctcagttgggactttgcagaatggaatgcagttcttggataatcagaaaatgacttattttgggaattcttcatttgggaattagagggttttctattctgtttaaccattgcattaccatgcctggattctatttttaaaatcttacctacgttttaaaaaatgagtattatttaatggaagctttcccccaattgtaaattaacctgtgcattcattatagaaaattagagaaagtacgaagaagaaaaagaaagtcacctataatcatccaacaatgtcccagcctttctatgtatatgatcccaaaagtgggatccttacatgttgttttagttttagttttctttctcttaacgtattttatttttatcatattagtgaatattctttgcaaagaagatttttttttttttttgagacagagtcttgctctgtcacccaggctggagtgcagtggcgtgatctcggctcactgtaagctccacctcccgggttcacaccattctcctgcctcatcctcccgagtagcttggactataggtgcccaccaccacgcccggctaattttttgtatttttagtagagatggggttcaccatgttagccaggatggtcatgatctcctgacctcgtgatccgtccgcctcggcctcccaaagtgctgggattacaggcgtgagccactgcgcctggcgcaaagaagatttttaatggctgtataatattctctcattaggcatcagttactcacctcccttgcagaggcacgttgggtggtttaaggggttttgctatcataactaatgctgtggtgaacattcttgcacgattctttgcccccatccctgatccttttcgtcagcggttttctagaaatggaaattagcagtccagccatgtaaaccttcaaacaacctatcagttcttgaaacttcaggtgcagagcaatccaaatactagccttacactttgcattttcagtgatagacatttagaaagctggggttttttcctttcctaatgaagtttgatgtttttgccggcgtccagggaagtgatcctgagctgaggctgtcagtaaaaaagccatttctcagccaggccctgaggcttagcagcctcttccagcagcacagcctccaggaggcagagtctggtgttacataaagggtgccatctgcttggagcaactcgagagcagagtgaggaagtgtggcgttggccgttgcttttcaaaatatttgccatcttcagaaaccctgtcattcttcccatcagccacaaaagccagtgtttcttaaaatctggctctgagttcagcatggaggccctgggcctggcatggagtaccttggtttgttgcagagagagagagacggcaagggcagagagcacacaccacacatggctctgcatggctttccagaaaccaccctggctggatcaccctcagccactctgaattcgcaggcaagagaacctgtacttacccatgctttctgtaaaagtcatcttggctttaaggcagttgcaacatgaaaacattctaacacttcatgaatatcaagcagctggtttggtttttgacttgacgcttccattttgggtaatttggctatcagtgcactcaagcatgtgtgaaagactcacgcagagggttcagggttggggacagccccgctgctcctcaggaggctggccacatgacagtggtctgtctctgcactgggatgccatgtagctgtaaaaagagtccatgtggacccatctctagggctttttgttaggtgatcaaagcaaagtgcaggacaatataagtaatgtgctggctacatttttgtctaaagagggcaaaggaatttctctttttgttagcttataaatgcataaaaggagtctgaatggatgaaatttacagaggttactgtgggggtggggaggacaggagagagaattgccacctaggtcttaactctttcttaatatgtttgaactatatgaatgtgctatctattgaaaaataaaatttttaaatcaacttgagaaaaggatctgagtaatccctgtaatcctggctactagggaggctgaagtgggaggattacttgagcctaggagttcaagattatagtgagccacgattgcgccactgcactccagcctaggcaacagagcgagacctcgtctcttaaaaaaaaaaaaaacaataaaaattaaaaatttttaaaaattgaaaaaagggaggaaatgtaaatcttccagcacttcctcagtgtcagaccctgagctggacacttatgttgtacatgctcccaggggagacagcagcatcctccctcttacagaggaagcacagtgggaagtccagggtctcagctagtcagagactaagctgggatctgaaagcctcgcctctgtcattctcctacatcgcttctaaaatgctacctgccttccttttaagtaaattgtgcaacattttattctccagaaatgttaataaggaagatctgcctttaaaattagcttaaaaatacaaaaattagctgggcgtggtggcgcatgcctggatcccagctactcaggaggctgaggcaggagaagcgcttgaacccgggaggcggaggttgcagtgagctgagattgtgccattgcactccaggctgggcaacagagtgaaattctgtctcaataaacaaataaagaaaaacaaaattagcttaaaagaggtttgtatcagtgtggaccatgttgacccagatctggccccaccattcaccagtgaccttgtgacagtgaggacagtgacagtgacctcgtcagcccagtgaggacacagttcttctttttttttttttttttcctgagacaaggtctcactctgtcacccagactggagtgcagtggcgcaatcttggttcactgtaatcttgaactcctgggctcaagtgatcctcccacttcagcctcctgagtagctgggattaccggtgcccaccaccacgcctggctaatttttgtatttttagtagagacggggtttcaccatcttggccaggctggtcttgaactcctaacctcaagtgatccgcccaccttggcctcccaaagtgctggaattacaggcgtgagccaccactcccgaccacagttgctcttctgaaggagtcatatgagaatgaagtgaaggcatctgaggaaagtgggtgacgcagggcctgactcaggaaaggcagctgggacatgcatctttggcctggtccacaaccagcgtctgcttccttcactttctaagaaagttattcaaaggctcatctgttattgagattttcctaagagattggagcctgccaagtccctcagtgaagggccatccttgtgagtgagcaccttcctacacaccttccaacagttcattagagcgtgaattagtgaaccatgtcctcctgtcctcaggttccaagttaggctttggatggcagttggcctttgcgatcctggacttaaccatgcctagcatctgtagctctttcaggactcaaggctaaggagggcacagaatggattctgtggatagatctgtcttactacttattgctgggaccacatgatttgagacccaggtcttcttgtgtggctggtggcagacttagcttcttaacatgtgagtccctcactcctggagggaccctgagtgaattgccgctcccacagtcagcttccagaactgactggcagaaattgatgagaggttctcagcctggtggagatgtcccacccgctcctgtgtgggaggccaggaagcagggtgtcatgcatgggagccacgagcttcagatgttcctgctagcccaccttcctcctgagtgccagactccacagagtccatggccctgggtgttggtcccaagaataggactgtggctaacaaccagcccacagagtgagcatccctgcctgtgtctgtgctgaagctctttcattcagggagacactggcttcaaacccctggagtggggctggccttccagggagccccttgatgtccgcagaatcggcatctcctgtgggcattccaggcccagatccgtcacagagctgtctcctctgcccttgaaggccggagaggtgaaatgagagggctgtgctcagagccgtcaacagacccaagggtcactcgccctagggccactagccccttggccagctcaggttccaccctcgcccccaagccaaggggtgttttttcctagattctaagtcactggtgctcagccctggatatatattggaatcacctgatcactttcaaaacatcatgaccctgggcttgggccatgccccaaacaagcatttttaaggcatccccagggactctagccagggagagccactactgctctacgccatttcagagcaggctcttgtctcattggccctgtaactgcccaacaggttctccttgcccactgcctagacaagagccgatttatcaagacaggagagttgcagtagacaaagggtaattcacgcagagctggctgtacaggagactggagttttattattcctcaaatcagcctctccaagaatttggggatcagagtttttaaggataacttgctgggtaggggcttgggaagtggagattgctgattggtcggcttggagatgaaatcatagggggtggaagtgagtttttcttgctatcttctgttcctggtgggatcaaagagctggttgagccagattacctgtctgtgtggcatcagatactgcatcagaacacagggtctacaaaatatctcaggcacaatcttaggttttatgacagtgatattattttcaggagcaatttggggaggttcagactcttgtagctaatttgttagtcctacaaaggcagactggtccccaggcaagaagggggtttatttcagggaaagggctgttaccggcattgtttcaaagttaaactataaactgaattcctcccaaggttagtttggtctgcatccaggaatgaacaaggacatcttggaagttagaagcaagatggagtcatttaggtcaccatcataattttctcagttaaaatttttgcaaagacagtttcagttcctcctgttgggttttataataccttattcctaatacttcatactgtgggatatgaagatgggaaaagagtgataaccgctctagcttctttctgctgacagggagcgtagtcagggtaggtgttgacccaaaggtaggaggagtgaaaccactttgcagctgtctgcttctactcaggggttcctggttagggtttgaaggcctgcatgacaaaggcattagtattctcatctatagttttaacaaatgagtcctaggataaagagtgaaagtcctggcttcagaagcttttgtagaattgatcctaagctctgagggacccaggtaaatagctccaagaaccaatcagacatggggttactagcagagagagatttgggtcagaggttgttagacagacagattggggtagacaggaaagaggaaatttaaatatactcatccttatctttttagtcagttttcctagtcctaagactagatcagttcagttaaacagctgtttccattatcaagagatggcactggagatgggctaggcatctttagttatagaggaggaaggcagtggcaatttgacatgtttttgtcatctgtattacaaagaataagcttcagcttgcagggcctcaggaaaaaggtagtagcaatttaattgagtccaagtcagaaaagtgggaaaaaaaaattgaaagcattagtttgggaattgtagcccacagagaattcaggatttagtccaaattgcaggaaataataaaaactcaagaacaaaggacaagactagaatctaacagcagggtgtatcatagttttttgaaacacttttttccctctcccatccttatttttattaaagacaaaccgtagtaggacaagtttacttgcaaaataagtcatagtcttattaagcttggcctgattatttgtataaagtaaagcaagaataattgtttgccagataggctgtttttaaaattggctttgctgaaactttgttccataagaaatctcaggttagacttttttaaagcctcgagcccagccatggatttatctactatacctgcaaagataaacctgtatgagttgggtgaaattttttcttctcatggtcctaagataatttggggctcctgggcctgtcaaaaagtgacagtctttatttaccacagttcaggaaccccgtacagggactgtgtagacaaggtatgaggccagcttttccaagggacttctattggctctgttagtcaactttgttccttaaagcagtctgtttatatttgaaagtatgtcgtaccagtcaaagccttggtaaagtaaccggcatctctaattgtatcctattacaaaagaaaacagattgttactgcccttgcacaaataattatactgccataagttgagaatactcacaaatagtttccaaattctggagaaatcagagagaaggcaatatgctctaaattttgctcacagaagtatactttaactcaattgttaaagttataaatagctcaaaagaaaaatagttttctggactctgaaaaacaaaaggattaacaatgtttaacacatcagctctccatgaggatcctagaagttttttttcctccattccaatggcacaatttgtaaagttatcagagacctgcattcaagagtacccattagagtactatatctgattataaactgccttttgaaaaggataaaaccaagacagcaactgcctgtgggtaacaaaagtctcaggacagccgtagttaaagatgcagtcaacaaggaaatctggtcatctctgtgacacacagtttaacagaacagttataattattactcataacatatactgagacgtatcagaattataggagtcttacacaattttgtaacacatactaataacatagttatacgactataaacccaaagaaagttaaacacttttttatatttgacagtgcttcctacataattttaatacaccaaataagccaaatatgcctcttttggactttaggggactttttttttttaacttagaatttgatcttgggaagtttgttaaatatcaaaggtttgaaacactagatatcacaaagtagaatcccaggtcaccataagtaattcatttagccacaatgataactcaaacattttgtaacaggaaaaacctttactctgatagagagaagactcagctttctaaacaacaaaacccagtgaagatagcatgaggccaactgaatctttcttttattttttttaatagtttactccaaagccaaataaaaatctttcattgtctctctctgtcaatattacataaaaatattcttcaaaagagaaaaccaaattttatctcgcattagtgcatctttaatgctaaagctagttttgtttttgttgttgtttgaggtggagtctcgctctgttgcccaggctggagtacagtggcacgatctcagctcactgcaagctctatctcctgggttcatgtcattctcctgcttcagcctcccgagtagctgggactacaggcgcgtgccaccacgcctggctaattttttgtattttttagtagagacggggtttcaccatgttagccaggatggtcttgatctcctgacctcgtgatccacccacctcggcctcccaaagtgctaggattacaggcatgagccactgtgcccggcctgttgtagttttgagacggagtttcactcttgtcacccaggctggagtgcagtggcatgatctcggctcactgcaccctccgcctcctgggttcaagcgattctcctgcctcccaagtagctgggattacaggcacccaccaccactcctggctaatttttgtattttttagtagagactgggtttcgccatgttggccaggctggtcttgaactcctgaccccacgtgatcgcccacctcagcctcccaaagcgctgggattacagttgtgagccaccactcctagccaaagctagtttttaataaaattttacaaacaaatgtatccgattttagtttgactgtagggtaacattttcataaaccttttatataaccctttataattgtttgttaacaaatcagtgttcaaaaataaaacactattttttttttttttttttgagatggagtcttgctccattgcccaggctggagtgcagtggcacattctcagctcactgcaacctctgcctctcaggttcaagcaattcttctgcctcaacctcccgagtagctgggactacaggcgtgtgccaccacgcccggctaatttttgtatttttagtagagacaggatttcaccatatgggccaggctggtttcgaacttctgacctcgtgatctgcctgcgtcggccttccaaagtgctaggattacaggcatgtgccaccgcgtctggcataaaaccctattattttgatatatgggcccagattctggccctgcatcagtatgcttttaatatttaatttatggaaaaaattaaataataccctttcgattttagccagcttgctcacacacagagttgttcacaaagttaatttttcacaaacctacaatttgcttaaactttcagttttattttgtctttcaaccaaaaataatctttaaactctctaaattagagaagattttctcttttaaaaaaacccatattcccatgtctttaagcagttttaattacataccaagtgcagagcctagaatacaggacagaactgcagataaagtctgactctctctggcctagctaggagtcatggctacctccatatgtccccaggccttatctggaatctaatggctctaaagtaggtaaattgaacaattacaaaagtcacagaagccacttatgaccttaaagcatccagcagaaacagtatctgatctgcctaattcagaccaaatgaagacagttttatttcatcaataatctttaaaactatctttatttaccaaagattactaacgtcatgtgaactaaaatgcattagagttgctatttctttgacaaaatatttaagtgcttattttttaagccaattaattacagctcttaaacatcacacacacaacattataaatatatagaccgaagaagatgcattagttaagatttttcatttgctgattttttaggggttttttttccccattttacaaatcttgtcacgactcacagagaccatctatgccatgcttggactgtctgacttgtcctatgtgtccctctttcgtgaataatcagtcgttctattttaggacaagaatttaccatacaagatcttttctcatataaatttctttttttataatcatccttaccaaaaatacatctttatagcctcaacttttttcacatatctctttcccctactaaagtaattcctgatgccctcaaaagtgaaaaaggccaagtaatgtgattcaaaacagaacagagccttagattttgagaggggtctgtctgcttacacttcttggggttttatgaggaaaacagagtttctcccaaaacagggtctgtggagccttctctctttttcccaaggagtccccagctgtcagaaagtaccttaggtcctctcatgtgggcattcagagtggcaggaagacagactggggaaataattcagttgactgagaagaaagacaaacaaaaactcattcctcgaagaaaaaaaaaaaatccaggaagagaaaaagcacaaaggccttttttttatttttttatttttatttttatttttttttgaaatggagtcttgctctgtcacccaggctagatagagtgcaatggcatgatctaagctcactgcagcctctgcctcccgggttcaagtgattctcgtgcctcagcctcccgagtagctgggaccacaggcacacgccaccaggcctggctaatttttgtatttttagtagagacagggtttcactatgttggccaggctggtcttgaactcctgacctcaagtgatccccctgcctcagcctctcaaagtgctgggattacaggcatgagccactgcacccagcccacaaaggccttttaaatgtgtgcatatatatatatatatatatatatatatatatatatatatatgcacacatttatatatatatatttatatatatttatacatatttatatatttatataatatatattatatatattgtataatatataatatatatgttatatattatatatatgttatataatatatgatatatatgatatatattatatatattatgttttatatataatatatatttataaatatatatatatttataaatttatatatatatataaaacttggatatccatttttaattaagcagattttaactgtagaactctttttttttttttttttttttttacaaaatctttttaaatttcttattaccagactctagccaggatagacagccagtatttctggcttttgaactttaccacaggtaacctcctagcaaaattaataagtcttatctaagattatgacttaactacggaagtataagatgtctcaaagggatggtaagcagttttttgtttttttcttttacaagatttagaatctccccaaacgtagtttagagaaaagaaaatttaaggcagatttcaaggcaagctgtccatggtggggaaagaatcaataaatggcacacaaaaaaaacttacataaataacaaaccagagagcacccattccgtaagctgggaaccagacccaggctaccactgtgaaatagcaaagcttcagctactgagctaaagctgaaggctgttacactgctcttcctgggaatccaggactttactcaagataattcttaaggctagacatgacactgtcacatgtcctctcagaccagctaccgacatgaacccaaaaattcatgccctctggatgccggagaccaaaagagggtaccctgacatggtcccaaagtcaagtttttcaggacgtaaaacaagagaagagggaaaccttatctggtttttgttggagcaaagtttggaactgaccagtctgccaggctggattgaacagcgggcttagaggggtcctatgtccacatcctattctgtggtcctgctctccatgacagaggatgcagctgtgagtgggtttggtttgcgctgtatctccagctactaaagcaatgcttggcaggtagtaggtgttctagaaaggtgtgtcgtattaatgtgtgaatactgactccccctcctaagtcactgagtgaggagagaggatgtgtgattcatctgaggcatgcgagagctggttgtgcctttgtctttgtttttcttttttcttttgagatggagtctcactctattgcccaggctggagtgcagtggtgcgatcttagctcactgcagcctccacccaccgggttccagtgattttcctgcctcagcctccagagtagctggggatttgtattcacagcacagagtgcaccagattccctacagcctaagtctaggctcataagattttttctattaatcagacccttgcagaggagacaaacagtgatgttttccattcatacacggcgagaggggccagaagcctggctggtaagaaatgtttaccctttttgcctgcatgtcaggtttctgggttcccattctctgtagcttccagaagaacggagcagctcttgatgaccctgctcgctgcacgctagctgtgggcgccaagtcgcattgcaaaggaaaaccatccgtttctgttttatggaaccacaggcaaaagcctctcaatttttcaagatgctgcccaatgggctgcatggggaactgaattaacattttccatcctggccagagcagagtacacatgacaaaactagtcactatgctcagtgcccagcatcaacttggcaaggctcacacttgctcccgttggtctctgtcatctttgatccactccactcaaggtgggaagggacggcttccaccgggaattcaaaggatggtctctgagccagatggaagagcggatggtcaccctcgaggcagccctgtcaaacttccgagcttctgctgacaagtccttcagggttcagtgaatgtgaccaaccagacaaactaggagagcctgatggacttccttcagcaattcccttagacatctcctccacatatacaaacacatacagcaaaacaccttccagaaagagtttccagactaaatcacaaaccaagagtattcctccaaacaagtcccctattctctgtacaattagggcagataccccatgctggggctacaaacagataccacctaatagagctagagatgccccatgatggggctacaggcagacacccaatgatggggctacagacagataccctgtgatggggctacagttacaggacgtctccccaggactgtttattgcagttaaatccatacaccatgggttggcagcaccccattagtagagatggtgccagtgtcagcccccagtcgaagagaactaggtggccgcctgggctggcctctggatccatcaccagtgaggggggttggggaggctactgaatcactggaagatagccacaagggagatcacagatgagcccccaaatttgtaaccccctccacaggttctccttgcccacagcctagacagccaatttatcaagacaggagaattgcaatagactaattcacacagagccagctgtgcaggagactggagttttattattactcaaatcagtctccaagaatttggggatttgagtttttaaggataacttggtgggtaggggctctggaggtgtggattgctgattggtcagcatggagatgaaatcatagggggtagaagtgagtttttcttgctgtcttctgtccttgggtgggatcaaagtgccggttgaatcatattacctgtctgggtggcgtcaactgctgcattggaaggcagggtctgcaaaatacctcaagcactgatcttaggatttacaagcgatgttattctcaggagcaatgtggggaggttcagactcttgcagccagaggctccgtggctccaaaaccataatttctaatcttgtaactaatttgttagtcctacaaaggcagactggtccccaggcaagaagggggtttatttcaggaaagagctgttatcctttgtttcaaagttgaactataggccgggcagggtggctcacgcctgtaatcccagcactttgggaggctgaggcaggccgatcacttgaggccgggagtttgagaccagcctggtcaacagggtgaaaccccgcctctactaaaagtacaaaaattagccaggtgtggtggtgcacacctgtaatcccagctactcgggaggctgaggcaggagaatcacttgaacctgggaggcagagattccagtgagccgagagtgtgccactgcactccaccttggtgacagagtgagactccgtctccaaaaacaaaaaaaacaaagttgaactataaactgaattcctcccaaggttagttcagcctatgccctggaatgaacaaggacagcttggaggttagaagcaagatggagtcaggccagatctctttcactgttaacattttctcagttataatttttgcaaatgtggtttcagtccctgcatccataatacctagaaatttgataaatacttgttaaacaaccaaaataaacatccatagcaagaatcgactataaggcatggtggtgcacacctgtagtcccagctactcaggaggctgaggtgggaggatcgcttgagcccaggaggtggaggctgcagcaagacatggtcgcaccagtgcactccagcctgggcaagagtgggaccctgtctcaaaaataaataagagtcccgaccacgagctacagagagtccatctgtgctataggaggcatccacacagcacacacccactgctaccagcgaagcagttcacgcaggctgtgatagatcacactgttcctctctttggatgattggggttcactgctacactgcacaggtcagcaacagcatgtacagaaatgggctgcggtggggagactcatcagccccctggcatctgaacatggccaacactatgccttctgtttcatcctcagactttgggactattagggatttaaatattaatgcgcggatttcactgagccctggcctctctttggtgcctgtcaggtacactataatgagaaattggatcgttcattcttccctccccccttccctcccttctccagggaacagggtttttgttcttggagcttgggaggtggctgagttccccaactagaatcaagtaacctttagtgcatatgcaaatccagcatttgaaatttccggttctctagccttattattctagagggcagccagctttcctttcatttcatttggggtccgcttcacttgctttgcagctactctggtatgcaagctcgacacagccccaagaaggctgcaccccaggaaggagcccaccatgctctgagagtcacaaagaaagaagcagacccttggcgggagagaaaggaaggcctgaggcaggttgtgtttgtgatgcagatgctcctgcgagccgtgcggctctctgaaagcgggtggagctgagaagcaacccagagaggctcctgcagccagggtcgggaggatttcaccttcctggatgggaattgattctccagacctagctttattaagtgtcagcgagttacatgcacacagatcactcagattccacagacacctccccaccagcccccagcaggaccacgggaggagactcgtgccgttaggcctctgtccctgcatgtgacatctgcagggaagggcaggcctagcaactgtcaggggactagcataaaccctttttgcttcaggggtctcttcccaggtaatggcctctgtcctctttgcaccctggccggctgcaggagcctcctaactgctcccttcaattgcgtcctcaccccgcacccgttctccagaaagatcctgttgtaaagtaatctgatcatggcccgggcttgcaggcttcaggcggctacccgtgaaatcccaggtccttaccacaatctgtgaggcccgctgtggcccggccccagcccctgcccatcctccctcttcagcgtcttctctgatggccacatggcctgtgccctcacgtccctcagatgccagggttccctcaccctccaggcctggcagcccttccctccctttgctcaacaaggcgcccaagagctgtctgttgatgactggtctccccagggcagctgtgatgtggttttggtttgcgccgtatccccagctgctaaagcaatgcctggcgggtagagggtttcgtgcgcgtccgtgtgaagagaccaccaaacgggctttgtgtgagcaacatggctgtttttttcacctgggtgcaggcgggctgagtcccaaaagagagtcagcaaagggtggtggattatcattagttcttatgggttttgggataggcggtgaagttaagagcaatgttttgcgggcaggagtggatctcacaaagtacatcctcaagagtggggagaatttcaaagaaccttcttaagggtgggggagattacaaagtacattgatcagtttgggtggggcagaagcaaatcacaatggtgggatgtcatcagttaaggccatttttacttttgcggatcttcagttacttcaggccatctggatgtatacgtgcaagtcacaggggatgcgatggcttggcttgggctcagaggcctgacattcctgccttcttatattaataagaaaaataaaatagtgttgaagtgttggggcggtgaaaatttttagggggtggtatggagagagaatggacgatgtttctcagggctgcttcaagcgggattaggggcggcgtgggaacctagagtgggagagattaagctgaagggaggtcttgtggtaaggggtgatattgtggggatgttagaagaaacatctgtcgtatagaatgattggtgatggcctggatacggttttggatgaattcagaaactaaatggaataagagaaggagaaaaacaggtataaaaggtctaagaattgggaggacctatgacatctgattagagagtgcctaaggagattcagcatagtcctgccagcaaagattatttatttacctcaagagtttagagtggcagtttggggatagcaccaggagatatcagctgtgatggcttggagaaacagtgtaaaccggcagtgtaaacaagagcagggcatgtatgagtagttgagaatggcgaataggaatatgactagacaggagatagtagggatgacaagttttggggggcacagtctaagttggtctggtgtctggaatgagactggggcctaataaaaaggagcgtctatacaggagcttacatgggctgtaccttgtagcattctgaggacaggcctgaattctgagaagggaaagtggtaaaagtattgtccagtcctttttaagttggaggctgagcttggtgaggtgtgtttttaaaagacctttagtccattctacctttcctgaagattgaggatggtaagggatatgaaggttccactgaatactaagagcctgagaaactgcttgggtgatttgactagtaaaggctggtccgttatcagactgtatagaggtgggaaggctaaactgaggaattatgtctgacagaagggaagaaatgactgcggtggccttctcagaccctgtaggaaaggcctctacttatctagtgaaagtgtctacttagactaagaggtattttagttacctgactcggggcatgttgagtgaagctaatttgccagtcctgggtgggggcaaatcctcaagcttgatgtgtagggaagggagggggcctgaataatccctgaggagtagtagaatagcagatggaacactgagaagttatttccttgaggatagatttccacgatggaaaggaaatgagaggttctaagaggcgggctagtggcttgtactatagcatagcctgcctttgctgctatgtggcgattaggcctggtggaaccgccatcaataaatcaagcgtgatcagggtgaggaacaggaaagaaggaaatatggggaaatggggtgaatatcaggtggatcagagagatacagtcatgggggtcaggtgtggtatcaggaataatgtgggaggccagattgaggtccaggccaggaacaatggtaattgtgggacttaacaaagagtgagtacagctgaaggagccggggagcagaaagtatatgcatcaggtatgaggaagaaagtagattttggaagttacgagaaatgtagagagtgagttgagcatagtttgtgatttttagggcctctaaaagtattaaagcagcggcagccgctgcacgcagacatgagggctaggctaaaacagtaaggtcaagttgtttggacagaaaggctacagggtgcggtcctggctgttgtgtaagaattctgaccgcactaaccatgcctaggaaggaaaggagttgttgttttgtaagtgattgaggtttgggagattaatcagacacgatcagcagggagagcacgtgtgtttttatgagaattatgccgagataggtaacagatggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagtcactgaggcggggagggtgtttggctcttttgaggcatgtgagagttggttgtgccttagggtttttgtttgaaaatttttctttagagtctcgctctgttgcccaggctgaagtacagtggtctgttcttggctcactgcaatctccgcctcccaggttcaagtgattctcctgccaagcagctgggattacaggtgcgcaccaccacacccagctaggttgtgcctttgttaggttctctgtgacttttacccactgtgccattcctgaaagaaatcttttttttttttttttaattagaagaattactggaactagcttggcactgttggacacagtctttgtctcagctactcgagaggctgaggcaggaggttcgctcgagcccagcctgggcaacatagcaagaccctatgtccgaaggaaaaaaaaggcaaaatcagaattaccagaactgatttcacatgtgtaggtagcagatggtggccatgcaattcaggtctgtctgaaggcccccaggcctggtacaaaactgtgtaaggccagtacaaggccctgacaggttcccaagtggctggactggaagagatgccaagttcatggcctcctaacctgactccacccagcactccctgggcccagcgacgttccctcctgaagcctgaaattcacctccacctgaggaggccatctgcctggggataggttcttgcaaaaatgaaaacactcatttccagaggcaattaattcttttaaaggatgtcagatttttggtacaaaatcatggtttccacgttggcttcatgctcggtgctttatgagaaaaatcccttttttctacggttgtgttcattgtattgtaaagcaatcgtagattattttaaggttttgagttagagtgattatccaattttatgagggaaataaaggaattccatgagaaaaacgggggctttcctgcagggctcggggttgcgggagcggcagataacctgattcattaacatgagcccagtgggattggtgggggtgatggggacacagattggagcactcaactcaggcacaggaccccagcagaacatgcccaggtcctcctagacatgggcccttgcagactttctgaggcctcggtttcgtcatcttaccaaggtgtgaccccaaccatcatctcctgaacttctggccacagagctctgagcaagcttccatcatgaccccattttggagatggggagttggcgcagccacactgctgctcagtggtagaaccagcatctgacccaggccacctgttccagagaccctgcttttagccagcagctcagtccccagtcatgtggggccatttatttatttatttaagatagagtctccctttgtcgcccaggctggagtgcagtggtgcgatctcggcttactgcaacttccacctcccgagttcaagcaattctcctgcctcagcctcccgagcagctgggatttcagacgtgcgccaccatgcccagctaatttttgtattttaagtagaaatggagttttgctgtgttagccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaaaaaaaaaaaaaactgatggctgtgagaatactgtcactcgctgatgccttctgtgtagaaaaataagccttagacagatcttcgcaagaacatcgtgatggctctcataggcataattacgtgttccaagccaaattgcagttcaagagaaggttataaatctcttcttaataacaattgtactcacgttcctctcctggaaactaagaggaaggtagctgaagaaactctccctgcccagttaaatcttgttttttgggtacttttggactccagggtcacatcagcaatggcccgggacagacgagggggagccttcatctgtacttcgtgtctttccagggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttcctgtttctcattccgatttctttttcctcctatgttcccagattctggaatggaaccccagcccttccaggtctgagagccactctttctttgctctggatttctgtcacatcgggggcccctccctctgcggagttgcatgttgctgttcctgatgcacagactcctcccccgctgcttttctgcccactgggtcaggatnnnnnnnnnnnnnnnnnnnntctttacaagtttccttaacgtattgcgtcaaagcgagacaaccgagtcttactcaaacttgttttaaccggagatggagggttgctgctgtgtcaccgcctgcacagggctgccctcaggtgagtaccccgagtctgccaggctgggtgctgatgcgtggaggtttgggccgtccctgccccagttcccacagtggctgcttgagaccctccccaggcccctcgagcccctcctgcactgtctgctgcctcccttctgcagtcagaattgacactccccttccaccttctttgtcatcacattgcatcccaggccagcttcctggggcttactccaagggcatcggcttgccccgcactgtggtgggatgtaaagtgataacagctaaacgacgcatgcacaacatgtcctggtgccttctgcgtgaccccagagcagcaggttctgcacgtggcaggtaagagcacagctgccaagaccccaagcctagttctgctgctacaagctgctgcgtgacttaaggtgagttcatcttcgcctcagtttcctcctctgtcaaatgggatagtccttaccgtgtatggaatttaaagcactttgaacagtgagtgtgagccattactaactcaagtaataccccttcccaacccagaaccctataaggcagggacagtcagtccctctctctgctttagggggttgcaggataaagacaccgtcacaagaaatttaaacacagtaggtaaattttgagccacagcaaagcacagaggttgcatccaggccagcttagcactgttgaaagtcaccatccccagcactgcagaagctgaccctgaactcaaggtcacccagggcttaagcctcagagaaaaggcctgggttgaacctgagcagtgggtgagtgcagggcaggcctctggctccctggagggagaggctagccaggaagttgagcttgaacctgatcccgagggagaggtgtggggcatgctcatgatctgtccgggaaggtctctccagctactggaaggggagtgcccacaggggccaggagaaggcagttgggcagatgttgccgtagtccggacacatccaggcatacgtggttttgaatcacttcctctccaagggctgctgcttcctctccacccctcccaagtgttctggctctgggccccagctggccacctcagcccgggcaggctcctccaacctgaacgacaggcaacctccacgctgcctgccacggcaccccaaagtcaagacgtagaactcattccacctccttcacccgaggctgctttcccaaacgtcttcccagtcccaccttcagttttgttttttgttgttgttgttgctattgtttttgagacaagtcactgttgttgcccagcctggagtgcaatggcacgatctcagctcgctgcaacctccgcctccccggttcaagcaattctactgcctcagcctcccgagtagctgagattacaggcccccgccaccatgcccaggtaatttttgtctttttagtagagacggggtttcaccatgttggccaggctggccttgaactcctgacctcaggtgatccacctgccttggcctctcaaagtactgggattacaggcatgggcatgagtcaccatgcccggcctttttttttgtttttgagacagagtctcactctgttatccaggctggggtgcagtggcacaatcttggctcgctgcaacctctgcctccaggttcaagcgattttcctgcctcagcctcc

SEQ ID NO: 11790 - DNA, 39528 bp, Human
ctctgggaagggaagagagtctggcccagatgggtaaagacaagtgtgttggcatctggtagacagggccagtggcacacaacagtgaacagctctactgctgacagccaacagggacttcggggtttggctgctggagatggaggacctgggcaaaagagacgtgaggccaagagagcaggtctcagaatgtggagctcatggaaggagagagggagggctaatcagactgctcctatctggccagaagccatgccccacactcaccaggccctaccccttttcctctgaatctttagctcttagatcagaaataatcttacgtgtcttcaggcttgatcctggcctgacggacagcagcctctgtcgtgtagcctttggagctgatcatggcagtacccaggaaaagactgtctggagaggctgcaaaaaccatgctcactgttcccagtccccgtacagaccatgtcagaggaggactgagggaggctcctctctctctctctctgtcacacacacgcacacgcgcacacacacacacacagatacacgcgcacacacacacaccgttttgcctggcagaacagacttataacttgcataatactgcagcagcccacactgtacctcatctccatttgggttccacaacagaagggagctggaaggaaatcagcgacaatctaactccacatgacaacctggctggacaacgaaacatccagcggggagaaagacactggaaattacccatacctgagccccatcccaaaacacctgagtcagcttctctgaccatggcccaggctaggtcatttgcaaagctcttgagtgattctaaagaaccactgctgtgaaaaataaaaatgatttcagcaaagagagaaaggtgaaactattttattggcactggctgtgatgctggctgtgagcagatgctggctgtgggcagaacaggggagagggccattgagaggcccttgtgactggagagtccaatcaaacgtaaagtgtgtgacagggagggactcctccaaattctgcaggtctctccagactggggatccctaacacaagaggaagtcttatgccccaagtgccagaattccaggaaactcatgcaatgaaaccagtcctcttgtgtcagagtttgcagctagaagcggttcaagggatggaggactctctgggagctggagtggtacgctgcaaagaacctaaatatgccataacttcctttacttccctctccaagaatttccaattgctcttccagcctattctgcctgacaggttagaaagttttcaatagttttcaatagaggttcgtttacttgcattgaattatctcatgaaggtcagcttgatttgggcacattaaagacagagtcggaagaacacatttccctaagttttattctaatgtacaacacatgtgatcatttgcgatggggtctaggcagacaaggcaggtaacagggagtccttccaaccaggggttggaacaaaggaggcttgatttggtgactcttgagacatttggctcactgctgtgatgctgtgagagattagctgtgcaatgtttgggctccttaaaaggaagtttatttaaaataaaacttacctgcacgtatgtaacactgtagacacagatccttcccacagtatatttaatctctgcagaattcactgggaggggaggggagccagtgggacctcttggctattacacaggttggcacttccagagagaacagtcttggcatcacaggcttcaggcatactcaaagctcttctcccttctgattccagtttctccatgccctgcagggcctcttgggattattgtattctggaaagcaaacaaagttggacactgtctctttaaataatagaggctgagaacctctcaggccaccatgacatatcccagcattggaccagcccctgaataaactggaaagacgcctggtctggcttcagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggtgagttttattggcaaactgtgcctctgggtgatgtgtgcctatgctttacaagaattgcctaatttcccaccccctgcaagccgcaaatgaaaaggattgcaggagagatggtgcatttgtgttggaattgactggagattcagagggctttttatatccttggttaaaaggtggatatatactctggctggggaggtggggggccatctgagagcatctagaaaccctaatgcatccagattgaaaggaagaaaggaatctagatgctttttcccccatggaaaatagctgtgcacacacagctggcaggtggccttggtaagcaggttagggagaagctgccacctgtggcagagccttggccagccgggctctgggtgtggcaagcctggtcagcaggcactgagtagcacttcctctgccaccattgagaaccaggcaggaggccagaggcagtgagggacagatgggttgggtttacctgtctggcagtatatggtgtggctgtgacctgggtggttattgattaaactattgggttcaaaagaaaggaagaagcgagctgtagcacccaatatatgcacttttctgtatgtgtattagactttattaaaaagtttatttgaaaatcacaaaggaagggaaagaaaaccctgagttagatatgctcatatttctaaagtgcttacttagaacagtcctgagtatgttgtgatcacataagtgttggttaaataaataaatgtccaaatggcataaaacaaagtaataatttctagagcaaatctaacttataaaatgacctgtggaggaaagaaaacactgccatgtctttagacttttttttctacttgcatatgcactttcatttataaatctttatctatctatctatctatctatctatctatctatctatctatctacctacctacctacctacctacctatcagagttacaagctactttagtgcagaggtggtcaggtcttccctgaaaggttgatgtgagagttaaatgtgatataataatagtggtggcaatttgggcactgggcccttattatgttgcagacacgatgttaactgctttgtacatattgtctccttcaatcaccaccataaacctttaaagcaggcattactatttccttttgcacctgagaaaactgaagctcagtgaacttgagaaattgcccaaattcacaacaaaagtaagcagggtgattaggtttgttggagcccagagccagagtgcctaaccactgcaccatactgcctctcacagaccatgcatataaagtccaggcaaagtgcttggcatataacgggcactgtaaatgcagtgtttacaagtacacttcattttaatctgataacacgatagttttaaaaagatcattgtttgaagatctttttcaaatttatttttacttaccgtaagaatatacaattagctaaaatagcagctcctttcaaatcgtaaaataatatagaattatttgaatcattgagagtgatgagcttctatgacacagtacactagaggtagggaagtgtgtgtgtgtgtgtgtgtgtgtgcgcgcgcgtgcgtgaactgctgcattttcaggcagaaacctttaacatccacattcctgctccctgtcccgtgcctcaaggctggcctgcgcacgggagtctcagttgggcgcgcctctgccaagccgagactgaagggggctagcctctctccctgtaacgctgggcgggccacgttaggaggctatgaatcagctgatttccttggctgctccaaccccacctcaaatggccacctcgcacccgcccgccaaaccccatggccaggactccagccaaggctgacagccaagcccgactgctgcaggaacactttgcctagagcttattcggtggtagtctggttttgcctaggctaggaggagcccaatcccagaccatgctatccagtagtcggccggacttttcttcccctaattcgcacccaagaggagcccgctagatcaatccccgccaatcctaggaagctggcatgcttcgtaggtgcagacagtaatagcggggaccggcgcggggcaggtgtgtccggctaagacgccaggacagggcaggggctccaggacccgagaggagagggacttcttccagcgctcaagcgcccgctgccctctattagtgggaaaggaatccagcctcagccccgcgcgggcgcggtcggcgtcggcgggcccagaagcccagccctgggcatccgctgagctacatttggctgggtcttcccagagtgggctgaggagccagtttctcggtcaacactaggtctccacggggccaggggagaagggaggtgggaggtgagaaagctcagccgcctctggtttcgagtaaaagtcgccgcggttttgcagggaccgactttttcttgaggcgcatttaaggccaagtgactgtctcctgccctccctctctcctgccccctctcctccctgagtcccgccctcccgcacacgctgacccagggacacaccctactgcagcgacgcaaacagggcgttgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgtaagtgatttggtggggagagtgaaggagatggaggagaaatgtgggcatcttccagtgagggtgccagaaagcgcagcgcaggcgcggggctttggccagctccctggggcttctgtttaggggcacagggtcccctgtgtgtcctgtttccctccaatgggtcttggagtaatacaacgaggagagcctttatggtctataagaccttacagggcaagggtgatggtgctggtgtctggatagcggataagggcggcccagttctcgccttgctgaagaggcgttgactctgggacacactggcaaaacagtccctgtggcggacatcccgagagtgttggactcctgtggttccccagttcccagcctcctgccatcggcttaattcaaaccctctgggagtcatcagaaatccttgtttatttcttccagtgcattccagagtttctttgaatgtgatgcttgtggagaggaacagaggggcctgggattgggtactttccaaactgggttattgaaacgttgtctccctggcccaagactctgcctaaaatggtccccagagtctcagccagatctttcacagccatgcatgtcctctaacaggtcatcccagccttcagttcccccaaagtttaaaatgaggggcgaggaccgcattacttgggataaatgtcctgccggctctgaccggctgaaattctcggactcagccttttaccctctgtctctctctcccgtccgctggacatctactcccttcggtccaggctcctgggctcctgtcccaccgcacccagaccggagctcaggcttgttggggttcgtgtcctggctttgagtgcctggggtgcagactggacccctaggcgagcacgtgggtctagcgcaagagcagaatgccccctgaccccaggggctgcctggggaagctcgcggtggacgggaagcgcagggtccgggcaaccctctcgagccattcttttctttccacactactctggctctgcaccacctctccggagccgccagagtctgcgcgaggctgagctggggccaggaccgttcctctacgctggcagagttgggtggaaacttggagacaaacggaatgcggagagcactggggtctgggaaaccagcctcctcgccgctgtctcccccaccgcatgccacggctgtctccaggtctcagacggaaatctgggcacctactcccctcacccctacctccaccccataggggaattcaccatctgaaccggggtctcggagaacgtgacctctcaccttccagggaggtcgccgggaggtgcttggggtgggtggaagcgtgcagtggcctctgctcatattttctggaaacccctccgttccctgggtggttttagacgtgcgaaccgcttgttttgtttccaaaagcaaaagatgttccgttgcaggcgggcccggctgggcgctgggcactgggcgctggtcctgcaggcggctgctgccccctctcggcggcaggcggcgcgaaggctcctgacccgcgcgggcggtcgggctgcgggcgctgggccaggccgggccttccgctagtgcgcgggaccctccctctgcgcgcgcctccgtcgctcggcccagtgcgttcggcctcacgcccagcgctctcctcgcaggcagaaactccgctgagcagaacttgccgccagaatgctcctcctgttgctgagtatcatcgtcctccacgtcgcggtgctggtgctgctgttcgtctccacgatcgtcagcgtgagtgcctggcggggaggctccctgcgcggcccgcccttccccatctgggttcccagcccgtgctcctgctggttcaggactgtgttatttgcagacagttggaagtctcagacgtcccagggaagtttctggcaatctgcccccttccagttgctttgagaaaacgagagcagattcagtgataggaaccaagcgagcgctgggctgggttagctgcgcaggtctctatttaagccaagtaacttcagagccgatctagggtccccgaccttcatttgacaagattgtttaacttttttttttcttgatgcagcctcgttgaagaagaggagtatttatgatttttttttctccaaaccatagtcagatgggtgaattaatttataaaacacccttttaggacttgaaattggaaagttaaaatgggcttttctggaaaagagttcacaggtcccatgtcggctttatggcatgaacacaacacattgttagtaaagcttccactggtaggaacaggccatcagagtaacttctgttacaaaactgtccagcccattagatcttaaagttattttcttggcgatgaagatgagcagacattcaggcagttttccagtggtggctttcacttcttaatttaaggcacattgtaagcatgattttctttttcgttttcttttcttttcttttcttttttttttttttttgagatggagtctccagcctgtcacccgggctggagtgcagtgccatgatcttggcttactgcaacctctgccttccgggttcaagccattctcctgcctcagcctgggattacaggtgcccgccaccacgcctggctaattttttttttttttgtatttttagtagagacggggtttcactatgttggccaggcttgtctcaaactcctgacctcatgatccgcccacctctgcctcccaaagtgctgggattacaggtgtgagccaccgtgcccggcctgtaagcatgattttctagtctctgtgagaaataattatgttggggatttgtgacttagtttaacatttacaagcatcttcacagtatctccattgtgcctggtgatgatgatatcagactgataggagctataaacaaggaaatagactgagagaggcgggcttggggaatgatcccgagatgctgggaggagagaaggcttgaatgcaggtgtctaaggttgagttcatggctccttctactatagtaaacatctctgcacataatcgtttctgtgtgcatgtggaacttctccatttacaaggtgcttttaagtcataaaacgttggctcttaccatgcaggggtgggcggtgtggctaggtggatgcgggtgcttttcgccatccctgggcctttctccttccccttttccttcactcctccctccctccctgactcaggatatctatctgattctctctagcaatggatcgtgggcaatggacacgcaactgatctctggcagaactgtagcacctcttcctcaggaaatgtccaccactgtttctcatcatcaccaaacggtgaggctggttttgtgctccatgagcttgtcctcagacgcctgtaacacgtttctcagcccagagctggaaacgcttattggaagacacaagccagaatgtcgttgctggggtggggtgggatgtgacagggagccatgagtccagggaaaatgggaggggtggtgatctcgctggggaagctgagatcctgggcatcattgtgattcactctacctagagacatgcccttagtgccctcctgatcacttaggataatgctttttgtgattgaaaaaaatatcgacctgggagctgtgaaggtggtatgatagctaagcctttggcagacccccttgggacattggatcaaacgtgtatctttggtttggtggctgtctctattcagaaatgtcctgcccctttctgctgcagtgacagtggggctagctcactgcaccgtcagttacatggacacaagactggctgcctttccaggtcttgggcctcagtgatgccacctagcatcaaaacctttgaatgtttccttgttgcaagatggggacttgaagctatttgcaaaaccctaagctaagccttggggtccttaatccagaagatcgtatttctcctctgtcctcagcatctttgcttgtgagatatggaagccaggcttcatgagggtcaaattaagggataattggcagcagaagcaccaactaggtacccaaggcacccagagggaaaggaacacccagccaggagccctgtgtgtttggatgcagacaggtggaggtaaacaggatgagctgttttggtggctgggtaggccatagcgattgatgttaagagcccgtggacctggatccacatgatcttttgttccagaagatgtgtcctcaggctggaaggacctagagatacagcagagctttcctaacatcctgggtttaaaaggccacggaaatacagctttaaatgttgctggagctactcatagatccagtatatatgttcaagatgctacaccagacgagagaaaccagtttagatccagttcagtaaaacaggcagtgaagtggcctttggtcctggctttgcataatccagttgctttgctggactttccctcttacagctcagtacccagtaatacccaagcatgtccccagctgaagcattataaaccaaattccttgaaccacagtacaaatagaaactgctaaaataataatttggtaatttacatggagaagatacgcaaggagtagaaaaccctgctttatgtttttaccttctgggttggggagggagcagagaaaaggtcccagtcctattggagtgagaacagtgcttaatcttgtctctgagtgtgtgaaaggcattgaattaaagccatcccagaaattacgtggtgggtttgcatggtgagttggcaactgagtaaatgaaatactcatgagtgcctgagaatgtgaccgtagcactgcttgtccccaaagccacagcatccggtttctccccctttagggtctggctgaagttcccggagcactccggatgggagtctccgtactcgctactgacacctggtggttacaagtagtgactcagcccgaaaagggcaggctttggtgctcacaggcgccatccccaagtggcatctggccacgcggcttggcacagaatcctggactcttgggcccggaagggggcagttttggcaggcgtgttaaaacccggcgaagtttcagcagaaacgaggcggcagaggagttgctaagttgtgcttaaaccatctgcaggaaagaaagcaatattgacctgtagcatgttacagattgacatttggtgtcttctgccgttggaaatagctgtcagttggtgctagaagcagatctcaaagaggcactagggttattttaatcaggaaacttcttatctctcaacttgttccttctgtgccaagctcatgttcttgagttcatttacaatgcctccttagtgtgggtttcaaatctgcctcgttgctttccgtgaggaccccagagtgtctgttttccacatctcccttctcagctctcacaatcagggcattttgaaaacatctggacactgcacctgaacatgctgggtttgttttcacgccactcaggcttaatctaaatttgaaatttccatttacacttccccagtagtggttatctctgccgctatcttccccaacgtggcagcacttgctacgacttcagccttaagtggcgaatcctccagggcctctttgattgagtttaacaattgtggctgcagacaataagctgaaaaaaatgtgtactttttaaaacattatactgtctttacaaatgaactatgctcattgcgaaccatttaacttgtctgtatttgctcttagaaagtatatttgaaaaaaaatacttgttaagtaatcaaaagtaatttgttattgacatcgatttgtgaagaatatgttgcaagtgtgaaaaaataaatagtggtgcaatctcggctgactacaacctccacctcctgggttcaagcgattttcctgcctcagcctcccgagtagctgggattataggcgcccaacaccacgcctggctaatttttgtatttttagtagagaggggtttcatcatgttgggcaggctggtctcgaactcctgacctcaggagatccacccacctcacctcccaaagtgctgggattagaggtgtgagccactgcgccatgtgacttggtatttttttctgaaaggactcatttttctggtgcatgaccatgacacttcacctctctctgggggttgccactcatgttgttttctacatgaatggggcctcctggcatcgtgccatgaggcagtctaacatctaggttgtgtagtttgaaagagacacaccagatcttgcccccaggctacatcttaatattagaaatagttttagatttttaactaactgactttgactccgcctgccttctcgtttttctaaatgtgtttgtatactttctggcaccccctccttatctgcctcgtgtgggcagaggtaagagaggcttagtgtggggatattcgttatgatattgtatccagtgcctctccggcccagggaatacaaggatctggaatgcatgggccttgccttgatggtcccgagcctggtcgaagagtcaggagatagatatggaagggtgaatcactcccttggaaggcagagcaggccaggtgcccaaagggaggcaggcagacagcgtctgagttcagggaggaagcggatgggaaatctctggtgggaggtagaatctgatccatcctccaaaggatgggcaggatttaagtcaatacaggcaacggggaggagaatattccctgtgacctaaggtaagggtagaacaaggcaggggatggggtagactggttggctagtgttctggttaggattaggattgattgtgtataagagaacatcttcaaatgataggggcttaagtaagatcatttatttttctctcttttcaaagaagtctggaagtaggtagcctgagagaggtatggaggttccatgaaattgtcagagatgcagacactttctagctcatttctttgccatctcttgggtttggctgtcatctttaggaaacaaaaggctgctagagctccagccatctcatccatgattcaagcagtagggtggagaaaggaggtggggaagaatgaatctccttttcttttaatgaaatgtgacatggtcacacctacacctatttacaagagaggctgagaaatatagtcattcggccttgggggaagcatggcttttcaaatcatagaaacctggcagcaaatacctctctgtaagcctggtgtggaatactttccttgagggtttgaccatcccctcccatacccaatcatactcttttgcaatagctcagttgggccctatgcagttccataagtcccagttatttcagcattcttcaaagagtccatctctgctgcatcctgggctctgtcagccaccccaccattctcacatgggctcttctcagaaactttaggacctgttgaggcttctctctctctatttctaccacctctccaggtataagtaagtcttattattattattgagacagagtttcactcttgttgcccaggctggagttcagtggcgccatcttggctcactgcaacctccgcttcccgggttcaagcaattctcctgcctcagcctcccgggtagctgggattacaggcatgcgccaccacgcttggctaattttttgtatttttagtagagacgggctttctccatgttggtcaggctggtctcgaactcccgacctcaggtgatccacctgcctcagcctcccaaagtgctgagattacaagcgtgagccaccatgcctggccatcttattattatttaatgaatccagacctctcttctgaatcccagacctgtttatccagctgtctcctggccacttcccttgggatatctaagagaggcccccaagtcactaggccagagacagtccttatcttcctccgccaattcaacccctctgtcactttctagtattttagtgaatgctgcttcaccagccagcaagccaaacatctagagtctgccttgacttgacgcgtttccttctttctcttctcagcattgtcacgggtccctcaggccaccccattgttccaatgcctgttgcccacctgtggtcacgctgcttcctcgtttgtcagaggcgccagggcagcctcctaactagtttgcctgaaccctttcttgctcctctgtgactcatttttcatatggaatccaggctgatatttaaaaaagcacaaacctaattatatcactcctcattttgaaacctttcagaggccgttcattggtcttaatcttcagatgaaaatctttaacaaggcccatcggaatctacctgaatgatccactcctgcttctgttaagtctcacctcccatctctcttcccctcatcttggaatttcagcgttttctcacgtcctgaaatgtgaacttcccacttcgggagtctctccatttctcttctgatctttcatgcaggactatttcttgaacaactctcgtgtaccagagactattgcaggtgctaaggttacaagagtgaacaagagcttatgttttactggacaaaccagtcagtaaacatggagaatttgggggcaatggtaagaactatataagacagggtaatgggataaagagggattgcagtggtgaaggaaggtctccttgaggagtggccaggagccagccatatgaacatctcggggaggttccatacagaaggaccgtcaagtgcaagatcgctggggagggaaggagcttggcgtagttgagggacagagggcagggcagactagtgggaacagagagtgaggggtaagtagaatcacagaccatctcaaaggtaccccccacccccactaggaaggagttgggtgcacatggatgcatttctaatctttgtgatttccttagacctgctgtcttccacgggtttctcagtggtccatttgattccaagttggagtgacagtccagaagcctctataaggcagaatatatcagaaattgtacaaggtagaaatgcatcggtatattttcagtgattattttgggtgacgggattcttatcactttggctgttttctttcttttgctgccttacctgttttcctcattgagatcttttattttcacaatcagaaaataactgtgaacattttatgttagaaaattggttttgagtagtaagtaggttccctctgccttgattaagagagtggagccctggggcatggcacgcagggtccatggcgtcgctttgaatgaggccagttcctggagctttagtttgcaaactcatacaatctggaaggctctggtgagggggaggggtgtgccaagcctcctccccaagaccctatgggtgagtttaaaatctactgacccaaaggattcaggcaaaacatttgccctgctattgaatgaaccagtgctttttgttttgaagtctccaagatccaaatatcaagtccaagttctcacaagcattcccctgctttttgtttaatttgtgtggacctgacgtgtagcagaatgggtcagaatactggaattaagccacaggcggcttgggagcccaagagctagaagggcacagtcctggcttgccctggcccctggctggtcttcatcagcttcagtgatgaggcaggacccaggcagtttgtcttcagtaaaatctgtctctcagggcctgtccctgctcacaaagtcctctcttgtctcagaagaaaaggtagttgataaactttttcatgctgaggtgttaggcacaaaaaatgtgcccctttttgaatcacttttgtttttaaaaaggaggccagtgctcaacaccaaagcatgaagggaattgttgagctttcctgtaatctgtccccaaacgtccttggccacctccattgtctaagggcagtacctgcagcccctcatttcccagtgacaacaggtgggtctgctctgccacagtgtgtgggcgggaccagcaccagacgctgagaagatgaccacttactactcttcttttccatttaaacagcagcagcagcagcagcagcagcaacagcaaactcatgactatcaataggttgtgtgaggaattagatcaatgctttgggttgaaaattagagaaactaaatcttgccagtctcagcagcccccaacctgagcccttggtggtctcctatcatcgctgtcttcaaaacgatcccagacttgtttatcaatttggtgacactgtcattttggcaaggacaccagacaatttccttgtctgtggctcagcttttggccagattttagaaaacacgggagaccttctgcatttatgggttcatgttttacattttaaaatctttgtggctccctcagccaacccataatctctacccaaggaatggctctggattttacaggctcttatgagatgctgagaccctggtggtacaagggaggtacagaggacggaatgtgttgtcagcatgccaggatttcaacccttagggtttctctgatgccaatacccaggaattagtatgaaatgtttgtttgaacctgtgtctgaactgtatgacctggaatctatagtctttgctttaaaaaaacttcaattgtatccccaagatttcaccagcaccaagaaaacatcccttgcatttcaggagcagggactggccatggtgcagcctgaggttgtggatgttgatctttggtgcccgagagaaggctgtctgggatgaagccttctgactgtggtcaggtccctgccagtgctgggggccacatgagtgtgcagtcatccacacacaagtggcccccaacactggcagggacccggagtcatctggcccatccctccttcctatcccatcgagccacagacccctctgcaatatgcctaccacatgttcatcctaccactgatggggaacttattaccttcaagagagcctcttttgtttttgaagagctaatagtgagatccattcatgtgttcttcaactctattgagcctgtcctatgtactgggcactgttctagaaatggggtgcacagagatgaacaagaaagagcaggtccctgccattgtgcagctcacaaggagttggaggaaacaggcaatacacaatacatgcatcactatgggtagtggaacatgctctgcaggaaacaaatagggtgatccaatggaaagtcatcactggaggaatgagctgctcagggaaggcctcttccttccatagtgatgtggtctgagatttagaagacagggaaggaccagttataggaagaaccatgggaagaaaattctaggaggtaaagggaagaaccaaggccctgagttagctgaagaaaggagggtggggaatgcgggagagagggatgggagcaggatcgctggtgcctcacaggctgtggtactgagaaggacagttgggacatcattgaagggttttaagcagaagagtgtcatgatttgattcatgttttgtaagctcattctggctgttgagaatgaattctggggagaggcaagagtggaaactggggaccagtgaggagtttgtggtcatagtccagactggacatgatgatgacactgagatgacaatgatgacaatgacaatgatgttaagaatacaaacagctcacgtaagtgccaggcattctttgaaaagcaatgcatttaatcctcacaagaactctaggaggtagctggtggcttagctagggaggggaagtagagaagaaaacaggtctcatgacagggtttgctgatgggttagatgtagggagttagggaagaatgattctagatgactctacgttttgggcttgagcaactggtgtgtaactgaatcttggactgagatggggagactggaggaggaacagaagatttgcgggaaggtgtagaaatcaggatttatattttgaccatcagagaggtcagcaaatcacttcaatttagaagtctttggcttaggggagaggtctgggctggaaattcaaagtcaagagtcattcctctataccgaagggtattcaatgttgtggtgctgaatacagttacttggggaggagttgagagcagaaggcagaaaaggggaacagggttcagagctaagtcttgggcatgccaggggttaacgagggtacaggaaggagaggagactggggatgaacagccagtgatgagggaggaatgccaggagatattgtcacttaagaaattacctcggctgggcgcggtggctcacgcctataatcccagcactttgggaggctgaggcgggcggattacaaggtcaggagattgagaccatcctggctaacacggtgaaaccctgtctctactaaaaatacaaaacaaaattagccgggcgtggtggccggtgcctgtagtcccagctactcgggaggctgaggcaggagaatggcgtgaacccgggaggcggagcttgcagtgagccgagatcgcaccactgcacgccagcctgagcgacagagtgagactccgtctcaaaaaaagaaattaccttgttaaacccaacactgcccctcttttgtccattcacttctagttgccttcattcttgcctgatgtgctggacttgggttttatcaagttgcttggcacgtccttaaagaatttaaatctccacagtgcctcctggacaatgactgcagggtgacccctgtctctcctctacacgatgactcttcaaacagttgacgattgcagtttttctttccttccttctttcagtggcttctctggtgctggtcccagctgcataagcagggcctcttcttgcccttctgaagtttggtcagtggtttggcttggcaggctgatgagcagagaataagggaagccgctctctctttgccacaccattctccttccaccctctctagtttttgtggattctaagtctgaagaatggtggtagaataatttaattcattagattgcaagcatatcattgacttctctgcacccccagtgtgttgtagtggaaaaactagtagtctgggcatcagggaatccttgtttttctgcaccgggtctgcctgtaacaaattaggtaacctggggcaggtaccctggtttcctaaaagcagagcaggcattgaggtaggacctgaagttgaggtaggacctgcacattgcatgggtcccggagcctctgttcatgttcaggatgtaattgtggcatcgagggatcctaaaaggaggtggcctctgagctgggccttggcaatggggtagaattgcagtaggcagagggagcagagatgggttttgtgcttgtaaacgggcattggtttactgtcactggtgggggtagcagctcttttgttctagctcttcatttccataatgcgtgttcttttttcatactttaggggaaagaaggaggagaactctattatttctatggggagaattcctcctaaacctgaagatcttaaaactaagcgaattattccctgttcattctccactgatgcagttcatgactgcaattgcaactgcctttcccgtcattttctatggccaaactcagtgtttttaagtgagctcttcttttaaaaaacaaaaacaaaaacaagtctcctgataaatccgtttgaaagacactaagttttgaaagttaagcaggctttgatcattcatggtacattgtgaattaccaaggagggagattgatatccttcatcgtacaatgcactcccctcctttttcttttgtatctggtggagtaagtcttccaagagcaattcttagagaaacaaagcctactctgtttccctgtttctagagttttccaacaagggtataaaaaagcctcagacagcttactattatccagtaacctcaggtacctcagtggctgcgtgttattccctttagaagtccaaaaactcactagcagagcaagaatatggatgtcaaagtgcagaactagaccctgacaaactagctctgtgcctgccacaaagcctcttaattaggaatgcagttcattgaataactgtatcaaagttagctggaataccttgacatgaagattccttccacttactgagcagtttgtgcccactagtggccagacacaggctttgctctagctaaaatacccccaggattacctgttgagagagccgcccacgtcaccttcatcgcctttgtgagctccatgctggcacatagttgtctccatctgttttgctttccgcatgaatcataggcaaagttagcctgaccagcaagcccatttcaaagccaccagctgggggagaagttgaagcccagggggcaagacccacgctgggctttgggcatgtttgagctggtgggcgaagcatatgggcaaaggccacattgtttaggatggaggcctttcagagactcagctatttctggaatgacattcatactgagaaataaggaaaatggcgatctgtgtgatggttgtgggttgggaggtttgggcgtgggagtcctggtcttggggtcatgtgttttgaaaacagtctagcactatgcaaatgggaggtgttaataactctttgcctctgtgatttaccctctcatggctttttctctcttggcctctccaaggtctcttctgactcttgcaactgtccttcctttcactttcaacaaaacctgttctcttgagtcagaacagttttatgaattgcccagagtgggacttgatatggggcagggttggttccatgctggtaatgaaagatgcacataaactgttacattgaaaagtgcttcatactttctgagcccttaactcactaggttgtaggccctgggctaagaatatagctgagggggctgatgtatttccttcattgctcagctgctcctacagcaggaatctgaccttgaaatgagctttgatctttgtgcaactcgagcttcccactatctgctgggggagctaggtctgggtgctgccacggcccatgtcagaaagctgtcagcagctcttataccggacactctcagaacaggaggcctgcaaagagctttagctttagttttgttgttgttgttgtttttgagacagtctcgctctgtcgcccaggctggagtgcagtggcgccatctcggctcactgcaagctccacctcccgggttcacaccattctcctgcctcagcctcccaagtagttgggactacaggtgcccgccaccacgcccagctaattttttgtatttttagtagagacgaggtttcaccgtgttagccaggatggtctcaatctcctgacctcgtgatccacccgccttggcctcccaaagtgctgggattacaggtgtgagccacggcgcccggcctttttttttttttttttttgagacgagtcttgctctgtttccaggctggagtgcagtggtgtgatctcggctcactgcagtctccgccttccgggttcaagtgattctcctgctccagcctcccaaatagctgggattacaggcacatgccaccacacccagctaatttttgtatttttagtagagacggggtttcaccatgttggccagtatgatctcgatctcctgaccttgtgatccacccgctttggcctcccaaagtgctgggattacaggcatgagccaccacgcccggccagagctttagtttttaattccagtgctcagcaccaaggttggatattggcttaaaacttccactggaaactccacaaatgtttagcaggcctccactttgcaccaggaactgagtgtggcctggaggacagcaggtactcaacataagttctactatttattgcatacttgcaaattgggtggggcgtggggaagagtatcgccacactggggcttgtgttaatctatagtttagccacttgggatgttggtgtcacactaggtttgatctaaatagaacaggtttgtaattgacagcattttcacttgcattatatttctctgaactcgaatcattattttctgtacagctgacttgttttgctgtagcagagtttggcagataatagcttgcatgtcgaatccaacctgcttttgtaaataagattttattggataaatggctattgaaggaatgggtcacacccactcatttacatcttgtccatggctatggctgattttgtgatacaaaggcagaattgagtagttgttaagaagaccgtatgacctgcaaagcctaaagtatttgctctctgattctttatagatagtttgctatctgtgcagatatttgcactctgactctgtagcacccttatgctggagaggagatatgaattgataccaaagttgtatcaaaacacttttggagttctggccaatgtgctaataacctggcttgtgtgaacattgtggctctcattttcttttttcttttttttttttttgagacgagtcttgctctgtcgcccaggctggagtgcagtggcgcagtggcgcgatctcggctcactgcaagctccgcctccagggttcacgccattctcctgcctcagcctccagagtagctgggactacaggcgcccgccaccacgcccggctaatttttttttttttgtatttttagtagagacgggttttcactgtgttagccagcatggtctcgatctcctgacctcgtgatctgccctcctgggcctcccaagtgctgggattacaggcgtgacccactgcgcccggcctgtggctcccattttcatactgcttggtgtgacccagatggaaatgctccagaacctggcccctcaataacagcctgtaaatgcttgtttaccctgttttctcacatcagccttttaggtggggttatttgcactatcctttaacagcgcttcaataacaactcttttgtttgatcattatgacaacccaataaaatatattagtgcctcaagtacgtaaagcagaattcaaggccaaaaaaatgtatgtggcaagttaggtgggcggtcagaagaacttggcaacagagcccagccctgcctgggctgtcctaaccagagcacataaatgctggagagagtcaggctttgcacgtgctcacacgggacccttaccttggacaggatcaaagccctgtcatttctggagtgtgtgatatctgctgtctcttactgcgctggttgttacctgtctattccagttctgatgaatggctctgattggggagcagcatcatctgagcttagaaatgtcctcagggccctgtggggttccctttgagcaacaacgagagctcttgaatcttgcaccagccttttggagctggaatggagtttgctttctcctgggctgggctctgttttttttcctctcgctgtccttgtgtagcttttgatcaatggcactggaggaaaggaaaatcccttgttgttttcctgggcatgtggaagcccagtcctgcccagaattccactagccctttgagttttggaatcctgactcttagtaagtcaatagagtgctgcatctgtttttacctttgtaatcttttaaattggttttaattatttaagtaatacaagtattataatacatgaaaatatcctcaactgaaaggcttcttgaccaaactcttcttcgttgcaacagtagttcctgggggaacccactgacatcaatttgacacaactttggctctttctctacgaatatttgcatgcctgtggatgtctatacgcaattacatagttttttggtgtttgttttcataatgatgacatgttgtgtgtgcaccttactcttttcattgtcttggagacctttcaaagactcttcattttctaactcatgatttttttaactgctgcaaaatatttcattgtgaggatataccataatttattttccctcatagaaatgctacaatcaatgtccttatttattttcctctgagtatatgttcactgtttttccaggatatagtagataagcacttgaacacatatagtgtcattacgctagaggtgttacaatttttaaactacttttaatggcaaaaattacaattacttttgtatcaacctaatatattctgccacaaaatggctggtcacaaaaggattataataataatattattattattcctgtgaatggtgtctgcaggtagctatcacttatttgttctgctgatattatccattttttttgaattttgcctattggctggatgaaaattggtgtcaccctcctcatgggtttctcttgcatttccttggttgctagtgaggttgggcaccttttacgatgtttattggctgttcatatttctcctttgctaatcacatggcttttcaattttatacttagctgttttctctttgttctgtctgtaatttaattttgttaatgatgcgaactagagatttaattttatgttttaccaaatgaatagccaacactatgtattgtctgttgtatttttccccactggtttatatgatgttgtgtattatctaccaaatttacatgtatgcttccaaagtcttattccatcccattcttttatttttctttcatgattaacaccatatttttgaattgctaaaactttataatataaatataagctttgtatgtctataaataaaatacattttattaattataattatatgttatataattataatataagcacttgaacatatatacttctataattatatattatataattatatatcatacttctatgatatgttctataattatatattgtatatatcatagttctatgatatgttctataattatatattataaagttacaattaattgtatatttaatttataccatatactgtaataagcaaaatatagaaatatgttttaaatctggtaggtggtatcttgactcattggttttatatgtttttctgattttctttttgttcatttgttcgttttggtttttagttgctgttgtgtttacttcaaattttttcttatctgtcattgctcattgttttttagatgaatttttaattgatttttttccagttccagttgcaatatggattaggacagcattgaatttgtagattattttggatgaaattggcatctttataactttgagtgtttctatccaggaacttagtatgtttctttagtacttcttttatgtacttgaataaaatttgtctaacttgttgatgtatccccaaagaaccagacatttttattaaatgtattttaatatttttttctgtctcattagtctgtgcttttatccatattaagtcaattaatttttggacttatttcattgttttttttctggcttcttgagttgaaagtgtagttcactctttttaaggatttttctagcaaatgcttagaagtgtatacattgtcctctgagaactgctttggttacaacccacaggtgtgccatgtggctctctatataattccttgctgaagaagtttttacttttcatcttgttttttttaatccgaggaattatctggaacactgtttttaaatttccaaatttattttggctagtttgtttttaatgtctaatttctgtttgcctttaggtatatgttgagcctacatcatttctgcttctatatttattgagatattctttgttgcccttatagtcagtttgaaaagctgtcccatgtgtgtttgaaaataactttgctatatagacacaagttttctatacatctattaggacagatttgttaatcctcttatgtaatctatattctttcttctttttggtctacctgacatctattttgaggaaggaagctaaagtcttctactgttattgtgattttaacaatttcttctcatattttgattactttttgattttaactttttcaggccatgttattatatgcataatgatttattttcttcagtcatagatcatgtaaaccagaagtaaagatcaaataaaccaaatctttcctctatgaaacaaccaaacaactctctggccacttttatcctttcaacataagttctattttttattattaatttatcttctttcttttttgttaacatttgcctgaagcttcttttcagaatcttttttgtttttgactgttgcttgttttaggtgtatctattatattagaatatagctacaatgtctctcttttttttttttttttttttttttgagacagagtctctctctgtgcccaggctggagtgcagtggtgtgatcttggctcactacaacctccacctcctgagttcaagcgattctctgcctcaacctcccaagtagctgggactataggtgtccaccagcacacctggccaatttttttgtatttttcgtagagatggggttttggcatgttggccaggctggtcttgaactcctggcctcaagtgatctacctgcctcagcctcccaaaatgtcttaatcaaagataaaattccatatcttatgagtgccttgaacccattcacatataatgtggttgatgatagacttactatcttaatgcatgtgttttatttattgggcttatggttgaaaaccatcttcttcatctctggatcatcagagtcaaccagagggcttggctcaaagcagtaggtattcaacaaatgctcattgaataaaaatgtccttgatcctctaattctgatttgattcgagaaataacttatggcaaagagctcaattgtaatggggttgggactaaaattcaagttaatgttgaaagatgtttcaagaagtatttaggttatattattaaatattagacactttctgtttatatagatttaacatataaagattttaagttttctgtgtatgtgaggtctcgtagtagtttctgctgaaaatgacaggggcgcggggttaagggtgaagacagtatctcaggattggagaaggaaatctaagatattgtctccaccagccatactcctcatgaacatgcacatggaaggacatttcccagccaaagtgaatccctttatttgttttagtttcagatttgagtctcagatttctttgtaattccagctgcatctaccaaagtgctagataatttttttattttaagcaaacaatattatgagaacattatctttattgcaaagtgctcctccagaagaacctctatgctggataaagacaaacatttgattaaggttatgtaagagtgaaatcaggatggctcacaacccattagccgtcattttcttactttaattgacaaagaaattgaaaaaatgaaagaagcatatgttgtgcttgaatgtgaagagtgctagactagaatcaaaggcctcttagatttggctgtgtcatttgggctcatgaaaacacctctggaaatctctttcagtgcaaaggagctggactagttgatctctcaggtttcttccaactctaaaatatctccagtctgtgccttggaaacatcttaggtgaaaatctaggaacagttaacctaatttgcacccttaaaattctgccatgagctgcttacaactcaaaacaagtttatcttactcagttactaattataaaccatccagatttcagagctgtgagtactgggtgaagcattgaaggtatgcttttgaagccattacatatggcagttactgagctgaaaggattaaatgctgcagcttccccagttgcccttcctccatgagagcagtgcctgcccccagcattctgtggcacttggaagacaagacagaggccaaatgcagatttttaccctgggcttccctctacagtgtggaactcaggttgtttcttctttcctccctgaaatgacatgagtttgcagcggatggtgaactgaagaaaccataggaggctctgtcttcttgcctgaatttcagttggaagcttggagatttggggttcaacagagataaggaagtgtaagccttcatcccgtctggtggttggcgatcacacaccgctctgtgctgaggctaatggccatgatcagagttgaccaaaaaaaaaaaaaaaaaaaaatacgggttgtccaagcaaattgatttccatacctatagagagcatacctttcttcatcagtattttcttccattcttccaaaaaattactttgggctctaacagccattcccgtgatctttacctctccttggggaatgcagataatttgaatagtggttttaagctatttttcttggaatacagaagttctgataagcccttcaaagacccctgagggcaagaagagggaaggtagtaggcagggctcaggccctctttaacacagacacatgtacataagtaacacatttgcaccaacactggaaggaaattcaatatattttaaaatgactttaactcctagtgatggaactatagatatttttttacagcccttccctgaatgttcacatgtgttttttatatatatgtgtgtgtcacgtatttgtatatgtgtatatacacatatatatagaaacacgtacatatttgtatgcatatttgtacatataggtatatatgtatgtaatgtgtacatattggcacatgtgtgtgtttgtatatgtatatatcagtacatatagatgtatgtatatatgtatatattttttcctccaaaataaacaataaagaatgtcttcttagattgcaaaagtgaattgtctgagttctgctaaggaaaaaggacttctgcttctgctgcctgtgaggactgtgctgtcagcagtcatggcccttcaggccctgcacctcgaggcagagccctcccccggccatggccagctctcctaaccaagtgtctctttcccccagaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtaagttgtggatggtaaagtccatgtggaagcggggtgcatccaagtctgcggaatgattagtttagtagaaggatgtggcctcagaatgactgatgttcatgagtctccccactggatgctttccataaagtgagggtgggtgcttgtatgtgtgggtgtgtacctgtatgtgtcttagaacttgggacttagaactctccccttctccctggaatgagatgcatatgaaagagaacttagaggatctggaaggaaggtccccacccaagccaggcgtatcaacaggaatgaaactgcaatctggacacataatcagaggtgaatactgaggctatctgtagagcaaaggtcaggcttgagagctgtttctgtagattacattatgcctccagaaaatggccctgatgtgctaagaactagcaaagtagttatcaggtatgtgtcttccaccaataggtagtgatgaagccacactgacaaattctcaccttccttgcttccagttcctagattctactgggctttgattgactgttgtcatcctctggtgtcttcattttgacactcttgtgtcacatattgtcatttccaaacatggggctatgacaacacatgaaaacacatgagaggtctccttaatctcctgcctaaactgtcttcaagttccctctttaaatacgttattaatatgcatagtgtgcagagtcctagaaacttctgttacacagggtgacatcttccaactttgtctctggattctgcctagcatcttacatgcttacatcttacatcttacatcttacatcttgcattctgcctagcatcttacattagctcttacatgtctgtctgttgacttactgttgactgaaccagcagggcattggagagaagtaagagctagatgtagtggtggattctgtggtccaaattcatagatcacaaacttcatatgtaccagagtatgtctaggtactgggagatgttctcaattctgaccctctgagagggcaaaggatgtagcatctcttctctgagttggttgtcagaatgcccatggtaccatttcaccactctgtccccaggagcagtcattggaaggttgacgtaaatagggttgtatgggaagacacagcccaaggttagatgttggtgaccttgtctagaagacagagagttcccctttcctgaaaaaaggaagtaaatgattaaccacttctcattaaacactcaaatacaacatttcaatactcatggttttgagatttcaaaaccagacagtgctttgctacttacacatgtcttatgacaccaagccaagctcctggatggttgctggctctgttaaatgactaattatgcaaggagatatcatttctaggtacgttaaagtgaagagttacccttactcaattttcagttggaataaaaacaactgtaacatattctggggtttctttttttttttctcactcgttttagtttgatatcaaatcaaataatgatcatatccattgcatcagtggatatgccctcaagataatatggatttagaaccagaactttcataatgtatttctattgaaatgttagtttcataagcgatgattgggttttcatgcccatgtgtgagatgtgcctcgctcaaaccttgttatgatttggcacgttacccatctgatgtgaaaaaaattacattttatttgtacaggctcgttattttactgatgaataatttgagcccaccagaggataaatgaatgaccaaggtcacccagctcatgacagggacggttgagtgttacactgaatatagtgaggtacttcttatattttaaagacagaatgcaccaaaaaatttaaagaacacaaaatccaaggcagaagctctgccttttatattatcttttattggaactgatttacaatggaaggtaaatgcaaatttgcaccatgtattattctgaagttccaaacatctgtgatgaatacaagcctgtactataagacccagtcacattgaaaatatggagctgagaagaggtaagctgctgttgaatgggctccttgggatagccagtaccttcatcttcattcatcctgctgagctgtttcggctttaagttctttaacaatgtctttttagcaacatcattacatcattttaggccaaaactcaaagtccagagataagaacccttaagtcactcatgtaactgcactgtgtgttaaaagtatttcagttcagccaaacactcttctcctaggtattgcgatttaagtatatttactaatccactcttgcttcactattttcattctcctccaaagtcaatacaagatgtttagaactgtgctggaagtgcagaattccgaatgtaaaagcgcatgactttgtcctctttatcccctttacatctagctgcttacgtctcatgaaactgaattttcagttatctgttggtccacatttgaataagaaattatcttgaatttgaaatgctgagctgtaatagcagttgtaatttgtaagtcctgagagtgtcctgtcctccgttgttaatcccagtcaagatcatctgagagttggtctccagggaacctcagatctctaggatgttgcactggaaatggctgcaggatctttccactaattctgagaactgaaagagttaggaactctatttggagagttcctggttcccttatcgtgtgacagttctaagtcaattttgtcatgtggttttctgactcacagactagtaagaagttagtaattagagagctaagtagattagggttgttggagatgagaaacccacgttttgggaaaacctggcaagtgacaacttaacatcaaggaagtagtcagaaaagctaaaactgacaaacagaaggtagaagaaagtagctccacactcatgggatgtgaaatctacaagcgtgcatgcccggcaaatgcctctccaatgcactggagcgttttaagtggaaaccactagaatctctgtgtagtctccggaagtggctgtgagggctgcattatctctgcacagcttcctcttggtgggcccagctgtgatctttatggatggcacacatcagctttcaggaaaagcacatgaaaggtgctagggctcttggagctgactgtaggtttgggagttgtctgtctccttgctctagattacagctctgtgtgttgtgtggggtctccatggtttgccaaattatctcttcctcacttagccacaaggctgacagttaggaactatctcttcttgattgcattaggttggctgcttcctgaatgcatatcaaaaggctccttcctttagttcagtgctttcaacctgagctgtgcatcagaatcacctgaggtcctttaaaaaaaaaaaaaagacagtgggcggggcgcagtggctcacgcctgtaatcccagcactttgggaggctgaggtgggcagatcacttgaggtcaggagttcaagaccagcccggccaacatggtgaaaccctgtctctactaaaaataaaaataaaaaaatagccaggcgtggtggtgcgtgcctgtagtcccagctacttgggaaactgaggcagagaagaatcacttgaacctaggaggtggaggttgcagtgagccaagatcatgccactgcactccagcctgggggtgacagagtaagactgtctcaaaaaaaaagaaaaaagaaaagaaaaaagacagtattcaggtctcatccctggagactctcatttaatagttgtgggatggatccactgcctaggtgactctgatgtgcatttagggttgggaaccactgacatagccattaaactgtccctaatcccactgtaaggttttctaggatattttcccagaaataactaaaccaccttcttagagaaggaacatcctgatcctgcgtctggactttggagtcattcttattttcagaacctatagccatctattccttgacaagatctgttgggttgggttgcactagactggaaaacatcaagaaattaatctagacacagacctaaaaggaagatttgcacgttttgatttattttactgcttacacccagcatcaagctccatgtggggcacatagaggagcctgaataaaactattattggttggatgattagataattgtgtttcctcggcagaatcaaactcaagtcaaatgtgtggttaccgggattaagaacagaaagaatagaggggactcctgagtgagtttcactttctctctctttttgttattgttgttcatttgttttgttaatagaaagatcaatatagctatagagcatttaaaataaaaggatttgggccaggtgtggtggcgaatgcctgtaatcccaacactttgaaagactgaggtgagaggattgcttaaagccaggagttcaagaccagcctgggcaacaaagcgagatgccatctctacaaaaaatgatttaaaaattagtggggtgccttggagcacgcctgtggtcccagctattcaggaggctgaggcaggaggattgcttgaggctgagaggtcaagactacagtgaactatgatcaggcccctgcacttgctccagcctggtgacagagtgagaccctgcctctctaggaaaaaaaaaaaaagaatttggtggggggggattaataaaagttcagtgccatcctgttcagagtgattcaaaggtggcttaagtcaaataccacatttagaaatttttgttagggacggatgattatggatgtctcactggccatgcccaaatcagagtcaatgctatgggtggctttctaggcagcaatggtcatttggatactgaaaatgtaaaaggagtgggcttcaatcacagaaacacagagaagtctcttgctttcagaggaacaggcctcacagccccttcctgccctcccttgttgccctgaggatgaagtgggagggagaaaaaggcacccactcatcaacccaacatcatagctgcaccttccagtgaccaccctggtggtctcactgacatccctttccagccaacttctctctgacttctgccccaggctctcaaatgaaagtgcttttgcgaggttaccaaagtacactttgaagtctttaatttgttggatcactctgctcctttcaatactgttagctacttactctttgaagctctattcccctggcttctgagacatcgctgtgttcccacttgcctgagtgaacacaccaggcggtcatgctggcctctcctctctccctcaccccacagccagccttctactgaatcctgcatttgggtagcatcctccgtaggcattacgcccatttctttgtcttgactcactaaccccagtgcagctatgcaaaggcctcctcatgcaccttccagctacctgccttgtccctgcccctgaatccattttctgcaccatggccagagtgatcattctaaaacgtgcgtctgatcatgtttctcctctgctgaagtttcctcagaggcttctcatcacagcttccttaacatgtcatgtaaggccctctctttcctgacccttagtgagctaatcagcctattatatgagagtccgtgtggcttctccagttctccagtttggactcagcgcccgtctatgctcttggggcatctggtgcatttccttccctctctcgaaattccatcgaactatattgaaattatatgcaaatgtctgtcttctagacacacagtccttaaggtaggagccatgtctcacttatcttggtacatctagagcagcagctagaacagggcccgcatgcaataggcactcattaaatgttcactgaaccaaagggaatggagatgataaggatgtactgggaattccctcagctacttcctttgaccttggccccttgggtgcttccttccagaggctctgggctctaatcactctcatggggttgcagtcactgttaaaggagcttaagactttctcttcaaaagggctttaggcagaacttgcaggaagttgttgcagacctacccatcctgagacagggagaaactcttgtaagttgaatgctcagcacatttgtattgtctggacagggtcagtgtccttctgcttaaagatgacctatgctcccagactcaggcccctaccagggagtcccggtcattgccaaagagcagaacatctgcctgtgcctcagggcctcacttacccttgccacagggacctggtgatacatctccacctactggttgctgagaaagtgagtcacagtccacttactaggggtatttggcttttggagatgactactggatgacattaactgtcttgggttgcagacagagggaacccagccaaagaatcatccttttctctatttcagggtacatctattgctttacatgcagacaatcttgtaataatatattccctaaaacatcagtctcatgacaacaatcatataaagtgtgtatcctctctttggctttgtagatatctaagtttactgcttatcacggttaagcttagagtcattcacttctgagattctactaagatgaaagtcatacacattaagctgtgtagttagtcgctgcacttctctatactgcctctttctatccctcttgttcaaggatggaatctggtatctcctcttagtcagtgaaatcggggagtagctggtccactcagctcctgaggcatttctcatgccagatctggttagacagcccatttgggagccctgcctgcatgatgataagtgttgtcctgccctgctagcactctgttaacacctttctctctgccaaggtcatgtttccttttttatagccctgccttcattagataagtcagacagagcccaagagacaacttcagtatttcttaaagacaagagttagcactttggagatgcaagccgtggaagagtggggcaagataattaaggatcctggacctcaaggcaaataaagtgtgtccccagcagatcaaaactgctgttttctgcaatcaacaattaacccgcaatgatttcgctcctgacatggccatctttgctgtcttctgaacttcctgtaggtggcaggtcctggatgctgtcccattttggttccaagactattgtgtggctctcttgacaggggccagtcaagtggcagttttctcctctgagttgcaggaggacaggcttaacagggtggttcatgtggcgtattcccacttctgcactgtcttcaaacaaagttgcagtgtccagtaaaacagcagcccaaatagcagtgaggttagatgtaggtggccgggcggtgggggggcgcgggtgcattgggaactctggaactgcatgaatcccacacggcatactggatttataatagagtcactcagagcttctcaaagaccctgttttcagggaggaaacagaccaggctttgtgcagctccaggctggggtgctgacatcactggacccctccttgtggggggacgctgtctgtcacgtgagctggggccatcagtttgagcgtggctgctccacagggcccaagatggaggcttttcttctctttccaacaccgaagggctgcattggtgggccagggagggtggcctgacccacctgcatatccagtgccctttagccttctttgggcttcaaatgcaaccttggggcacccagggaaatggagcttgcctttgatcatcttccccctctgcagcgtggcttcccagtcatactgtcggctgcatccttattcctcactttctttttccctctccacacatttctttgtctgtttggcagtgcccataggcattgcttgcttcacctggtatgtggcaactctgttagggggaccataggcccctgtggtctgcatggagcttaatccttttaccatggcgtgactccaataatggtaaaatgtcacttcacttccattggctttaggtaatgccaccactcacttgtagagtggcatatagatttccaggggtttccatacccaaccacccttggaaagagacaggtaggtttttcttgcagcctgaatgcctgctggccatgtagtgtggcctgggaattggtgacagtgaaagaaagagaaatagggcagaaaatgtaaagaaaaccctcaggtattaaggcctaggtggccaagattggaaatagagagcaagttgttttccttgttcccatatttttgtgctacctcctttcaattctggacctggaagcagatttccttccagaggtagaaatgttcttcctacccagcaattgtcagcatccggggtggcggagagggggccgctctgccatggactctccgtcacccagcttgtccctctccttccccaggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcactggtctctcttgagtttttgtgggaacttgggtgtgggtacaaggtgcctgttggagcaggatgaagagcttcagtggaaagcaaagttgagctggagatttgggttacaagatggtgctaaggcaccaaaatcatagctgttttacaagctacagggagcacatgatgccttcatgatgtctgtgcaaaggtttgctaattggagacagttgggaattgcagctgaaatggaggctgtaaatggactggaaggcacttgagtattcatttagttcaaccctctctggtgctctgttgtttgatgacccacatggaaaacatggaggcatgtcatgagctgccctgatatactgggaatgttggcagaagcatctcagatccctcaccctgaggtatgatatggtgaaaggtctgaatgatggtgacttgaggccacacttgcagataaaacattggttggcaccaactaagctcctaatgccatcctgaaggagagaaaaggccaccattgtcacccagctcagggtttctgagttgtgtctcatgcgtccatatttttacccgtcgaccttttgttgtgtgtctgcaaaataacaagcaaatgatgtggttgatagtccttaatatttattgtgcaactattttgaattgggtaccaaagataaagaagtaatgacatatatcttaacatcgaaaggtcacattttagtgagaggtacaagtaaacaagtgactatattataataaggttaagagcatagaaatgagagcctgggtttgagcctgtcctttgctgcttaccagccataggggcctgaaaaggttacgtaaacactaagattcagttttctcatctataaaatggggatgccaataacaagggtatagggctgaggggatttcaaggaagttatatggataaagtgttcagcatagtgactagtacctagaaagactctatagattagagtggttatcacatatgttacaacagaggtatatttgaaagagcatgtaggagagacattgactgttatgcaggattctcagtatcagtctgcacactggaatctcccatgcaggaattcccattagagatttggattccctgtttccatgatgggacccacccatcatggtttaaagaacacttctggtgattacagcatgcaactggggatgacacctctgagctagtgcaggaggtctcatacttcaacatgctagtgaatcacctgggaatctgatagcatgcagattctgaaactttaggcccaggtggggattgagattctgcatttccaattagtgcctgggtgaggtggatgctgcttgtccaccgaccacactttgagtagcaagggcctagcataaagccaccttcaggtaccttgtgctcttctgtccttgggtgtctgtgacggaaggacttctcttttctgaggttttcagtagtgactgctactctgcttttgactcagatagttttaaggtggcacaggtggccatgagatgcatgtgagattaagaaaactaggaattttatttcacgagctggtactttgaaaacatacacttttatttcataaacttttctaacatttcattaaaaattaatagggataagaataaagaagaaaagcaaaaacggcccctaaatctccctacccaggtaacactcttggcatttaaaaaaaaaccatatatctaggattataacatcctatcttgtatctagagggaaaaatacaatctgaaagcctctttcccacctacccatagtcttttgccaaaggtaaccgtaagacatagtttcttatgacttcttccaggaaagaaaattgcccacatatgtacatccatctatgtattttttaaacgtacacaaaagtgatcatactactcacttctgcaccttttcatttaatgataaaaatttgagatcattctataccattctataccagcatatacctcatgctttttagtgaacacta

SEQ ID NO: 11791 - DNA, 8801 bp, Human
  misc_feature (1)...(8801): n = A,T,C or G
aagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaatgatgtgcttatttgtatttttgcttagggggtgatagagaactgggccaaattggagtcttcttgggacccaagttccctctctaacaggtgggggcgctctcagagccgagggggaaggtttcggggatggtgctggacccggacctgtgtcccccagcagtgaaggttatgtactgggaggaaaagaggaaaggcatacttgagtgaggctgcgtgcaggctctggggcgactggtttggtcggcgatgggggagtgccactgttgacaaacactgggtacgttgccgggcggccctagctcccgtaggcccggtctgttgctaacatcaaggagctgtttatggagccgcctccccgtggactggccttaagtgtccctatctattctccctacgaccaaagctcctgcggccttccctctagggttgtcaccctagctggacctggtaagcttgtgctggggaacgctaactccagcattaagcgctcgccgcctcggtcctgaggagggcagtgacgggtacggccgctcactcccagctcggcgctaacacggttaacctccagctcttacagctgccgtcgctccgcctctgccagttcaatgttttattggtgaacgtgatccggggccttccaagtcccgccaatccagatgtaggagaggtagggttaggcgcgtgccgcgagaacagagtggacggagagtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcggcggcggctacaggcggtgctgcagtgtctctccctcttgtcgccaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattcagaagtgctgcctgtccggggagaccacccagctgcccagaacaggttcctctacgtgggcggtgccctgcatgccctacccactggcctcaggtaacaccagcacctccgctccttttactgtgccctcatcctcatatgccttccatttctttcttcttttcttttttttttttttttttttttttttgagacggagtatcgctctcgcccaggatggagtgcaatggcgcgatcttggctcactgcaacttccgcctttcgggttcaagcgattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagcgcctggagctggggaggtatgtcaggagcttccccctcactatgcctttctccatgcagggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatcccaccctcattccctaccaaataggggctgtggaaatcagtcagtgtagattattttttcgctccttagtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcaggtgaggggggattgattcagagggtgaaaatattaagtactgccaaagtgagggagtggggacaaggggtgctattcaatgattctttttttcttttttgagacggagtcttgctctgctgcctaggctggagtgcagtggtgcaatctcagatcggctcgctgcaacctccgcctcccagattcaagcaattctcctgcctcagcctcttaagtagctgggattacaaacatgtgccaccactcccagctaatctttgtatttttttgtagagatgcagtttcactatgttggccaggctggtctcaaactcctgacctcaagtgatccacccgcctcggcctcctaaagtgctgggattacaggtgtgagccactgcatccagcctcaatgattcttctttgcttcctctgcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctcgtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctatgaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagggatttggacatttggtgccatcttcagaagatccaggagtcctgggaatcgtgtatgactcagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaaggtaagttgggataaacttccctcagctctccactgaaggccttgaagacagagactggaacatttgtcactgtatgtcagccaaggcctaggacatcaataataaacttttccctgcatcctctcctctcttctcagaactgcattccccagtatacactaggtcactggcaaaaactaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggcttggtctggctgttctatcacctataggcataagaatgcggggcagcaaagaggcaaagtgtgcctgggatgcagaaagcaggagcagatgcgagacaaagtcctttattagaaaatatatcaaaatcccagccccctgagccaggaccagaagagggagctattccagcataggcagaaaatgcccagggaggggcttcnnnnnnnnnnnnnnnnnnnnnnnnnnnnnnnnnnnnnnnnnnnnnnnnnnnnggacccctgaggtctacaggagcccagctccagtccagcagtgagggagaggcccctaccccctagcacggcaccaggagttcagttccctcacatccctctgagaacagtgaggagctgagggtggggagaatacaaccccatgaattcggtttcatgattaaggtagacaggaaggaggagtcagtgtgaacctcggagggctgtgtggttggcagtagatagaggcccaggcctggctgggggccggcgttgcagcatctcttgacggaaggcttgggaggaaccaggtgggtaacgtggcccagaaggagcccgaggaccccgagggtcagtcccaatgtctgctgtgatgttggtataaagaggccccagctctcgagccagcaactggtatgtcagtgagttcatcccatcttgcgtccaggaattctgggtacggaccaggaggtcaaatctgagggttagaggttggagactaagacccagaaaggaacagccagaaatctagggacctttaggattttcctggctaggggtacagaaccctgaggatccagtaacaattcccaggcagtccttccttcttcctacctgtggggattttcctcattgcccttatctcctcggtgcttcaccatcttatagtgtcctacagatgtggggggccgagagatcttcatcccagccaggcgcaccctatgggaaaagtgagggtatcatgggggatccagagtagagaaaagcaaggaagggattaaatgtttctgtacacacaaaaaaacaactattacttagtaggcaaaagaaaaaaaaagcccaggacagaagtcaaacagaaagaaggaaatggctgaagagaatataaaagctggatgtatccaaatcctcagggcccagtgccagtcaccctagggcctttaaacagttggcaacctattcccttggcttcctaaagggctcctaggagctgcccttgcagtctaggaaggacgcagagagaggccattctgtcaaaagaataagagaagactgggagttgctgagaatcttagaatagtgactgagctaccccagcttctctcccacatcccccatgttaagaaaaaggtaggccaggtgcagtggctcacacctgcaatcctagcacttttggatgccaaggcagaaggatcacttgaggccaggagttcaagaccagcctgggaaaataatgggaccttgtctctagagaaaaagaaaaaaaaaaaaaacgaaagaaagaaaagaaaagggtagaaccaggtaatcaggaccttaaaagaaacaaactccacttctgacacacagaagcatggagtgcagatggcctgggaaggaactagaagaatacttatgtatatttacaattcactgggtatttcacacacatacagaggatgagaattcacagagatgtcatcacagaggacacagggggaatggaggcaattggtcctgcataccaagcccaaatattcataccacagacatgaaattgggtcagctgaggctgaaggtcagaatgtttcacatgctaaaaatgagttggccctgtgccaatggcacaggccttttacaaagcgattctgggaacatggagcagagcccctctctcctaaccccataggaagtggcctggctggaaccccagcagaaggcaagactaagctgtctctgggcccctttccagttctggaatccgacgatactatttcctattgat

SEQ ID NO: 11792 - DNA, 12802 bp, Human
acatccatccccatggcctctctgtgcactgacatctgacgtcttcctcagggagaagaaaactgaagctcatgggggtgaagtgacttttgccctaggccagatagcccataggtgcagaaaggataagactcagggtcacatgaccccaaagcactttcccttgctacttctattcttgctcctgttctctactcttaagtgatccggatgggctcctgcatgagtagacgataagaccaccctgaagaatgttcattccttcctcattgcaatagtgccacggccctgcttggccggaggtggggtgtggtctggggcaaacatgttcttcccctcccttcccaaaccagaagctgggactgtactgatctagaacgggaggacaaggacagtgagtcgctggggctctttctcttccctcagccctgtttcccagttcctccaggaaccttactgacggcaagctttgtgctggcttccattctgaagtggaggctcctggctgggtgttgcctggacactttgttcctggtgggcactgtgcactcagaagaaggctgggccaaaatgggtctgtactcgtttccagtggtagttcatcaataaggaagatcactgaggctgtgatcttccagacagggttgtgaaaataactaggaatgaaaaaagtagctggatcaaaggttacaaagggttggatacattggctcacacttgtaatcccagcactttgggaggctgaagtggaggatcacttgaggccaggagtttgagactagcctgagcaacatagtgagattccatttctacaaaaaaaaatctagtaagactatattttaaaaaatgcaatcaaggtattaactggggggaaaaaagaaagaaagaaaaaaaagggttacagagaaccctgcttgactgaagggacttcgcacactgccattttacccacacactgatagaagaaaatgcttcaaggagaactcatttacccagataacttcctttaattaggaaatttcaaaaaattccctgaatggtttagataatatgtttgtccaatcatgacttcacaagggatctgaagcaacgtagttctggtccagaactgtcagtgctgaggagattcccagtgtccacagctgctgctcccaagctcactgctggtctttctctagactctcttcctgggcattaacttgaaagaagctgaagtttgttagctctgtgactctacctggagctccagccttacacatcccaatcaggatggggcatctccctggctcgacaagccacaggggctccaaaactgcctgacttttcatctcccactcccatggaacgttctcatacacagtgttctgttactggcactgttgctccaccactcacccaggcctagcctcctgcctctctaacagccaatggcgaccaagtcctagcagtcctatctctaaaggtcctcgctatctgtcatctccccttcattttcccagttactccagttactgtcctactgaaggacccccatcccatctgggctactataaccacatggaccatcccttgcttcaatcatagaattctttcttcagatcaaagtatattcagacactcgatacagtaacaaaagcaagctatcctggaaggaagaaggaatcaggaggcagaggtatgaaatatctgtggcctgtatctcaccttctgggtgaggtagactcctgcctcatctcttccctggaattcctggggttccctgaatacacaccatgaagtttccatttttgagatggattatttcttctgctcacagtgtctttctttcttgtctgcccagcacatggttaaagcatgagatgtgaaaccaggaagaaccaggtctgaaccttagctccaccagtggtagcttcaaaccttggtcctttctgagcctgcttcttcaaccgtaaggtaaaaataatatcagtacttatgttatacacctgttcacggcgttaaataatgctatatttaagttgcttagcagagagatggtaagcactcaacaaatgttcacacatcataattttcctcacccttcatgagtcaactggacagcaactcctccacgaagctttccccaatctcctccagctgtgtccccagtgaaatctaccacactgcatttatagtcaggaggcaccattctgcctccctcctcacactgtgacctctttaagggcagaggctatcttgttcatctttggttctctgctattcagtagtatccatcacttagtagagctcagtgttcactgaattagttaattaacaaaaaagggaggaagtatgatcattcattaatgaaatgtatcgaacatgtactgtgtgacagacaatgtgctggctgctggggatacatctgtgaataaacagagggagttcttgccctcatggggctcccattctaatgaggaggatacactcaataaacaaccacatgtatagtatactagataatgcaaagtgctttgggaaaaaataaagcagattaggggtaacaaggcaagaagcagttgttgctctttttttattttatttttttcaaaatggagtctgactctgtcacccaggctggagtgctatggcgcgatctcagctcactccaaccttcacctctcaggttcgagtgattctcccgcctcagcctcccaagtagctgggattacaggcgcccgccaccatacccggctaattctttttgtatttttagtagagacggggtttcaccatgttggccaggctggtctcgaactcctgacctcaggtgatctgcctgccttgacctcccaaagtgctggaataacaggcgtgagccactgagactgaccttgttgctgtttatgttaggtcagggaaggcctcacagaaaaggtgacgtctgaacagagagctgaagaaagtgaggaagaaggcacatggacattagagggtgggaagatagggaagagcacaacccagatcaagggagaagccaagtgtaaaggccctgaggggagagcgtgctgcacgggaggccagccagcgggggccggggctggagtgctacaagatgagggcagagaagcagtggggcgggggtcctgtggggtgcagatcgtgggtcatgtggggctctaccattccttcatgaagatgtgcatgattattgcttgattactttcttgggcatcttgaaaatcctgtcctcctacctatgttaaaatgcagcagaaaggaaaagtcctagccttactcagtcttaatgagtacaaatgaagttgttttacattaatatctaaatctcaatggtttgagttctcacctgtgcaaatgtagaatgtcccagctccgggaaaatccttttccccttagtatttctaggaatcctaggggcatgtgcatggttgtatgatcctaaaccagttgccagggctggtcaggtcatgctttggcagcatcaggctccagtggtcctacagacacaccacagtagggtgctccactcacctcaccagcccctaggtcatccagaggatttatcattattctgagactccacagggccttgcctgtggatccagaaagctaccactgtgcctcaatacaagacactactcttggcaggtgagaacattccgtctgggtttggatgagaagggccgttccacagcaacattttttgaactccagtgttacagtgtctatggacacagcttttagttcacacctagagcccttctctccccagggagcaaacttaccttcaagttggctggtttgggacatacctggacagcagcttgcctccaaccttctatcttcttgggaagctgggcttgctatcagactggtccttttcttatggtagattttctcttgaggctcccattagtctctgcaagtgggcctccgcctgggccactccagcacattagacctgtcagtagtcaaagccaagagtgcacaaagttcccaactttttcccaggatccccaggcccaacaaaaatcaatgaatgtgatgcctgaggaggattattgcctaactacgtaccagtactgttgaatcccatctcctactcagctgggacccactgaagttcttcctcaggatattagctttatcaacatcccaaggttttccatttcttattcaaggtgtgactacactgagcagtaacagcaaaacctgaaagagaatggatacaggtgttcatttcagatggtacaagtttaacaaagtacaagagcaacttaaggtttgacacaaaaactctaagcatatatttaaatcctagtatttcatccagaaaacaccacagcataactgagagcactggaggcagaaataattcagtttagatccatggattgcttgctatttactgtgtgactctgggtagccacttactttaaatctatttttcccacttatagaaaggtaatgatgaccacttgttggaaaacttgagggtaatacttgtaaaggtcatagtaagacccaacaacttgggcccaacacctggtaggcacaaagtctgttctgcttcctttccctttctgtagagaaatgcacaggatattccttatatgccacttatgttatgggattgacataggttttgtccctcatgctatgggattgattaggttttgctctaaaaagctttaaaaaagaaaattcattactataagatcaactcgattccaacttaatcttatagtaactctaaggtatgattatgctgcaattctagtgtatttgatttttatttcatattgaatatcattatattctcaataaacccttaacaggctttaactgtctcatagctttctctctgatttcctcgataaaaacaaaatagcaataattaagaaagatcagaaaataaaagccaaggaatgaaaagtctgaataaaagctattgcatactctacatagaaaagatctagctgatatggtgatcaggaaggcacacaggatctggaatcaggagacctgagcttgaattgactcagccactctgtagatgggaggcatcttggtctctatgggacattttcctcatctaagatgcaaatatcatctcacagaattataatcggtgtcaaatgacaagtgctatatgttagttcagttcaacaagccaaatagagacaatcagacagacctggtccctgccccagggagctcacagtctctttgacctgggccctactttttccctgatctggtttttagtagaggccagcttggaattgctgctcatgactacattgattgacttccaggagagccttcgaaacaccagtgctcactgacctaaccttctctgctggtcttacatagaactggtctggggaactcactctatttccatgctatctctagccaaaatacttaacttcttgcacaaaaatcataaaataaagaattacaaataaatcactccccctgcaaactcaaagatcaggctcatcccctctcctgactgtgtggcaatatcatcctttgcccaaaagagatcctctcatactggagaccaaactccaggtcactttattgccagtcctgtgtgtttacatgccatcataataaaatttacaaagtgttttccctaaagcctcgcccactgctacccaggtcaagtagaaccaaaggatatctagctgtctgtccttgggactgacacaccctgaatctctcctctcgcatttttaagcagttatgacacagaaagaacctttgggcccaggaccctgggttttgtaagaaccagtctttgggagaacagacctaaaccctcttcttctaaagtgagtggtgtttttactagttgcttcttcaaactttgtaattcgagtccttctttaaagtaacaaaaatgtttttaaagtcttctgctgaatctcttaccaaacaataaccttcaagttttggtgaaaccattacttttatatgttgagcttgcttaaaacaaggcacgcaagtaatcctgtgacatactccattttcttcaaaaactgatgaacaagctttgcgcagtggcagtatcatagccaatgaggtttactcaaggagtgattattgctaattgaaaaactgatgaacatatgaagtgcatgtctgtagcttaatagtacaaagtcagccaacttgagaccttggctcaggtatttttgcaacatttctagcccatgactacactgggtaatcctacccctttggacttaccaaacatctctgtaatcctttaatgtacaagtaatagacatctacatcactccaaacaacactctacctgctccagggggagtcttacgtcagaggacttctgctgctgcaataggggaagatcacagaaagagacagtatggagtttgattcaataatttctgcctgtctgagaggaacagtacacaggcaggtggggaagacttggtttataaacagtggttaccaatgccttccaaaaaactgtacagtactttactagtagtctctctctacccctgccaggacaatctaagcagaaactctgcagttagaaggcaatagaatgatatatttaaagtgatgaaagaaaaacctgtcaaccaagatttctttcttttttttgagacagggtctcactctgtcacccaggctagagtgcagtggtgtgatttcagcccactgcagtactacactacctcctgtagtcaagggatcctcccacctcagcctcctgagcagctgggactacatgcatgagccatcacattcagctaatttttctattttttgtagagatggagttttgccatgttgccccggctggtctcgaactcctgagctcaagtgatcagcttgtctcaggctcccagagtgctgggattacaggtgtgagccaccacgcccagccaagaattctgtatctggtaaaactatccttcaaaatcaagggagaaactaagatatccctaaataaacaaaagctgaaggaattcattaccactagacctaccctgcaagaaacgttaaaaggagtcccttccttcaggttgtaagtaaacaacactagacagtaactcaaagatgtataaaaatatacatttttcctttcaaggtaaacacatagacaaatataaaaatcagtattattgcaattttggttcgtaactccccttattattttacaggacttaaaatagaaaagcataaaaaactataaatctttgctagtgggtacacaatatataaagatgtaatttgtggcagcaataacataaagaagagacggagctgtaaaggacgtcttttgtatgcaattaaagttatcagtttaaaataggttgttataacattaggatgttttatctaagtctcatggtaacacaaaggaaatatctacagaatatacacaaaaggaagtgagaagggaaccaaacacgccactataaaaaaatcaactgaactcgctgggcgcggtggctcacacctgtaatcccagcactttgggaggctgaggcgggcggatcacaaggtcaggagttcgagaccagcctggccaatatggtgaaaccctgtctctattaaaaatacaaaaattagctgggtgggcgtggtggcacgtgcttgtagtcccagctacttagggggctgaggcagaggaatcgcttgagcctgggaggcagaggttgcagtgagccgagatcatgccactgcactccagcctgggtgacagagcgagactccgtgtcaaaaaaaaaaaaaaaaaaagaaaaagaaaaacaaaatcaactgaactcaaagaaacacagtaagggcgtaaatgagggacaaaaagagcctataagagatacagaaaacaacaaaatggcaacagtaagtccttccccatcagtaattactttaaatgtaaatgaattttaactcccaaatcaagacagattgccagaatgaatttaaaaaaaagagtccatctacatactgtctacaagagactcactttagatctaagcacacacaggttgacaaagaaaggacagaaaaagatattccatgcaaatagtaatgaagacagtaggggtgactatactaatatcagacaaaatagactttaagtcaaaaactggtacaaaagacaaagaacattatatatttttaaaaggatcaattcaccaatgagatatagcaattataaacatacacaacacacacacacacacacacacacacacacaccgcaaacataagagctcctaaatatatgaacaaacactgacagaactgaagggaggaacagatggcctactgtaacagtaggcttcaataccccactttctataactgatagaaaagcaagagactagatcaaaaaagaaacagaggctgggcgcagtggctcacacttgtaatctcagcactatgggaggctgaggcgggtgaattgctcgagtctaggagttcaagaccagcctgggcgacatggtaaaaccccccccatctctactaaaaatacaaaaaattagccaggcatggtggtgcacgcctatagtcccagctacttgacaggctaaggcaggagaatcacttgagcctgggaggcagaggttgtagtgagccaagatcgcaccacttcactccagcctgggtgacagaagtgaaaccctgtctcaaaaagaggacttgaacaacatgataggccatttggacctaacacatagacaaaaagcataccacccaacaataagcagaatacacatattcctcaagagtatatggaacattcgctgggacaggctattaggccacaagtaagtcttaaaacatttgaaaagactgaaattatataaagtagctttctaatcacaatggaataaaattagaaatccatagcagaaagaaaaccctaaaatccacaaatatgtggaaatcaaatggtacattcttaaacaaccaatgggtcaaggaagaagtcacaagggaaataagaaaataacttgagacaatgaaaataaaaacaccaaagcttatgggatgcaacaaaagcaatgctgaaagaaatttgtatctacaaatgctcaaattttaagatctcaaatcaacaacctagttttataccttaaagaacaagaagaacaaactaaacacaaagcaagcaaaaggaaagaaataataaagattagagcagagataaacataacagagaatacaaaaaaagagaaaaaaaaatcaaagaaaacaagagctggttcctcagaaatatcaacaaaattgacaaacttttagctaggtgaagaaaaagagaagactcaaatgcgaggacattatgacccattttacagaaacaaaaaggattataaaacactactatgaacaactgtatgccaccaagttggataacctagacaaaacggacaaattaaattcctggaaacacaacctaccaactctaaatcatgaaaaaataaaaatctgaacagatctataactagtaaggaaacacccaatgaacaaaagttcaggaccagatggccttactggtgagctctaccaaacatttaaaaaagaataccaatcttcctcatacttcaaaaaattgaagagaaacacttccaaactccaaactatgaagtcagtattatcctgataccaaaaccaaaggcactaaaactacagaccaatatccctgataaatatgttgcaaaaatcctcaacaaaatactagcaaagaaaattcaagagcacactaaaagaattacaccccatgaccgtgaaggatttattcccaaaatgcaaggatggttcaacaacaacaaatataaatcgatcaatataatacaccacattaacagaatgaagaaaacaactcatgatcatctcaattgatgcagaaaagacatttaacaaaatccaacaccatttcatgatttaaaaaaaaacactctacaaacaaggaacagaaggaaactcaacataataaatgtcatatatgaaaagcccacagctaatatcatactcatactcaggactgaaagctttttatcagaaacaagacaagaatgcccacttttaccacgtctgttcaacatagtactggaaatcttagccaaaacaattaggcataaaaaggaaactaaaaagccatccaagctggaaagaaattaaattatctgtttgcagacaacatgatattacatgtagaaatgcccagagtccacaaaacacccccaaagccaaacaaaactgttagaataaacaaattcagaaaagctgcaggatacaaaaatcaatacaaatcagtcgcatttttacatgttaacaatgaacaatcctaaaaggaacttatgaaaacaaattatgatagcatcaaatacaataaaatacttaggaatatacctaaccaaggaggcgaaagacttctacattgaaaactacaggccatcatggtggctcacatctgtaatcctagcactttggaggccaaggcagggggatcgcttgaggccaggagttgaagagcagcctgggcaacatagcaagacctcaactctacaaaaaaaattatccgggcatggtggcacacacctgtagtcctagctatttggaaagctgaggtgggaagactgcttgaagccaggagtttgagacaagcctggacaacaaagggagaatctgaatcaaaaagaagaatgaaaagaaagaaagaaaaagaaaaggaaaaaaggaaaagaaaactacaaaacattaaggaaattaaagaagacaccaataaatgaagatattccatggtcatgattcaaagacttaatattgttaagaagtcaatactacccagagcacctctacagattcaatgcaattcctaacaaaataccaataatgtttactgcatatatagaaaaatccattttaaaattcacatgaaatctcaaatagccaaaacaatcttgaaaaacaacaaagttggaagactcacacgtcctgacttcagtggggacagacacacagacagttctatattgcaacatgcagaccaatggaaaagaagaaagtccagaaatcaactcttacacatatggtcaaatgatttttgaaaagacttgcaagaccattccatggggaaaataagtttttttcagtaaatgttgctggggaaacttgatatccatatgcaaatggataaagttggaaccttattttacacaacatacaaaaaatcaactagaaatggatcaaagacctaaacataagaactaaacttacaaaattatagggtaaaagcttcataatattgaatttggcaataatttttttgatatgacaccaaaagcacaggcaataaaagaaaaaagtgagatacagcaaaatttaaatgtgtgcaacgaagaacacaatcaagagtgaaaaggcaatctaaagaatgaaagagagtatttgcaaatcatatagctgataaagcattaacatgagtacacaaagcactcctacaactcacaccaaacaacccaatataaaactgggcaaatgacttgaatagacatttctccaaggaagatatataaatggtcaaaaagtacattaaaagatgctctacatcactatcattagggaaatgcaaactaaaatcacaagataccacctcacatcacttaggatggctaccatcaaaaaataaaaataacaagtgttagcaagcatatggagaaattggaactcttgtgtactattggtgggaatataaaattgtgtagccccttatggaaagtgtatgtatggcactttctaaacaaatttaaaatggaattaccatatgatctagcaattctacttctaggtatataaccaaaagaattggaaaaaaaaatggttgttttttaatatctctaaaagtgaagaaaaaaaggtcttgaacaaatacttgtacacccatgatcacagcagcgttattcacaatagccaaaggtggaggcaacccaagtgtccattgacagatgaatggacaaacaaaatgtggtatatacacacactggaatattatgcaaccttaaaatgcaaggaaatttggacacatggacaaaccttgaggacattataccaagtgaaataagacagtcgcaaaaagacaaatgtatgattccacttatatgaggtacctagaacagacaactcgtaagagacagaaagtagaatggtggttgccaagagcttgggggaggaaggagagttctttgataggtagagttaaaattttgcaagatgagaagatttctgaagatgaatggtggtgatggcgatacattgtgaacatactcaatgccactgagcggtaaaactgtttaagatagtaaatcttaaaaccggaaggggaagaaaaaaagccaagcatgagagtgcatgcctatagtcccagccacttgggaggagactgaggcaggaagattgcttgagcctgggagttcaaggctgcagggagctaggatcacaccactgcacttcagcctgggcgacacagtaagaacccatctcttaaaaaacaaacaaaatcccccacaactctgtatcatcatagccaagttgtcaaagttagtatcatcaattctgggacaaaactaaagtctatgttcttggaagaaatatgctgaagtatttggggctcaaggggcaagttgtcggcaagttactctgagtctgcaaaaatagctctatgcatatacaagatgacagagtcaatgacgtggcaaaacgttaacacttggtaaatatcagtgagtataccggagtttattta

SEQ ID NO: 11793 - DNA, 7926 bp, Human
ggtggaaggactgcttgagccccgaaagttgaggctgccatgtccataccactgcaccactccagtctgagtgacagagtgagatcctatctcaaagaaaaaagaaaaaccatctgtatttccaattcttcttctcaacagagtatagcagaaaaatgacacacaaacatcacatgtagagtttgcatcagaagaggtctttaaaaagatcaagacaacagatttttacagttaaaagagacctcttggttatctagttcaactttcttctatgtatgaatctctatagtatgcctgataaatgctcatctaccttctacttgaatattctcagtgatggagaaatcactatttgagaaggtacttgattccttattttgacaattataatgtccaagttaaacccaatgaacccagcccttccttcttaaaccacagagaatactccttcttccttatggtaaccctataaataattaaacacagctataaagtcatcccgtctttttttcctcagacttttctagtttcattcaactacttctcatgttatagttttcaacattttcaccaaactgattgatatcctcagtgtatgttcccatttgtttctactgcttctaaaatggagcctggagcaacactctaagtgaggttaacccagagtggagaatctcctaggacaggactagtatatatctctcattataaactccatacggttactattcaaatttgtactggctcttacctaaggtagagtcaaaccttgacaatggctagtaggaaaaaggatgacatgaagccaggatgggaccagagctgagagaactgatcccactctggcaccggatctttggtgggaaggcaaagctgtctaaaggagtcctagatatatcaaagacattcagggtgttttgacaggtggaccaggaaaatattgctggaggaatatttgaagtcagacatgtggcagcatcatgcctccaataggttttggagcaggctctcatcatcccttagggaacatgagaataaagacctaacccctaggggaaaatgttgcaaagagcttttgctgtgttttcagatgactttgcaaattaaagtcaagaagactggagttcaaagaagggctgtatttctaggcagaaactgaggtagtaagaatctggtgtcataaagacctttgttgaattccatcttttctgctttccaagcctaagtttcctcatgtaaaaatggggataagcacttaactttagtactttaagtactaactttaaaggactgctgtgaagatctagtgggataatatatgtagttaggcatgcagttagtgcttatcaaatgttattattatagattaagatgcacaaataaaatataagttaaataaattttaaaataatttcacttttgaagcttttaaagtaattatgtactaagagcattttctcaaattattcttaacacttcctttaagaaaagggctatatctgttttttgaaagatgaccagaagtgacatggattggttgaaaatggcttgtaaagtaagcctaacatttatgatttattaccataaaaactgtaccaacagtacggttataacaaatacacttatttttggattttattttcaagtaagataatgactttatcataaacctttgaaatcagtctttttacagtataaattcagattcattaatccacatagaatttttctcgatggtataattctgtatttgttaaaagtctttgcataagccccttgtcaagccaaatgctgttttccttttagtatccaattatctgaaacttaagaagagtgtgcaccgcccaatgggtgtgtgtatgtgctgctttgaacctatagttgagatccagagaattgggagtgacatcatctgtaacaataaaagagcctctcttggtaagcagaagacctatatataaaagtcaccatttaaggggtctgcagtccaattcatcagttgtctttagtttactcagcatcagctactaacatacctgaacgaagatcttgttctaagacattgtatggtaagtaaacttaaaaattcacttctgaatctcatgagattttgataatcaagttattatttaatgtgtaccatttctacaaataccatgttgtttcttcaaggtaaaatgctaagaagtttgagttatgtttaatataaaatgccacatacaaaataaattaatgctactcaaatcacaaaatcctttttgattaaagtcttctgagataccttgccttttaaaacctcatctgaaattacaacaaaaaatcattaaaatttggcatgctatgctttaatataatagtatcggtgtcaaaattttgaaataaaacaggttgatggtgaatgaatagttctgatttaaataatctttataaatttattaagtggagttaatattctgtttttcctgcagagtattcttatctagattatttattttatggctcataaagagcccaatctgtatactaaagttggataagcccagtttgactagtaaatatttatttcctttacataaatgacagctgtattctgaaaacagtatttcctatgctatttctaaatgatgcagtttccctgtaaaataggagtacataactactctatgtgtatgttaaaaggtagtacactgagcattaaggaaaagcacttctataataacagcctttgcaagtactgaaatgcagattaaggcaagaatatcctatactgatgtgaaacgaggaaagagacaaaagttatattaaaagataattgttaataaaataagttgaagaaataagctacaaacaagcattccattcagagataaagctcgaaatccatatcacaagtaattaatcagatgatttttaaatgctttgacacattatttttaatgctaggagaaatgtgaattaatttagtgaaaatctctagattagcacctattagtttggtatttatggttattacaatgcctgaaatgaaggttacttaagaaaaggatttgctacgtaaatagtgttaacaatttacactatgaagaaaattaggcattttcaagcaagttataaacatttaggtataatcaacataaaatgcagtgcggggggatttctcaaaaataggctctttcattcctcttgtagcttaagatttctgcagtgtgacagaagggagcatgagaagcatggctcaccagccagcctctattgtctatgtaattagaagcttcagaactcactaataccactgtacctttcactggcgcattaccccataaaacttgagatgaggtgagatctgagtataaagataggtcagaagtattttaaagggcttaatttgccaaaaagaaaagtaaaaagctagagaccctttttgcagaacatttggtgaccacacatttgagggaagatgtggcattagatgaagcagaagcaaaccctgctcttaggggctcatctaggtgagtgcacagcctgtgacactacagggagaggctcagtaaactgagatccagcattctgtatgacagaggcattgcttatcacagaggttctgaattttaagtaggaagtacataatgaagagggctttaaaaattgctaagaaagcgagtcaccagggctggcagtagtgtaacagggccatcctgagctgttaggagagtagatgcagggagggctggtgacctccgtgggtttatctgttggagactcttctctccaaatcccaggcctggcttccagcaccatccagctgtgcccaagaagccacgctggtctgttctccaagtcttttaaatggtgcctaatttttctaagtgagcttagcaatgagaagaaaaaaaaaacatgaattatttttctggaaaatcaaggagacatgggtaacaacaggcactaataaatatttatagatgagtgaatgaggaaataattacataaaaaaggtcagtgacaattgataaatgacaaggaaatatttaattaggtaaaagtaaaccattgctctctatactaggatagactttatctacttcgtcttttcctaagtcagcatgttaattctgggggaggatcataagaaaggaaatacttttttaaaaaaaatttaaaaacatgtaacaaagcaagggtaaaatatatgtatatacataagtggtatgactgtaaaactgtactttccattagttattagctgagttaagagaatgatcacgttgaagtactgtgtggactagaaatgtactctgtcatcatgcaatgaaatgttgctaacattttaacatagctcatttatgcagaatgaattctggcagtttaccccaagtcacagttaggacggtagatggtgagatcgcagatgcgtgattatctagattcagtgttacatttttgatgtttatcactcagtggatttttattaatatgctgattaagttatttacttggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacattgaagtcttaacattttaatatttatagtgcttattagtttgcaaaattgtataattaggaattatttcagagacaatgttttctttttcaggtgagtagttgccgcttaatatcattggagtacattctttatactgtttgtgaaattaatactagcatattaagtgtacaaatagatttagaaaacaataaaaaattgcattctaaaaaaataaataaaaataaataaataaataaataaataaaacttgcacaagaaatctccaaaagatagttaggagcataaaactaatttataagttaaattatgtgtatatataatgtatactaatgtatccataaaataaagaggttgattccaaaagcttctcgtgaaaaccaacccaattagttagtattgcattctgtgtactatagtttggaatattaaaaatattttaaaatacctccattttgcttatccttttagtgaagatgatacctgcaaaagacatggctaaagttatgattgtcatgttggcaatttgttttcttacaaaatcggatgggaaatctgttaagtaagtactgttttgccttggaattggatttttaatgttgactttatcatttcgaagtggggagctaatgggaagtggccctctctgtttctcttcttcccaggaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttccccagaggcccagaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaaaatgtaatgatcataagtctaaataaatgaagtatttctcactcattgcaagtatatctttttggttatcactgatacccacatgtttacattgatcatgactaggtagaacaatacaaagtatttttttagtcatgtgtttcacatttggatattttgaacatcaacgttttagtattaccaaagtattaggtttccaaatcttcactagctcaatactgttgtccttttggtttcaggaaaggaaataaaatgctcagcaaaaaaagggggcataaagtggtccgaaacttgaaaaagtatttgcccctacataaaaacccactaatcatagttctaatctggacgcaaaattgcaagaaatagaatgtttgtatctattagaagataatttcattcattcatttgtcatttgacaaatatctatttagtgtttattgtttgtcgtgtactgtcttaggcactggcatacaatggcaaacaaaacagacatggtttctgtctacatgcggcctaagatttaacagagaagacagatattattaattcataatttagtttgataagtgctatgtaagcacagcacaaaatattggagtgtaaaatacagagccctaatgtacttagatcagtgctgtccaacagaactttctgtgatgacagaaatgttctgtattctgtgctgtccaatatggtagccacatgttcatttatgtaaaatgtgggtagtgtgactgatgattgatttttatttacttatttttattttcaatcccttcgtcaatttgaatgattttaaattttaaatttaatttaaaattaatttaaataaaattataaaataaaaaatggaaatagccacatacagttagtgactactatactgaacagtatagttcaatctcaagatgatccagctgaataagaaacatgactaagagttaactagatgaaaagaagtaggagggtttcccaggcaggtggtatagcatatgcaaaggcccttagttgggagggaagatggctgtaatgctaagagccaggattacaaaaatgaataagattccatctctggcctcaaagagttcattttctaatggagaaagacagataggtaagcaagtaattacaatacaaatacaaaatactgtgagatacagagagagtagacttgcctgatagaatgaacaattgagatggaagtttaacggtaagtgaactttgtaaaatgtagaacagaagaatattaacaaatttcttgcattctggtggaatcaatcaaactgtagtttaaatgcaaagaaaattaactttaaatagaaagggatgcattacagaatcatagagaatgctgaaggaaacaatctaggaaagactcaaagtcactgagggagcgattctctcttctaatagcagtagctgccttgactattatcctgagactgccctgatcaggaggcagctgctgttccagaaacacactacacctctaccatccaccccagcaaaacggatgtccagcattctgcctattgacatctgtcagtgccttgtcattgtaacgtttgctaacactagtacagtaaaatcaaaccggtccacaacaatgcttgccagcagaaagggagaagtggcagattaccttacttctgccttccctttctcacaagaatgcatatgatttgctgaaccttagcggcagaggtgtctggaaaatgtagtttttaacttgccaacctatgtaatagaggaatacacactagaaggtggagtggacagtgtctctgactccctggtagagaaatggcacggtgagtattcttgaatatgtcctcttatggaactgtgtgagaatttctttgggatcgttatccagaagtagaatcataagacagacataaatgagtttcacaagcacagtttatactccttccagtaggctaagcattcctgtttccttatttccacctccagtttggaatgatatgcctttataaaaagttttgccatattgacgtcaggtggtagctcattggtttaattt

SEQ ID NO: 11794 - DNA, 25067 bp, Human
ttttcctcacgatggcagcctgagaacaggggacgcccaagggctgggatttgtgtgctccggaagaaaacggggtgtagaagtggggcctctgaaagagggcgaaaaggcaaggaaaaggagaaatgttgcacagtcttatggtctgtcccctgccattctgttcccctgaggtgtcagagcagcttctctgtcttcccagggatgagtttacacagacattccctgtggccccctgaggcctccacctctgaaatctgcagaacagccaggaaacaagcccggcccatggcgccacctgctgcctgcctgcctccgctcatgcaccctgggctgggatggtacttctgttcgtctggcattattgcccttggtcatttaccggcagccctgggcccctccttgctcttctccatgacactaggactcccttggtcttgaagctgggtgagattatcagggtttgtttctcaatgactttgaggtttgacagcagagcacactctttggcagatgagggggcttgaggcttagtcttattccgtgattaaaagcatttcttgtatgtttgtcctttcccagcctggagtggtgggaataaggccactatgttgacttagcggaaggaagggctgactcactgttcaccttccctgtacgttaccagctcgaggtctcaggatgcgttggaccctattttggtctccggaatttgtcatcatgcagtgctattttccccattatgcagaggtggagagggattaaggcgggggcgggcccctgtctccatggagacagtgacgctaccccgctaggggttatttggaagcggggcaggcctaggaggctgaagaaggcttcggactggactccccagcccctggtgttagggcttttctctttcttgggcttgggaacattagccagccccattttagaggggaaaactgaggctcagaaagggcactgaatccccttaggtcacaatgcgcccaagggaagaggcaggatcgactgagcctaggatctcgcgtcttcggctttcccccagagcctgggaagcccttcttagctccactcttctttgagctttccgtcaaacaaatcctagggcccgtggccttttcgagcgctcctaaaggcgactctccaagacccgctctctaaggtgctcttcccctttaagactcacggctcttcccgtcaggctgcgtcgcagtcttaaggccccgccttttcagacagcttccgctgggcctgggccgctgcggggcggtcacggcccctttaagcctgagccccgccccctggctccccgccccctcttctcccctcccccaagccagcacctggtgccccggcgggtcgtgcggcgcggcgctccgcggtgagcgcctgaccccgagggggcccggggccgcgtccctgggccctccccacccttgcggtggcctcgcgggtcccaggggcggggctggagcggcagcagggccggggagatgggcggtggggagcgcgggagggaccgggccgagccgggggaagggctccggtgacttaaggggagggaatgctcctctgccgtgctcaccgcgtgctggggctgcgcggggctaggtatggtcgggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagaggtgggggtcgcagcaaaagcactggggtggagggcggccagtgtggggcagacgcctgtgtgccttcctcagatacgggcagagttgtggatgtgagaagggtctggcttgggtacctcagttccaaacctcctgtgtccatcagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagtgagtgttcttgaggtggaaagcccaggtgcagcctctgaggcagtgagtgttcttgaggtggaaagcccaggtggtggtggtctgaggtggaggggctgtttgcacatcttggtataactgctttctctattgtgttgcaaatcatagtagttaccacttactgagcgtttataaacactagaaaaccctgtgcacctttaaataaatgcaaccattttatagatgaagaagccgaggctcagatgcctatgggcttcatcaacccctgattttagaggaactgcgtcattgtacatctctgtctttctctcttaggcctccaagcctttgggagtagcttctgaagatgaggtaaatagaccagtctcttttctgtcccatttttctcttgcccactgtgtttttacctttaaacttagttcacccgtatttcaatttttgggctttcctgaccgaatgagaatgcctgcttgtttttaaatgtattttttcgtccttctaaatctatggaaagacagtttctctttatgtgtctccagtttctgtgttttcctttccttgtatctaacattgggatccccctccagtgggtcctgcctcttgctggggcctcccaagcctatgggttcatttcatcatttcccttctggcagttggtggctgaattcctgcaggaccagaatgcaccccttgtgtcccgtgcccctcagaccttcaagatggatgacctcctggctgagatgcagcagattgagcagtcaaacttccgccaggctccccagagaggtgagtccagagtctagtgggaggggagatcgttttccatgtagccagggccaaggaagggggttccattggatgctgctggcattggggacctgagatgcagaaggagacaaaagtaacagagtgttttcacgtggattcagggttctttaggcatgatggaatggtatgtatgtattctttcttagttttctctctctctcttttaagcccctggtgtggcagacttggccttgtctgagaactgggcccaggagtttcttgcagctggagatgctgtggatgtaactcaggattataatgagactgactggtcccaagaattcatctctgaagttacaggtgaaacttgttatgggaaaatctatattggcttctatgggacagaattctatacccttcccctgttcacgttatagtgtgattacgatttttctggtctcatgactcatttctagaggggtagggtactgaactcaatttcccttaggtgataacggaatgtaatgtatattaaagagaggactgggtttgtactggataagagattttggatagagagaacgaagagtttggttggcctttttactttatcactgtggtttagtggagaggatctacagattggatggatggcagtgttgccgaggaagagagtattcactacagcacctgggattctggccttaagttatttggaacagaattggggccttcagagtgttattgtgaagttccagtgcctgaagtgtatggctttagaaggtaaagaccataccatgatgatgataataaaaattaataacaatagttacgttctaggccttgtgttacatgctttgaatgcgttatctacttactctccatgagaaccctagaggtagttactgtttttagacctagtttaaagataagaaaattgaggcttagaggtgaagtgtgcccaaggttacacagctttgtcagtggtagagttgggatttgatcctggatttgaatgattcctgaccctgtggccttaactgtgatgctatactgtcaggcctgcaatttatcttctttcttgctttgctacagacttaaaggtttcagcctaatttttcctctttgaaagcatccattgctcctgcatcttttatgattgattcttcttgccctaagcctatctaatcaggtacatggtgggaagggcagtctcttcagctttcctcttcctgattgctctcaaaagttagcctttttcctgtttaagaaatcaagaataacaagagatacacatagagaaagttaccaagttccaggatctcggggagtcacatcatcatggttcctgaatttttctgagatgattaaagggactgaattggtttctacccccaccattttaatttatgttctttcttcgtttgctacagatttcaaggtctcaagtctaattttccttgagagcatccattgctcctcgcatcctttaggattgattcttcttacccgaagcctatctgatcagggacaaatgtgtgtgaaggaggcccatgtttaggatgggcttctccgcacacaagagaaaaatcccaaatctaaaaactaaaactcacctttaataagatctgtgggtctcttttatcacgtgtctctttcccacccataagttggagttaaggtagaacagtaggtgctcttggctttaagagtgctaatcactttatcttcttaagctcattagaacttcacagtaacagtaacacaaggtggatatcccacccccattttatagatgaggagactgagatttggaaaagttaaatactttgtgcaaaatcattgaataatagagatgatattcaaactcatgtctgtgtggctcttgagattcttttttttttttttttttgagacagggtcttgctctcacccagggtggagtgcagcggtgcaatctgtacgcactgcaacctctgcctcctggcttcaagggattctcccgtttcagcctcctgagtagctgggactacaggcgtgtgccaccatgcccggctaattttggtatttttagtagagacagggtttcaccatgttggccaggctggtcttgaactcctgaccttaagtaatccaccacagcctcccaaagtgctgggattacaagcgtgagccaccgcacgcgccctcacgttgagattctttgtgaaattgccgcaagttaaaatctgaaccatagcaaagaccctctccaagacagaaactcagtttttcacataaaccttagacttaagtgctatctcttatcacagagaggcttctgttgtaatgtgggcattagtcatttttgataattcagaaaaatcattgctactatgagcgttgagatggatgaaatttttgctgtaattacctgaattgcatgcagccattgaaatcttccttaacttgaaatgaaaaagaactttagaaaaacatgttttatctgtctcaccagttaaatgctcttagtagagctcttctagtattttgtagattcttttggaatcgtgcctgtttcacagaggcagagacatgcaaaccttagaatggaagttgagctgtttgaagtctgccttcataaaaatgtcttattgcagcagtatattgctttgcatgtagtaggcctctggtattgaatgaatgaattgagatctgggagaaaaagctaaaggaaaggagttcattttgtcgtaactgacttttttttattatccttcatttttaattacagcatttgtggttgatacaattgtatgggttagctatggctttatagataagtagattttgagatgaaagaaggttatactttttaagttcttattttaaaatctccactgttaagagtcaaaatcaagtttaaaaagaatgttgcagctcaattatttaaatttaaattttttatttggaagtacttagtttcactggaagttgaaaaaaaaaatgtataggaaggttctgtatacccttcacccagtctcctccagtggtaacattttacatagcagttatgcagagatcaaaaatcaagaagttgcccttgtttcaatcctcagagtttattaggtttcaccagttttacatgcccttatttgtgtgtgtgtgttttttgcaattttattaaatgtgtagatttgtgtaagcaccatcatgatcaagatacagaactattctctcaccacatgaagttcatttttttagcttaccttattttgtaatggaatccccccgtcttaaatcttctgggtcaaataattctccatcttgtgtttgctcagatctagagataaaacacatcgtcagggttcttaaatttagacagcttcggttgacatggtatgtgaggttcatatgataatcgtgagagataaacctgcactttcatgggaaaagccatggatagcagtagcagaagataattggcaacagatcttttctggatgttggaggagaggctttggaataacagtctcattgtgatgttttctgcttttgttataggtttgccatgagcagactaatgataatagctaacatttgttactgtattcattggttttcaccgcagcccctactgttatctctgctttaaagataaggacatggaaacttaagaaggttgagtaactagtctgaagatgcacagtgaataagtgatggagttaggatttaaatgtgggtagactgaccctacaacttgtattcttctccacagtgctgctatttagcagacacagaaactttcatgagtaagagtagcaagttctgagtttttgacttttgagcttggggaagatgtgcctagaaggaatgagtaaacaacgagaaattatatgaggtgcacattttgagtggggtatttggtgtctaggttattctcactctactaatctgtatgacctcaggcagtgcatcccctctgtagaccttagttgccttgatctcagatgtatccacatggatctgattttctgtaggaatttctcaaagattgtgaaggcagtgtgttactcttttgattctttcggttatttgactcttgttggagtaggttcccaatgccaagaaattctgggtcttgtggcgatttaatctggccaactaccaaattataggtatttgaggatagtttttctcagctctgggattttttttcttaaactgcctcatatctattgttaagtcctcatgtctgttgtaaaaattcaaaggtgctttgtgttttttctgtttttttttttttgtccttgagaggaccatttcataggaatttgaaatgttttctgtgaatttgaggagcacttatggccagaatatgcttttgcaaaatactctagttgagagttagaagtgtttggagagttgaggaggtagtagttatttttcaacagaatggagctaagaatttcaactaagaatggaactaaggaactaggagatcttaaagtctctttgagtattaagcatctcctttctgtctccacacttgaggcaacagtctaattggggcaaatggaagagaaatgcttcctgtaagagctagtgagcagaatctgtatttaatttttgagagtccttgaaattaacagatggatctatggtcaaaaaaaattgccaaccatatttcttattacattatacattatatattatataatattatattatacattttacattatatataatgtatatataatgtatttcttatgttataacgtatttcttattacattatgttatatataatgtatttcttattacatatgttacatataatgtatttattacattatatattatatataatgtaatatatgttatgtaataattatatatgtcatatataatttaattatatgtcatatttaattatatatgtcataatttatatatgtcatatataatttaattatatgtcatatataatttaattatatatgtcataatttatatatgtcatatataatttaattatatatgacatatataatgtaataattatgtgtcatacatatatgtgtcatatataatgtaataattatatgtgccatatataatgtaataattatgtgtcatatataatgtaataattacatcatatataatgtaataattatatatgtcacatataatgtaataattatatatgtcacatataatgtaataattatatatgtcacatataatgtaataattatatatgtcacataatgtaataattatatatgtcacatataatgtaataattatatatgtcacatataatgtaataattatatatgtcacatataatgtaataattatatatgtcacatataatgtaataattatatatgtcacatataatgtaataattatatatgtcacatataatgtaataattatatatgtcacatataatgtaataattatatatgtcacataatgtaataattatatatgtcacatataatgtaataattatatatgtcacatataatgtaataattatatatgtcacatataatgtaataattatatatgtcacatataatgtaataattatatgtcacatataatgtaataattatatgtcacatataatgtaataattatatatgtcacatataatgtaataattatatatgtcacatataatgtaattatatatgtcacatataatgtaattatatatgtcacatataatgtaattatatatgtcacatataatgtaattatatatgtcatataatgtaataatatatgtcatatataatgtaataattatatatgtcatatataatgtaattatatatgtcatatataatgtaattatatatgtcatatataatgtaataattatatatgtcatatgtaataattatatgtcatatataatgtaataattatatatgtcatatataatgtaataattatatatgtcatatataatgtaatcatatgtcatatacaatgtaataattatatatgtcatatacaatgtaataattatatatgtcatatacaatgtaatacttatatatatgtcatatacaatgtaatatatgtcatatacaatgtaattatgttatatataatgtaattatatatgttatatataatataataattatatatgttatatataatgtaataattatatgttatatataatgtaataattatatatgttatatataatataataagtagtaattacttattatttataattaggtgtattctgagagtcttgatcctttgtttttcacattttgacatttcatgctcagattttgagactactttgttgacattattcaggcaaagtctcagttaaaatggagtagaagtttttgtactttaataccgaaggggtagtaaaagcaagggtggtcagatcttgaaactggggacaaagactgctagtatcagctaatattttcacacccctgcccaaatgtccctctttaatgcaaattggagttagtaggttctcaacaagagagtggagttcccccttgggaactgtccttgtcatgggccaggagtggggaatagcaggggaaggtggtggcagactaactagtaagattagttctggacacagggcagaaggaaagaacaccgtaggcttgtgccttctctttgtttccttgttctttagtgcccgcagtcagtctccttgttttttttttctggccacaggatagtaaagggcaaagtcctggaggatgaaaaacagttcagcaccctcattgagtttgttgccttgataggtttattctgatgttgcagcagtcccctttgtcactagagcttctgagacagtttctagaattagactgaaaaaacatagctactcaaagataatcaaaagtgagaaaagtcagaatagtgtttacttctgggggctgggagactgagggagcctgtgagggaactgtaaacgttctgtatcttgatccgggtggtggttatgtgagtgtatcaaatgtggaagttaatttagctgtacacttaagtttggtagacattatatggtttcatatttgtatattacatttcaattaaaaaatgaaaaaacccaccaaacatccatagggaagagcagacctatgtatctttaattctagcctagcattccacttctctgattctcttggtaggcaaattacaatgaaataaggctcctttggccgggattgtgtgaactctgggtagagggagaacagaccagtgccttggttaaggaacaggagcccttctgtgctcccttcactccttactggctccctgctgtacttctgaggaaagtgaaagcccttccgcttcctatttcttattgaaatatcttgcacttcaagaaaaagagtttggttcttaatcctttcctgagattccttatttgatctcccgttcccaactctcagtaaatttctgccccaggctccttgagaatgggttggatattgaggatgttgaaaatttagtactatattcttttgaccaggggtttctgagggagtcagcagagttttgtctgctttggtgtggctaagagggtcagttgaatatgggcatctctttccctttccttgatcccacactgaatgaacctgtgtgatttccccacttctctgctccttgcagaccccttgtctgtgtcccctgcccgctgggctgaggaatatttggagcaatcagaggagaagctgtggctgggagaacctgagggaacagccaccgatcgctggtgagttcagatacctctttccgaatcccgtgaaaggagtatggacagttttcccagcctcctccatccacgttctcgaaccaacttactttattcttttttttttttttttttttatcattcttgggtgtttctcgcagagggggatttggcagggtcataggacaatagtggagggaaggtcagcacataagcaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtgaacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatcggatttctcaatcttttccccacctttcccccttttctattccacaaaaccgccattgtcatcatggcccgttctcaatgagctgttgggtacacctcccagacggggtggtggccaggcagaggggctcctcacttcccagtaggggcggccgggcagaggcgcccctcaccttctggacggggcggctggccgggcggggggctgacccccacctccctcccggacggggcggctggccgggcagggggctgacccccacctccctcccggacggggcggctggccgggcggggggctgacccccacctccctcctggacggggcggctggccgggcggggggctgaccccccgcctccctcccggacggggcggctggccaggcggggggctgacccgcacctccctcccggacggggcggctggccgggcggggggctgacccccccacctccctcccggatggggtggctgccgggcggagacgctcctcacttcccagacggggcagctgccgggcagagggtctcctcacttctcagacggggcggctgggcagagacgctcctcacctcccagatggggtcgcggccaggcagaggcgctcctcacatcccagacggggcggcggggcagaggcgctcctcacatctcagacgatgggtggtcgggcagaggcgctcctcacttcctcgatgggatggcggctgggaagaggcgctcctcacttcctagatgggatggcggccgggcagagacgctcctcactttccagactgggcagccaggcagaggggctcctcacatcccagacgatgggcggccaggcagagacgctcctcacttcccagatggggtggcggccaggcagaggctgcaatctcggcactttgggaggccaaggcaggcggctgggaggtggaggttgtagcgagccgagatcacgccactgcaccccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcatggaggcgcgtgcctgcaattgcaggcactcggcaggctgaagcaggagaatcaggcagggaggttgcagggagccgagatggcagcagtacagtccagcttcggctcggcatcagagggagaccgtggaaagagagggggagagagaccgtagggagagggagagagagagggagagggcttactttattctttaagatttccccttgggttattactcctgtgaatttatggttgaaatgtagtcaaggacacggtggttgtgtgcctgtactcaggaagctgaggtgggaggattgcttgggcccaggaggtcaagtctagcccgaggaacacagtaagaccttgtctttaaaaaaccaaaagcgcatgcatgtgtgcgtgcacacacacacacgcacacacatatatacacacatacacatatgtacacacgcatacacacacatacatgtgcacatacatgtatatacacacgtatacatatgtaaacatgtagatacatgcgtacacatgtatacacacacatagacatacatgtatacacacagatacacatgtatatacatacacacatacacgtatatatacatacatatcagctatatttgggaggaagggagttttcagacttttaaaatatatgtatataggtaaatatatatatatttttcaagaatcctaactatcctatatgacgttcataacttcatcttaaagttcataattttaccttgttcccttcttaattttgagcctgctactatcccatctgtatgcaaagatatgtttgggaaagggagagctagaaggatgtagctagtactttcacactcctgcccaaatgtccttctataatgcaaattggagtttgtaggttctcaacaggagaatggagttccctcacaggaactgtcattgtcatgggctaggagtggggagtagcatggggagggtgatggcagactaatgtgtaaaattagttcttacccgttccaggtatgatgaatatcatcctgaggaggatctgcagcacacggccagtgactttgtggccaaagtggatgaccccaaattggctaattctgaggtgagccacatccctctgctgctttgcccagcagagctggttttggaaggcaagaatcttgcttttcttaccccagtttagtttaaagagaaggagaagagatcttaggtctcttcgttcctgtctatagaacagagacttaagatcctgcctcttccttctagtgttcattccctcatctccttgcctactaactcttttttctgatgcctttgcaagtctttagagccagaaatccctttctttttgctctctacctcttttagggtctttagcatatcttgtctgcagctagagatggtcaggggaggggtgagtacagggtcctcttgggcatggttgagagtgcacacctggaagtcctttcccaagtggcctgtgtgtgtctctgtgccccagttcctgaaattcgtgcggcagattggcgaagggcaggtgtccctggagtccggtgcagggtcgggccgagctcaggcagaacagtgggcagcagagtttatacagcagcaggtaggacattgtcactttccagtcccacttcagagccagctgatgccccaggccatgggttcagtggtcagtggtcccagatggggaaggataagaccagcttgtcttgatagcatccaggtcccaagtgggtgggaaagagattctgagaatgattttctcagaagtacccaggttggtggtggttagtgggtatttagtgtgcgtctgatggatagaaagttggtggtagtggtactgaccatccttttttgtcgcagggtacatcagatgcctgggttgaccagttcacaagaccagtaaacacatctgcccttgatatggagtttgaacgagccaagtcagctatagaggtgagagcagatagtgcaggagcagacaccccaaaagaaaacactccttggagtgagtgggtgtatgaacatcaaagatgatgcaaattgtatttcatagtggacctggatcatctgtgtcagagttgcttggggatggggtgggtgctgttgaaaaatgcagatttctgggccaggcatggtggctcatgcctgtaatctcagcactttgggagcccgaggtgggtggatcacctgaggttaggagttcgagaccagtctgaacaacatggagaaaccccatgtctctactaaaaatacaaaattagcgtggtgtgttggcgcatgcctgtaatcccagctacttgggaggctgaggcaggagaaatgtttgaaactgggaggtggaggttgcaacgagatgagatcacgccattgcactctagcctgggcaacgagagtgaaactctgtctcaaacaaaaaactaaactaaactatgcactgcactgcactgcactgcactgcactgcactgcactacattacatttctggccatcaccccagactactaaatcagtatctggggatagcatctggccatttgcattttaaaaaacttattcagatgattcttaaacatattgaaattcaagaactgctgccttagagaatcccagcagagctgagtgtggggtggggtggtcatgatggatctcctttttctatctgctttcccttccttacagtctgatgtcgatttctgggacaagttgcaggcagagttggaggagatggcaaaacgggatgctgaggcccacccctggctttctgactatgatgaccttacgtcagctacctatgataaggtgaggtaaaaactcttagtttttcaggttccagaacttccttctttttaacgtctttcctttaatcctgaatttgaagggtgcttttaagtattttcttgagtccctttccacgaaaagaagtctgaataattcccttgcccttcctcttcagtgattgagtataaactttattcttgggatatagatgttaatgagactatctttgtcaataatgacagtccagtacataacacctgtgaaggaggtttgcacatgcttgctgcattaaaagcacagaggaagtagctctgcttggaggtcagattgggagctttttgagaagactgctaactcctttggtgggcagtgttagtggacagactatccctttgcctccacatcttaatatctgtttactttttaaactcacatattcattttaagttctttttataggtagtagccacttgccctaatttagggttttcaaagaatttatattagataacttaaatattagggaaatttcttagtagtatgaaagatgattgcattttgcctatagcatgtgctgttgacttagaagcatatgttacttctggggtcttactgaaaaacaaatctacctgtgggttgtaggatatttggggatgtgtttaataactgagctcctgagttgaaacatgaagaggggaaagaatcacttggttttgaaaaaaggcaaaacaggaactggggatgtgagtagtgatgtctttttctcagttcagatctggttgggaaagtattgtggggctggaaccagggcctgagatgcaaaccagggtgctggagatggatcttgatgtaataagggagctatgcaaagatgggaagatgcagttcagaaaaaggctagagtttgagagccagtgaagaacagtattaggaaaaatatgattttgcttattattccagtctgatctggatttttctaactatcctgtgtgatataagggaaaagacagctgggaccttgccatgtatttcactagactatgagttcattgtatataattttgataaggaagaactgaaggaaatatagataacacttttgttattattttgtattaacaatttgataagtcacataggccccatcaacttataaatggaaagttgtacatttatgtaaaaatgtccatgcttttcatacatatagacataatactagttttgtatgagcagcattttcttttatcatttattactctcgtatttatgacatgctggccagaatacatttttttttttcagacacatagaacaatgtgacaaattagaaagcaaatttttttttagaaaaaaaatcacatttgatcaggttccaagaatagaaatgtggaaaggatagtcttttcgataaatggtattggagaaactgcatatccatgtgcaaaagagtgaaactgaaccgttacctcacactatgtacaaaacttaatccaaaatggcttaaagacccaaatgcagtacccaaaaccgtaaaatgcctagaagaaaacatagggagaaagtttcttgacattagtctttgcaatgatttttgggatatgagcttttggtgtcacatccagaatacattttttaattaaaaactttaaaagtatgtttgtagattcttgagccctacttgatatcattgatactttgggatattgcaaaattaggactagaaatacttgcattaatgttcctcaaaaagtgatgtagtaagcaattagtatctggctttaagctaatattgaattccatgtcaatagaactttttaaaaacaaaggacttgactcttgattgttacataaattcatggatctctttgaatgcactgtttgtttattgatagcccttatattttcagagacaatttacattgcagctcaggcagatattaatatactattatgataaaagagaagtatgtgatgggacaaactctttgtagtgatcatttctgcagtttgatcctatgagattttggagcagaccagaccgtgtatcagataaaattaatgacttgggtttggcttttcaggatgtaacagtgaagccaagcttatcctgtgttctgtgggttgttgagggatcccccagagtactctttttccatcatctatgcaaatattctaattttggaaaattcctctttgatcagcaattgatgagacttcaaggagggtagataatatggatgagaggaaacttagagaatcctgtggttgcaagatggtggcattgagttgttgtattatctaatgaagacacctgaagagcattcgcatcacttctggctgtcatatacaggccatcatatcttaaggaagtatccagagcagtgaggataatagctatttacagatagtatcttaagctttttggtaaggcgttggtgaagattcccatttgatgttctcaatggctctgagaggcaggaattacttttattaggaaactgcattatagatgacagtaatctctgttttctgtagagtggcttaaaacacgtattaatgatgaacaatagttgaggttgaatgcagaaggatttattttattgaactgtaatagtctagggcaagggccagcaaactggcttgtgggataaatctttatgtttttagtgatccactagctgaggatggttttaacatttttaaatggttggagaaaatcaaaagagtaatactttgtgacaagtgaaaattatataaaattcaaattttagtgtccataaataaaatgttattggaagacagccgtgctcatttgtttacttatgtctggctgctttcgcactacaacagtagaggtgagtagttgcagcagatccacgaagcctgaaatatttattatctggcccttcgcagaaaaagtttgctgatcactggactagcgtcattttctgccttctgagtttttatattatgcagagatgtccaaaaacacacttgttttcaatataaatatactttctatacatttatctcaaatctactatgtctttcttcttaaaccccccattgtaattatttaattttcatttgtgacaaataatttgcatctgatcatgacttagaattttgctggtaagatttaagtgtttttgattctttatcattttcacaataatgaaaaagggcctcatgtctttattttgtacagttttatctgaatttattcttaactgcatttagaaagacctccacctggtgttttgcatcttgttttcgttctggtgtattattttatgatggtaactactctccaaaaacggactttttatttgcatgtcccaaattttgcagcttactagtgacttcccctttacctcatttcttctctgcctagtgtaaaatgccagttgacaaagctttgcagatagtatcgtaactcttctctaaagtgagaaatcctcagctggaagagaatggtgtctttctgaagtattctctgccatctggattttgggatccagcttttgcttactgtcagatacagattaatattcatgattattaagaatgaaatcggggaataaattaacattttcaaaatgcttgaaaatgttttatctagttgacatgtggaatgactctgagctaagtaagagttatatttgaatagcaggactccaaacaacatttcctttatacatcatcacattattgaaggataacaagaaatgcactttgcatagctagggacactttgtctcattactataagcagatcctgttgagacattctgccccgtggtgagaagtcaaggtgtgggaatacaagcctgtgatgacttcctaaaataagcttatttccagcgcagatgaatttgtagactttcctagcttcccaggtatcatgaacaggagatgggagcacaaacctgataccaaatgattttacttgtgtcatacatgatctttataatatggagaatttgccagcaattaattcaggaacctgtttggaggccctcagcttctctgcctgctggttgtcatcctcacatccctgctgttctgacggtgccacctctcagtccatctctcacgtgcttttcttgtaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagtgagtgactccatagtctcatttctggctagagactgcttcctccatcttgagaaaggccccaaggagagtagtgcagatgggttagggcctgggtgatggcctaggataggggcttgagagcgagatggtgagtgggagaagccagggggaagggcgaatggagaggtgaatatggggtgatggaatctgtcaacttccctctaggcttggcagtatctgggtaccacccaggcagagaatgaacaagaactattagccatcagtgcattgcggaggtgagtacactgaaaggtgtgggtgaggtgcttccaaggctctgcatataaccttttgaatgacagaagcccagacctggatccttgtcttctttctgagtgctatcaagagtgttttctcatgctgaaactctgagggttggagtgaattccattccttcatcggcttttgattttatttgcggctttggttggctccttgcctgctaaaaccttccccttagatctgtaactttattattaactcatgtcagaggagtcacaggtgaggccattgtgactctgcatttcaaagcttggcttggatcccagggtgctcacatgtgccagtgtcagtcattgcagatatcaagtctgcccatccctgatcaaacaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgagtgagtatgaggggttcctaggatgaggaattacagtaacctaagtcccagtaggagggtgaccttggttttggaagtttggatggattgagactgaagggtcctgagaatgggatgggaaacctaggatcaagttgaaggaggtctgcattctacagttcagtgctaggatgaaatagaaaaacaggcttctatattggactttgagagtagaagagatgactgatagattgatgaatgttggggatatggttgatcaatgaagaaattaatttggggggatgggaatagagacattcatctacctactttgtgtttttttccttttcatccagctccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgtgagcccaggggaggaatggaaatgggacatgactgtgtaccttattgaagagccatttgttgggaagctgggtttgatggtgcatgcctgtagtcccagctacttgggaggctgaagtgggaggatcacttgagcctgggagttcaaatccagcctgggcaacatagcaagaccctgcccacccccacaaaaaagaataatttgttcagacttttggagtcttggggtatttcattccagtgttccatgtactgactgccttgggaggactgggaaaagaaggctgggagtgtagggtcatctggacataagagagtctgcatagggtgagaggggctacattgtagccacacaccgaactgttgagaatggaatgggacgaaacatgttagctaacagagtagtgaaacagctggagtaatgtgcagagtttgagctgagtcggtggagtaatgtgcagagtttgatctgagtcggtggagtaatgtgcagagtttgagctgagtcaagctgttcccatccgttctgcatccctatcccaggactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccggtgagagtatctattgagaaatgaatgaatgagctttttctccctgcctttggccctagctccttattcttagatcctgtttgactaaccagccctagctttctccctcccactgctagctgacctgcttccttccattgttgttcagcttaacagctctcattcctcttcttccttacagggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatgagttctgctggtcatgaagctgggatggcagaaggtgagttggcgtttggaggactgggattcaacagtttctgcctttcaaattctcactggtatattggttacctgctcatccctctaaaaatgatagagcacaggagacagggtccctgttctctgggcctctgggctagcaggagaaagagatgtcgataatcatgaatttttactcctgttactactacaaaggaaagtgtgcagtgccatataattgttaggttgttttgtattatgaattacatggaaggattttgatagtttttcagtgcttagggtttctaaagcttttcatctggctctgcctgcctttatcgggaactgtattaagtgccatatcaagatgggtatttatcctgaggaaaaatttaaaaatatacacaaatatttatacttggagatagatgtttgtgggcacattagacttggaaaaaaattttttttttttgtttttttttttaaggcagcgtttcactctttttgcccaggctggagtgcaatggcatgatctcagctcactgcagcctccgcctcctgggttcaagcgattctcctgcctcagcttcctaagtagatgagattacaggcatgtgccaccacgcccagctaattttgtatttttattagagacagggtttcatcatgttggtcaggctggtctcgaacgcccaacctcaggcaatccgcccacctcggcctcccaaagtgctgggattacagacgtgagccaccgtgcccagccaaaaaaaagtctaacttttaaatttatttaaaaagtttttcaaatagagactagatctcactatgttgaccaggctggtcttgaactcctggcctcaaggaatcctgcctcagcctcccaaagttctgggatcacagggaggagcaccatacctggccaaagtctaattttttttttccggtgagctcaaaagctgccagaaaaaaaaaaaaaaaaacccaaaaaacaaaaaaacaggtctaaaagacaactgggtaagtaaattgtccagacagtgaaatatagctattgctatttaatcatttatggaataatttccagtgacaatagatgctaacaatatagtgagaaaaatggttggtcaattatttacagattgtcttaagaaaaaaatgcattgaaaagacaatagggaactatcccaatgtgctaaaagtggggagatcatacttctctgtaattctcaaattttcttggtgcatgtttgatacttttctagaggagaaaattaaacacctgggggaggaaaacaggaagctgttgtggcacctgtcaccacctgggggatcacgaggcagctggtgtcttgggctctgcaggttggtggtgcaaagacccaggcgggaagtgggctgggcaggtggaggagcagtttccacactacataggtgcaggacatgacaaagtctggctgtgtaaatgacttaagaattaagctataaaatacctaggaatccaacttacaagggatgtgaaggacctcttcaaggagaactacaaaccagtgctcaaggaaataaaagaggatacaaacaaatggaagaacattccatgctcatgggtagaaagaatcaatattgtgaaaatggccatactgcccaaggtaatttacagattcaatgccatccccatcaagctaccaatgactttcttcacagaattggaaaaaactactttaaagtccatatggaaccaaaaaagagcccacatcaccaagtcaatcctaagccaaaagaacaaagctggaggcatcacactacctgacttcttcaaactatactacaaggctacagtaaccaaaacagcatggtactggtaccaaaacagagatatagatcaatggaacagaacagagccctcagaaataacaccgcatatctacaactatctgatctttgacaaacctga

SEQ ID NO: 11795 - DNA, 27702 bp, Human
agggagactggagtagggtgggggcaactgggggctcatttgagtcagagaaaagacaaattacaaaaagtaggaagaaaagattggtccatgtgaaacccatctgggtttgttgcctggctcttattgaatgtaggtgggctcctaccctcccacagagactgggagacaggctctgtcctcaggttgctggaacaaacagtacattcttttggcaacctggagttttctcaggcaggcactttaaggaagctggagttgtcctagggatatggctgagctgttagaaactatgttagtgtttgctcaagtctttctaggccatgccttgaggtctagtagagaaagggctcagagggccctggctagagtttggtcgaggacagaatcttggtcaggagtgtgctacagtgtgtcaggtgtggtcctgcactgttcccaaagtgtgtttcttagaacaccattgtgctgggatggtaataggtgtccatggaaaaagaggtccataagtaaggaaaatattgaaagttaatccattatctatctatctatctatctatctatctatctatctatctatcatctatctatccatcctctatttgatagatagataaaacttctcagagcctctaatatatgcattgggggtctccaagagggagatttcattaggaatcagtatctagagaaaatgtatgcctggcacagaacaagtgctctgtgactgtgtgtgtggcatgaatgaatgaagcagtgagtggatattagagacgatggactgcaggagtctaagagaggaaagaaggaaagaaaacttactgcatcagtgagtagctcgggactctggtaatgaatgatcaagtaaaaaagtatgaatatttactttttttttttcttttttttagacagagttttgcttttgttgcccaacctggagtacaatagtacgatctaagctcattgcaacctccacctcctgggttcaagcaattctcctgcctcagcctcccgagtagctgggattacaggcgcctgccaccatgcctggctaatttttgtatttttagtagagacggggtttcaccatgttggccaggctggtctcaaactcttgacctcagatgatccgcccaccttggcctcccaaagtgctgggattataggcatgagccactgcacccagccgattatttactatgttaatagctactatttattaagcaactactatgtgctgggcatgatggtagatgctttcttctattatcttttttagttaaaacagatcaagaaatataattaaacatttaggagggtttttgtaggcttggtttatagaagtaatcactaaaagcaattgtgataatctgacaaagacttaagcttacctgtggtcataataggaagggctaaagaccagctaaccctccaagccacttgaaatattagtaattaatggcagagtgttatgcataattagacactagtagtgtgcagctttttttgaaatgcagcatttacattggacgtcaatctttgctttcgtcaggaaaccaccagcgtactgtacgttgttaaatgaaagcaagcagccaggttaaattctaattaaacattaccattgttatttgaaaaataacagcttagtgttggtgtcaaattgacttttatccacgaatggaattagaacattttgtcattttaggctgtctaatacatgtgaataacacttcctgagaagctgtctttgactttagttaagttgaaacaaagagaattaatatggtgaggatgtaaatgaggatgtcatttagcaaaagaaaaggattatgttgtatctgttttcctttgagcctctaccggtgctttgtaagcaggctggacatttttctggactgtgaattccaaatgtagctcctgttactgcatggtggttcagtgggtaagctgttcccgtttgctgcgtgcaactttcccaaaccagctgtctgagcagggaaatgagtgggctttcccaaggggcagaaggataaaagaagaaagaaaactttgagttttaagaaaatgtgtactgagaatgaatgtatcaagaacttgttaggatagaaagtaaatttaaggcagaattgcacatatataaagctggtagggaggtggcacggtggtgggcattgagaaccagacagactgattgactagttattgattaagttctcctatgtgccagaccctggcagtcactgcctttgagaatcttagatttcagaactatgaggaagacctacaattgcaatgggattgtggagtggacagcacagtgcaaatctcaaatcttttagtttctacctatgtgatcttggacaaattatttcacctgtctgattctcatgtttttcatttgtaaaatgggggcactagcctcaacctcacagatttattgtgaggatgaagcgaaatactacattaagagatctagtatagtgtcctgaatacacatagccctcagtaacctgctagtgtcctttgtcttaataccgaaaccacctttgtcttaatactgaaaaaacagacagagaaagagatttgacctaaccaactccatcttgcttctaacctccaagctgtccttgttcattccggggtgtaggctgaactaactttgagaggaaattagtttatggtttaaaacaaagacaataacagccctttcccaaaacaaacctccttcttgcctggggactagactgcctttgcaggactaacaagttagccacaagattagaaattatagtttagggccgggcatggtggctcacgcctgtaatcctagcattttgggaggctgaggtgggcggatcacttgaattcagaagtttgagactagcatggccaacatagggaaatctcgtctctactaaaaaaaaaaaaaaaaaaaaaaaaaaaaaaaaaaattagacaggcatggttgtgtgcctataatcccagctactctggaggctgaggcaggacaatcgcttgaacctgggaggccgagattgcagtcagctgagattgcgccaccgtactccagcctgggaaacggagactctctcaaaaaaaaaaaaaaaaaaagaaatagttcagaagtcaggcagctggaggctacaagattctgaccctccctaaactgctcctaagatcagggcttgagacattttgcagaccctgcacttgacggatcagctggcaccacccagattgataaactggctcatctggtcttgtggtccccatccaggaactgactcagctgcaggaggacagcttcaattccctatgagttcatctcggacccaaccaatcagagctcttgactcactggcttccccctacccaccaagttgtccttaaaaactttgatccccgaatgcttggggaaaccaatctgagtaataataaaactcaagtcacctgcacagctggctctgtgtgaattactctctctattgcaattcccctgtcttgataaaatggctctatctaggcagctggcaaggtgaatccattgggtggttacaatacctcccttagtagactaaagaacaacttggataaaaccagcaagaaatggattatatcgagggaaattgtcatgcccatccaagaccatgataaggaatgaggaagtaacataatggaaggattctgtctcttctcattgggactgactctaagcacctctgattagatgtcattctatgtctgggatgatctcaggactatggtattgtcctcttgtgctatcaattttaactcacaaatggatgtcgatgtcatttattctcttattctacagaccttcattggctacatgggtagtatgggcaagagataggtggtcctgacggaggagtgggaagagccagtgctctggagtgggattactttctggctgcctgctcaggaaagttgtttcaccattctcaacctcagtttccacatctgtaatatatggaaattaatttctacctcataggattgttgtaagtattaaatgagatattattgtaatgcttaattaaatgagataatatatttaaaaatataattcccctagatataatacatatgtatacataatatatacatataatacatatgtatacataacatatacgtataatacgtatgtatacataatctatgcatataatacatatgtatacataatctatgcgtataatacatatgtatacataatctgtgcgtatataatacatatgtatacataagctgtgcgtatataatacatatgtatacataagctgtgcgtatataatacatatgtatacataagctgtgcgtatataatacatatgtatacataagctgtgcgtatagaatacatatgtatacataagctgtgcgtatagaatacatatgtatacataatctgtgcgtatagaatacatatgtatacataatctgtgcgtatagaatacatatgtatacataatctgtgcgtatataatacatatgtatacataagctgtgcgtatagaatacatatgtatacataagctgtgcgtatataatacatatgtatacataagctgtgcgtatataatacatatgtatacataagctgtgcgtatataatacatatgtatacataagctgtgcgtatataatacatatgtatacataacctgtgcgtatataatacatatgtatacataacctgtgcgtatataatacatatgtatacataagctgtgcgtatataatacatatgtatacataagctgtgcgtatataatacatatgtatacataacctgtgcgtatataatacatatgtatacataacctgtgcgtatataatacatatgtatacataatctgtacatatataatacatatgtatatataaagggattggtaaccaaatctctatataatattatatctctgttacgggagtggggcagggaagtgctggatagagaagggcagggtccttggcaaaagctccaacttcaggcctgtgcccacagacctaagtgagaagacgcgctcctgttttcaagcctgaatgttgcattttccaagaccactgtggcctgccacactccccatcctgtgtccatacaaacctgagaccttagagggcacacccacaagtggctgcacattgagaccagcagaccagcagaccagcagactagaagaccagcagaccagcagaccagcagactagcagaccagcagaccagtgatggtggaacaatgcagcagaaaaagagagaaaaggagagacgtctggacaccgaggggagttcagcctggggtggttggagaagagtccgctcactgggcccaactccagaggaaaccacattcccactccatccccctttctggctccccatccatcttgctgagagccacctccatcactcaataaaaccttgctctcatccttcaagcccgcgtgtgatccaattcttttgggacactgggcaagagcttgggatacagaaggttgtcacaatgccccctgcccttgctataaggcagagagtccattgagctgattaatacacaagctgtctgcagacggcaaagctaaaggagtacagtgtaacacatgcccgcttgggctttgggagtctcagacacgcacccctagatgctgccgtggggccagagcccaaaagtgcttactccagttcttgcacctgcccatctgcatgccctcccttctgtaaagggtttgagctgtggggggaccaaacagcatgaccacatccctgttgcacgaccatgcccctgttgcaaggggaatcagggaactctcccatttcattagtttgttcatgctggtctaaaaaaaaaaatacctgagattgggtaatttataaacaatagaaatttattccttacagttctggaggctgggaagtccaagatcaaggtgccagcagactcaatgtctggtgaggcctgctctttgtttccaagatggcaccttctagctgtgtcctcagacagcagagggcagaaggcaaaaagggccttgctatttccttccagcccttttataagtgtgctaatccaattcatgagggtgaagctcatggcctgatcacctcataaaggccccacctattaatactgtagcattggggaataattttcaacatgaattttggagagaacacaaacattcaaattatagcaatatcttaaaacctgtaaactccttatgcacaagactgtgtcttatttggaaagcaatatggcatcatggttaagtgggagctctggagtcaagtctggagtttaaaccttagctccaggttaccaaccttaccagctggtgttcttgagcaaaggatgtatctctggaactcaatttctgaaatgtgaacattaggataatagtactaccccacaaggttttgtgagaattcaatagtgtataatgaacttttgcttgaggatgagggagcagttcgtgatggattaacccttgacagaagtatacaagctagaaaaattatgaaaaacaggcacttgaaggcctcagaaaacagccaaagcagcaatgaattttgataatattttatttcttgatctgactagtgattacatagatttttttcaccttgttgagattgattgagctgtactctcataaacttttccgtgtatattacttcagtaagaaaatttactaaaaaaagagaattggacattataatcactgattgtagcactagaatggagtacgtgcatccagacattatctggcctttttttttttttttttaaatgctctggcctagttctgttccctatacataggagatacttaacagatatatgtagaatctaattgaatgtgaagttctgctttttcatggtgcttcttgaaaatatattttctcttcttttattccctctcagagacccattgccttatgaattctttcctctattgtttataccaagttgattatttaaaaagaaaccttaattgcacaccttttcctttagaggtatcaatataatgtttgcttttaaagagatgtcatttctccagtattgtgattaaactctctgccgaacttggggttgagtttccaaacactccttgaacacaatgtcaaatccatggatgatgtcgtaacgctcactcactgccactttagtggcttctccaagcaacatgctctttgcaccgaaatcaatggcagcagatttctataaagtggagagaatcctaagcaggtaataattttctgtatgtatatgatctaatgaagaaaagaaaattttaataaagtttaagtgtttccttaaaatgaaggcactgctctactttgtaatccttgaactaaagcaataaatcaggaagagccttatttgaactgagaattttaaggtgctctggataagtctgaaagtgaggaggctttgttgtccagtggaaagaggggtcagagagcttggcttccctccactcatcttttcctcccctctttcagacactttacttctgaacaacaaattggtgtctagtccccctttacaaatgagttatagttctttgagagtaccagctttaaatctaggtaaaactaatttaggcatagctcagatatattgtgggtttggttctagaccattgcaataaagccaattcacaataaagtgagccaacaatgttttggtttcccattacatataaaagttatttttatactatactgtagtgtattaagtatacaacagcattacatctcacaaacaaggtacatgcattacatacaaatactttattgctaaaaaagctaatgattatctgagctttcagagagtcataatatttttgctggcagagagtcttgtcttgatgttgatggctggtgactgatcagggtggtggttgccgaaggttggggttgctctggcaatttcttagaataagacaacaatgaagtttgctgcatcaattgactcctttttacaaaatatttctttatagcatgtgatgccgcctgatagcattttacccacagttgaacttctttcagaattggagtcaatcctcttaaactctgccactgctttatcaattaagttgatgtaatattctaaatcctttcttgtcatttcaacaatattcacagcatcttcactaggagtagattccatctcaagaaaccacattctttgctcatctataagaagtacctcctcatatattcaagtttgatcatgagattgcagcatttcagttacatccacaggttccatttcgaattgtagtctcttgttatttccaccacttttgcagttacttcctgcactgaagtcttgaatccatcaaagtcatccataagggttggaatcaacttctttcaaattcctgttattgttgatattttgacctccttccatgtattgtgcatgtctttaatgccatctagatagatgaatcctttccagaaggttttcagtttactttgcccagatccatcagtggaatcactatcgatggcagctagagccttatgaaatgaattcttgacccatgtgctacagaatggatgttgtttcagcaggcataaaaagagcattaatcactttgtacatctctatcagagctcttggatgaccaggtgcatcgtcaatgagcagtaatattttgaaaggaatattttgttctgagcagtagatctcaacagtgggcttaaaatattcagtaaattatgtgtaaacagacatgctgtcatccaggctttttcccccttcttatagagcacagacaaagtagatttagcataattcttaaggaccccaggatttttggaatggtaaatgagcactggtttcaacttaaagtcaccagctgcattagtttctgacaagagagtcagcctgtcctttgaaactttgaagacaggcattgacatctcctctctagctgtgaaagtcctattttggcatcttcttccaaaataagattgttttatttgcattgaaaatctgttgtttacgagaacacatggacacagggcggggaacatcacacaccagggcctgtcggggggtggggagctgggggagggatagcattaggagaaatacctaatgtaaacgacgagttgatgggtgcagcaaaccaacatggcacatgtatacctatgtaaaaaacctgcacgttgtgcacatgtcccctagaacttaaagtataataacaataaaaaaaagaaaatctgttgcttagtgtaataaccttcatcagtgatcttagctagatcttgtgaataactggctgcagcttcttcatcagcacttgctgcttcaccttgcgtttttgttacagagagagtttcttttcttaaacctcatgaaccaatctctgctggccccaacttttcctctgcagcttcctcacttctctcagccttcgtagaactgaagagagttagggctttgctctgtattagactttggtttaagggaatattgtggctgacttgatcttctatccagatcactgaaactttctccatattagcaataagagtgtttcactttcttaccattcatgtgttcactggagtagtacttttaatttccttcaaaaacttttcctttgcatttacaacttgattaacagtttagtgcaagaggcttagctttggcctagctgggcttttgacctgccttcttccctaagcttaatcatttctagcctttgatttaaagtgagagacctgtgactcttcctttcttttgaacacttggaatccattgcagggttattaattgtcctaatttcaatattgttgtgtctcagggaatagggagcccaaaagggaagtggactagtcagaacacataaaacatgtatcaattaatttcactgtcttatatgggcatggttagtggtgccccaaaacaattataatagtagcatcgaagactatgggtcacagatcacaataacagatataataataatgaaaaagcttgaaatattgcaagaactactaaaatgtgacacacagacatgaagcgaacatatgctgttgaaaaaatgatgatgccaatagacttagttgacacaggattgccacaaaccttcaatttcaaaatatgcaacaaagcaaagtgcaataaaaggaggtatgcctttagtaaaaactggaagtcaaacttataaaggggtgaaaacaagaagggttgatcactttgtgcagacctttagttttgtcttccagtccttcccacactgcaatgcatgacctagcaaatttcagggtctctagcgtgcagcagaaagcttcatagtcaaagttagttttagagtttggtgacctaattcttttgtctttgtttttgtctctgcaaattccttacatttgtgccagcttacttagtgatgcatttcaaagatagtttaaaaaaagatttcatttcgtattttagtgattttccattagaagggtagttcgaagtacctggtcttccatcctgctggaaataaaaatccctttaatgcctgtactagtcagggttctccagtgaaacagaacagtatataaaactacacatttatatatgtatttaaagaaagagatttgttataaggaattggttcgtgtgactatggaggatgaaaagtcctgagatgtgcaatcagcaagctggaggcctaggagagccagtggtgcggtttcagtatgagagctgacaggctcaagaccctagaaaagctgatacctgatacaatcccatttgtttatttttgcttttgttatatcaaactaaaaaacttctgcacagcaaaggaaacaatcaacagagtaaaaagcctacagaatgggagatttttttttttttttttttttttttattagatggagtcttgctctgtcaccaggttggagtgcagtggcgcgatcttggctcactgcaacctccacctcctgggttcgattcccctgcctcagccttctgagcagctgggactacaggcgtgcatcaccacacccggctaatttttttttttttttgtattttagtagagatggggtttcaccatgttggccagaatggtctcgatctcctgacctcaggtgattgtggcatgatctcagctcactgcaacctccgcctcctgggttcaagcgattctcctgcctcagcctcctgagtagctgggattataggcgtgccccaccatgcctggctaactttgtatttttagtagagacgggttttctccatgttggtcaggctagtctcgaactcgtgacctcaggtgatctgcctgccttggcctcccaaagtgctgggattacaggtgagagtcatcacgcctggctgagactgggtaatttacaaagaaaaagaggtttaatggactcacagttccacatggctggggaggtctcacaatcatggcagaaggcaaaggaagagcaaggtcacatcttacatggcagcaggaaggagagaacttgtgcagggaaactcccatttataaaaccatcagatctcgtgagacttatccactatcacaagaacagtgtgggaaagatccacccccgtgattcaatcacctccaactgggtccctcccatgacacacgggaattatgggagctacaattcaagatgagatttgggtggagacacagccaaaccatatcatcagagaactgcatatcaaaaccacagtgaggtatcatctcaccccagttaggatggttattatcaagaagattaagaaaaaatgctggcaaggatgtggagaaatgggaactcttactcttggtgggaatgtaaactagcacagccactgtggagaagagtatggagggtcatcaaaaagctacagataaaactgtcatatgatccagcagtcccatttatccaaaggaaagaaaatcagtgtattgaagagacatctgcagtcccatgtttattgcagctcttttcaaaatagccaagatatgtaatgaacctaggtgttcaacaacagataaatagataaagaaaatgtggcatatatacacaatggaacactattcagccataaaaaggaatgaaatcctgtcatttgcggcaacatggatggaactggaggaaattatgttgttaagtacaagtcaggaacagaaagttaaacaccacatattctcagtcatatgtggaagctaaaaaatagttgatctcatagaagtaagaaatagaacagaggagactagaaggtgggaagcgtaaagagaaagggggataggaagagattggttaaggttataaaattacagttagataggaggcataagttctagtttaccacagcactgtagaatgactatagttaacaataatttatatagtttcaaatagctagaaagagagcattgaatgttcctgatacagaattgctgggtcctggctaacctccaccctcaagcctggaacctgggccctaagtgaaagcagctgacctcattttttctgctcaaataattgcctttttggccctccccacccccatcctgtgcccataaaaagacttcgtctggcagagcaacacaagtggctggtgcaagtggttggggatgcaagctgctgagcctcggagatacaagttggtgaactttggggatacaagcagctgagcatcagagactatggagacgcagttaacttcagatggttcagtttcagggaaagatcatcttcttcccataccaccccctttccaattccccatcccactgagtgccacttttatcacccagtaaaatcctccacatacactacccttcaaatagttcatgtgacctgattcttcctggataccgaacaagaactcaggtgtcaaaaaggacaggtgcaggaggctatcactctgacccttcactgagctgctaacagttagccatccatggactgcaggctgagtgaaatgagccactccagttcctgcccacaaagggggtcgaggtcaaggaaacaatcccatctcagtcccaacacaaaaaaaagataaatgtttgccatgatggttatattaattgccctgatctgatcactatgccttacatatgtattgcaatatcactaagtatgccatacatatgtacaattatgtgtcaattaaaaaaattaaaaataaataactaaaaagaaaaagagctgatgtttcagtatgagtcttaaggcctgaaaagaccaatgtcctggctcaaggcagttaagcaggagaagtttccctttattcagactttttgtcctgttaaggtcttcatttgattggatggggtcctcccacattagggaaggcaatcttcttttcttagtgtactgattcaaatgttaatctcatccagaaacaccctcacagacacacccagtataacgtttgaccagatatctgggcatctaatggcccaggcaaactgacacataaaattaaccatcacaatggattatccacaaaagggcagctatctccctaaggggaattcagctctagcttttgaagttttttttcctctttgtcacatgcattatcctatgtagatctggtcattcatttattcatcaaggacctcctgagagcctgctgtgtgccagacactactttggatactggggagacagtgaacaaagtagacttattgtgtaaaaaaagtacacactggcagtatcctaattttgtgtaaatggcttctgaaaatgtgcataaaataaaatgtaagaaaatctaaacaataggcttatctagtattaagggagggttcattcagaaaaaagctaagaaatattataaaacttctatttatatcttgccttttagtcataattttgacaacagattcccaacttttcagaatatttctaaatttgttttgattgttgtctttctatgagtgaacacacaattgctcttgttaagccccatgagtgtgtgtttgaagctaaagatgcgtcattttagacacatataatggtctccatctctatctcacttctaataggtttgtgatatttacagttcttatcaggtattagggtttttattttttaggttttcacttactatacgacataaggaccaacgctctgcaactttactaaagaaaataaataatctttatacactgattacttagttatgggcattttgttaagtgccttatgaatattatctttttaaatcctgggataggagtacatccctggaccatttatagaactgcattctgttcaatgagttattacagagaaagggaagtggatgaagttgaaaagatcatcatgccataatggatagtacacaaaagacataattagcatgaaaaaaattcagcttattcaaatagaactgtagttactctaatgaataaatgatcccttgattatactttcaagtaataccaagtctaaaaatggttgttaaaccaacaacttctaagttttaattgatttggaatgaatatgtgggcctccattatcataagccagaccaatgtagttgagatgcccattttcccactattcctagccctgaacttggctaaactgctcaactctttgagcctcagtttatttttctgcaaaatgggagcaatcgtaagaacgtcaaaggatgcgaaaaggataaagtaatttatcctttaataaaggataaaataaagtttaataaataaaataaaagaacatacagtttggaacttggaacatcatagttgtttgaaaaatatttgggcttctatttcctgcagtcaggtatattctaagtattcaatgaatatttgttggaggtgttgaattccaatatctataagcaaagagaagtattatattaaaataaaattagttattgaatttggtgttaaatagtttagtctagagctgcctctttacatattttaagttcagcctaaagatttctctgtacatcatgaactataacctaaacggagatataaacagactgtaacctactcttgtgccaatcaccgagttttggccagtcaaagggtgccaactgttcaaaccgtgttcaaataaggtaaatgcctgagctgtcaccagtccagctgtttgtatacctcacttctgtttcctgtgtgtcactttcctttttctgttcataaatcttcttccaccctatggctgctctggactctctgagcctactctggctctggaggctggctgattcatgaatcattcttgctcaattcaactgttacatttactttggctaaggtttttcttctaacattggaaagaaagctgaaacctttcaaactttactcttgaatcttcttttccttgtcagggaactcttcaagggtggatgtcctggaatggccaattatttgtctaaatgctttgtttctttcctaaccaattaggctaaaacacctctggtaaacaaataggcatacaggccccccgccctcaccaccccataaataagactgtaggtgagaaaggcagggaggctgcactttccccttctgatctgtgcaggggaggtttctgcttcaggggatgtggaggagactggtcctggcttagtcttcttaggtaaatctttggcgggagcagcaagctgccccttctaatctgccttccaagtgcatgtagtggttcatggcactgctttacaagagggatgggtttgatgggtggagcacttgcacatttttaacttataaaagtccttgtgagccaggcacagtgcctcatgcctgtaatcccagaacactgggaggctgaagtgggaggatcacttgaggccaggagttggagaccagcctgggcaatatagtgagactctgtttccaccaaaaaaaaaaaaaaaaaaagaaaaaaaagaaaaaaaaattagctgggtggtggcacacacctggagtgttagctactcaacaggctgaggttggtgaattgctcaaacctaagaggttgaggcttcagtgaagttggttatgattgtaccactgggcatccaagtctgggcaacagagagagaccctgtgtccaaaaaacaacaacaaaaaagttattgtgaaacccttagaagagacagtaccagagcttatcagtatctggtttttctttccttcctgggtccacagaggattacatttcctaggtcctttgccagtaggtggagctatgtgtccagtttcacttcagagcccaagcatagaacatacagatgttggtactgccacacactctcttcaatcttgtcttgagatgttagagccacaaggcaagggacatgtagtttgctgagttactgcattgaccttagttgtcctggagagctgcccagacatacagtagatgtagcaaacatgaagagtaaactattatggtatgaaggcacttaaatttgagggctatctgttactgcctcataatctggtttattctgactaattgagcctcgcggggaaggtttgaaatggggtagaaagtattctgtgctaccaacaaaatatcctaaaactatgccaaatagtctactggtaaatgatggggaatcaagactggaggtgggaaatgaggggaaggaaagcaatgaatctggagaagctgcaacagaattactgtctaaaatcatgatcaattgctttttctgggttttgagttagcctgtaaccttcctgcattccaggattctcaaataaattctatgcctttgcctatctcaaaggaatctcctcgaagaccatcgtttttgaaatgccttgaagattgcttacagcagaaaccagctcagcacctgtctgttgccaagtttctttgcaagtaaggaatgatagtcgtatgactttaaactatcattcttccttcacttgaagtgagcaaatttgagtcaacaaataacgatgggagcttacatcaagtgactgtgcttggctgtggggctaccaagatgaagaaggaatgctcctgccctcgaggagctcacagtctagtgggagggaacaatgcggacataactggctacggaacaagttagcctggggaagggcttcagcagaggcataaacagaaaaagtcagggtccagagggagagagatctgttctctttgttggggaggggtctgggaaggctgtattttaagttagtacttgaaggatgacaaagaccttgatggttttctgtgaggtatgaaaaactgccagtgttgtatctctagctttaggagttttattcctatgctgcagaaaaatccagctcgggagatgtgtaatttaagcattttcaaagcccatataaccagagatctgggctaatgggaaaatagtcataacattgccgctaaatgcaataacttgttgatatattttgctcaattacccttgttaatgattcatcaatctttttttgcttcctgcactaaaaaaatcttgctgcagaattttgcccaaacatatacacacctagtttttggcccttggcagccttcctaagtggagagtattttccacatgtggttgttgacatgtagattttgaaattcaaaaacaatggatacatacaagagggagaggagactgagaatgtatcctccatgacacacaaagatcagtgttttttacaaggtggtcccggctgggtgtggtggctcatgcctataatcccagcactttgggaggctgagctgggcggatcacatgaggccaggagttccagaccagcctggccaacacggtgaaaccctgtctctactaaaaatacaaaaaaaaaaagaaaagaaaagaaaagaaaaaaaattagccggacgtagtagggtgcgcttgtagtcccacttactcgggaggctgaggcaggagaatcacttgaacccaggaggcagaggttgcagtgagccaagatcatgtcactgcactccagcgtgggtgacagagcaagacttcaactgaaaaaaaaaaaaaaagtggtccctagaacactaattttggatgaattaataaatgtggtataaaaaaggattatatggtatgttttttgtcagtgtggcaactatcaatttattacctctcagctccaaattcacccttttgttaccagctccacagtgaagccttaagcattgctcttttgtagcaagcatggtgttaagctttctcagtagaggaacaccggagaaacattgcaggaggagggggatcctcttcctgctggctgcaaccacaccttttccaacaaggtctgaatcccagccttggggaggccccaacttccaagtttgcttctccttggatgctcttccttggccctggagtattcgtcagtgtactcttcacatctctatagttactcccctgttgtttttattttatttattttatttttttttgtttgagatggagtctcgctctgtcacccaggctggagtgcagtggtgtgatctcggctcactgcaacctctgcctcctgggttcaagtgattctcctgcctcagcctcctgagtagctgggattacaggcacccaccaccatgcccagctaatttttgtatttttagtagagatggggttttgccatgttggctaggctggtcttgaacttctgacttcaggtgatctgcccaccttggcctcccaaagtgctggcattacaggcgtgagccaccacacctggcctcctgttatgtttaataagggtttatattaaacaagtgagtgagttctcatgagatctgatggttttataagaggctcctccccctttattcggcagttttccttcctactgcattgtgaagaaggtgccttgcttctcaagttctgccatgattgtaagtttcctgaggccttcctggccatgctgaactgtgagccaattaaacctctttcctttataaattacccagtcttgggcagttctttatagccatatgaaaacagactagtacagtaaattggtactgcagagagtggggtactgctataaagataccccaaaatgtggaagcaactttggaactgggtaataggcagaggttgggaaagtttagaggactgagaagaagagaggaaaatgtgggaaggtttggaactccctagagacttgttgaatggctttgaccaaaatgctgatagtgatatggacaatcaggctgaggtggtttcagatgaagatgaggaacttgttgggaactgtaataaaggtgattcttgctgtgctttaacaaagagactggtggcattttgcccctgccctacagatctgcagaactttgaacttaagagagatgatttagcgtatctgggagaagaaatttctaagcagcaaagtgttccagaggtgacttggatgcttgtaaaagcattcggttttatgcattcacaaagagatgatttgaaattagaacatctgtttaaaagggaagcagggcataaaagtttagaaaaattgcaggctaatttctaacgcaatgtgttagaaaataaaaacccattttctgaagagaaattcaagccagctgcagaaatttgcataagtaatgaggagccagatattaatcgccaagacaatggggaaaatttctccagggcatgtcagaggtcttcatggcagccccttccatcacaggcccagtggcctagaagggaaaatggttttgtggggtgggcccagggccttgctgctttgtgcggtctcagaacttggtgccctgcaacccagttgtggctaaaaggggccaatatacagctcaggctgttgcttcagaggggaaaagccccaagtctgggaggcttacatgtgatgttgagcctgcaggtacatagaagtcaagaattgaggtttggaaacttgcatctagatttcagaggatgtatggaaatgcctggatgtccaggcagaaatttgctgcaggagcagagccctcatggagaacctctcttagagcagtgtggaagagaaatgtggggttggggtccccacacagagtccgcactggggcactgcctagtggagctgtgagaagaaggccatcatcctccagaccccagaatggtagttccactgacagcttgcacagtgtgcctggaaaagccacaaacactcaatgccagcccatgaaggcagctgggaggggggctgcgccctgcaaagcaacaggagaagagctgcctaaggctgtgggaggccacctcttgtatcagtgtgacctggatgtgagacatggagtcaaaggaaatcattttggagatttaagatttgactgccccactgggttttggatttgcatggggcctgtagtccttcatttgcgccaatttctcccacttggaatgggtgtatttacccaatgcctgtacccccattgtatctaggaagtaactaacttgcttttaattttgcaggctcattggtggaaggaacttgcttgtcttgtctcagatgatactttgaacttggacttttgggttaatgctagaatgagttaagactttgggggactgttgaaaaggcatgattgtgttttgaaatgtgaggacatgagatttgggagggaccagggatgaaatgatatggttaggctttgtgtccccacccaaatctcatcttgaattgtaatccccattatacccacgtgtcaagggacagagcaggtggaagtaattgaatcatgagggcggtttctcccatgccgttctcatgataccgagtgagttctcatgagatctaatggttttataagaggctcttcccccgttactcatcacttctccttcttgccaccttgtgaagaaggtgccttgcttcccctttgccttctgccatgattgtaagtttcctgaggctttcccagccatgctgaactgtgagtcaattaaacctcttcctttataagttactcagtctcaggcagttctttatagcagtgtgaaaactgactaatatagtctattattccatttctattatgtccatgagtacctgaagtttagctcccacttatgagactgtgtggtatttggttttctcttcctgtgttaattcacttaggataatggcctctagctgcattcatgttgctgcaaaggatatgattttatccttttttatgagtgtgccgtagtccagtgtctatgtactacattttctttacccaattcaccatcgatgggcacctaagttgatcccatatctttgctatagtgaacagtgctgcaatgaacatataagtgcatgtaccttttttgtagaacagttttttttcctgtggttatataatgagatgtctgggtcaaatggtaattctgttttaagtcctttgagaaatctccaaactgctttccaagtgtctgaactaagttacattaccaccaacagtatgtaagcatttccgtttctctgcagctttgccagcatctgttatttttttgactttttaataatagccattctgactggtgtgaaatggtatcccattgtggttttgatttgcatttctctgatgattaatgatgttgagcaatttttgtatgctagttggctgcttgtatgtcttcttttgagaagagtctgtcatgtcctttgtccgctgtttttctttttgacatagggtctcactctgtcacccaggctgcaatgcagtggtgtgatcagggctcactgcagcttcagcctcctgggctgaagcaattctcccacctcagcctcctaagtagctgaaagtataggcacaggccaccacacctgactaatttaaaaaaatttctttctttccttttttttttttttttttgtagagatgagttctcactatattgcccaggctgattttgcccactttttaatgtggctatttgttttttttctgcttgttgaattgtttaagttctttacagatcctggacattaaacctttgttgggtacatagtttgcaaacattttctcccattctgtaggttgtctgtttactctgttgatagtttctcttgctgtgcagaagctctttagtctaattaagtcccacttgtcaatttttgtttttgttgcagttgctcttgaggacttagccgtaaattctttgccaaggctaatgttgagaagagtatttcccaggtttttgtctgggatttttatagtttgaagtcttatatttaaatttttaattcttcttgagttaatctttttgtatgtggtgaaaggtaggggttcaatttcatttttctgaatatggctacctagttttatctcagcatcacttattgaacagggagtcctttccccattgtttatttttgttgactttgtagaagatcagatggttgtaggcatgtggctttatttctgggttctctattctgctccattggtttatgtgtctgtttttatacactgtagtaccatgctcttttggttactgtagttgtatagcatagtttgacaacaggtaatgtgaggcctccagctttgtttctttttgtttggctgtttggactcttttctggtactacatgaattttagaatagtttttttttttctaattctgtgaaaaatgatgttggtagtttgatagggatagtgttgaatctatagattgctttgggtagtattaccactttaatgatactgagtcttccaatgcatgagtatggaatgtttttccatttgtttgtatcatctataatttctttcagcagtgttttgtatttctccttgtggagatctttcatctccttggttggatgtattcctaggtattttttttattttattattttatttgtgactattgtaaatgagattgtgttcttgtttggctctcagcttgaacattattggtgtatagaaatgctactgatttttgtacactgattttgtatactgaaactttactgaaacctctttttccattctaggggcctttttgtagagctcttaggttttctgggtatagaatcatattattggagaagaaagataatgtgactgcttctttttctatttggatgctttttctttcctttttttgcctgattgctcttgctaagattttcagtactatgctgaataggagtggtgagagtgggcattcttgtcttattcctattcttaaggggaatgcttccagcttttgcccattcagtatgatgttggctgtcagtttgtcatagatggcttttattattttgaggtatgcttctttgaagcctaatttgttgcggcacatgttcttttcttttccattttttttttttttgagatggagtctcgctctgttgcccaggctggaggctggagtgcagtggcacaatcttggcttagtgcaacctctgcctcccaggttcaagtgatttccctacctcagcctccctgtagctgggattacaggtgtgtgctaccacagcaagctaatttttgtatttttagtagagacagggttttgccatgttggccaggctggtcttgaactcctgacctcaagtgatccatccacctcggcctcccaaagttctgggattacatgtgtgagccaccatgcttggcccacattttcttatataatatgaaaaaatccacgttaattcacattaccactgatctcattaggaaaaaaattttaagtattagcagttatcaagctcatgatgtcagataaaaggtttccaaaatgctaagattcacttgaaatctgaagtttatcattggcaagaatatgtttgccaaataattaagtctgaataactgtaatttgtctgtcagtcatcctcataaatatgaaatttttaaaaaatggaaaagtagctaattccgtttgtagctcaaacaatcataagtattttttctcatgacaaaccacagtattttggtatgcagtgaaagagctttatgtctacattatatttcatcacaaacaatattaagatgtgtactcaaaagtgagatttaaaaaaagtcttttttttctgttgcattaagtgataaggcaaaacttatattttatttatttattattgattttattttttaattttcggagacaaggttttgctctgtcatccaggctggagcacagtggcataatcatgtttcactgcagcctcaacctcccaggttcaagtgatccacctcagtgttccaagtagctgtgactgcagtcatgcaccaccatgcctaatgttttatttattgaagagatagggtcttgctatgttgcccaggctggtctcaaactcctgggctcaagctatctttctgccgtggccttccaaagtgctgggattacaggcatgaaccacagttcctggcaagaatttgcatttaaaaaactatgactgcatggggtgaaaactacaatgactactaagtacagtttggtattctactgtgatttgtgataaggaccagccattttacccattgctatagtttggatatttgaccctccaaccctcataatgaaattcaatccccagtgttggaggtggggtgcagtcaaggtgtctgggtcacaagggtggatccctcgtgaataagttaaggccttccttgggtgggagatgaatgagttctcgctctgttagctcctgagagagctggttatttataaaaagcttggcacctcccctctcttttgctccctggccacgtgatctctgcacaagccagctccccttctccttctaccatgagtagaagcagcctgagaccctcaccagaagcagatgctggtgtcatgcttcttgtacagcctgaagaaccataagccaaatataccttcttttctttgtaaattacccagtgtcagatattcttttatagtaacacaaatggatggagacccaccattacttttacaccattaatgtaaatgtcaacacgatgaaaaaagcaaacgatgtctcagtattattgcaaaaatagttttggctgggcatagtggctcatgcctataatcccagcactttgggaggccgaggtgggtggatcaactgaggtcagtagttcaagaccagcctggtcaacatggtgaaactaaaatacaaaactaaagatacaaaaactaaaaatacaaacattagccgggcgtggtggtgtgtacctgtaattccagttacttgggaggctgaggcaggggaatcacttgaacccaagaggcagaggttgcagtgagcagagattgcaccattgcactccagcctaggccacagagtgagactccatatcaaacaaaacaaaacaacaaccagttttgacctaatggataccatgaaagggtctgaggacccacaagagtttgaagactgcactttgagaactgccaggctagttatgctgtgatgacaaatgactgtggaacttcaacggcttaacctacaaggacctatttcttgtgcatacaacctgtccatggtgccatgactgcaagtttgttctacatcgtctttactccaggactctgtatgtggactaggctgcttcctctgccatggcagaggaaagagagaagagaagacgtgagctggctaaagctttgcccagacatgacaacaggaagtgatatgtatcacttctgcccgtttcacttgagttcatcagtgtagagatgtatattctttcagcgagagaaaccggaagcatggcaaacagtttacgacctaacgcagtggtcataaaagattagaaaacggccaggcacagtggctcacgcctgtaatcccagcactttgggaggccgaggcgggtggatcatgaggtcaggagtttcagaccagcctgaccaacatggtgaaaccctgtttctactaaaaatacaaaaattagccaggtgcggtgacgcacacctgtaatcccagctactcaggaggctgaggcaggagaatcgcttgaacccgggagacggaggttgcagtgagccgagattgcgccattgcactccagcctgggtgacagagcgagactccgtctcaaaaaaaaaaaaaaaaaattagaaaacactgcataaaacactcctttcctagaaattcacaatacacaaaggcataaaaagacatggagaaatcccgcagtaaggaaacactgtgcacttggtttaattgagggtagggctactgagagaaaatttagattcaagatttagatttagatttagattaagatctgatgctcattgtccttttcctgtttgaccctttgctggtcctgggcagagaaaaaggcagccttgaccaatcctttcccatgtactcaacaacaggttaaagaacactgggatcattacttagtacctggccaattgggctcagtgactgaccaaatgaggctctcttcaatacttcccttattattacccgctcctgtgctggtgaacaaggacgctggatggaaccgcttgtgtactcagagactattactgatacagaagcgaggaagggaagtgctgggaaagcaagggcgtggtcctggctagggcttcactcctgggcctgtgcccaaggacctagatgacgacaggcttctgttttcctgcccaaatgatgcatttcccaagaccaccccgggccgccacaccccccatccggtgcctataaccccccccctagactctagcaggcagacacacatgtggttggaagtaaagaggaaaacattggcggaagaacacattggcggaagaacatacaggtggctggagcttgagaaggcgttgaggggagcacacctaaggaagagcactccggctggctatccaccggtggaatggctcacagtttggatgggatggttggaggaaagcctgggccactgagctgcctgactccgggaataaaaccactttcccactccatcagccttatggctcccccatctgctgagagctacttccactcaataaaaccttgcactcattctctaagtccatgtgccctccagttcttccagtacaccaatgagaggtgacagcacgctgacagccctcacagccctcgctcgctcttggcgcctccctggcctcggcgtccgctctggctatgctcggggagcccttcagcccgccactgcgctttgggcgcccctctctgggctggttgaagccggagccggctcactcagcttgcccggaggtgtggagggagagacgtgggcgggaacctgggctgcgcgcagcgcttaggggccagctagatagagttccggatgaggtgggcttggcgggccccgcactcagagtggaccccggcagtgaggggcttagcacccgggccagcagctgcggagggtgcgccgggtcctccagcagtgccggcccacaggcgctgcactcaatttctcgcccggccttagctgcctccccgtggggcagggctcgggacctgcagcccgccatgcctgagcctctctccacccccgcggagggctcctgcttgggccgagcctcccccacgagcaccttccccttctccacagcgcccagtcccatcgaccgcccaagggctgaggagtgcaggcgcaaggcacgagactggcaggcagctccacctgcggcatgcccccctgcggatccactgggtgaagccagctgggttcctgagtttagtggggacttggagaacctttatgtgtagctaagggattgtgaatgcaccaatcagcactctgtgtctagctcagggtttgtaaatacacc

SEQ ID NO: 11796 - DNA, 57280 bp, Human
ctgaatctcctttccccgcagtccctgaggccagcaggctctgggcctcacaactgtcctctgctgagcgaccctttggtcagatccctgggcgtgcacgtagcagggaggtatgcatctgtgtgcgtgtgtgtccacgtatgggaacacaggtgtatgcatgtatgcatgtgtacagggtacacccatgtgagggccccccagacctttttccaaggagtaaatgacaccctctcatagtgtcaggtgttcactcaggacccccaagggtgagggtggagcgagagcgtggaaaggcctaaggtaggctaggcaggagcacagccccagatggccccttaagatggccacacagagcccagccagacatcaatgtcagccaagggctggccagggtggtccccgggaggtgcgggggtggggctatttaagcctacccacttctctcttcattcacctaggaggcaatcacaggagcttgtctgtagccaaaagatgcccccagcccctccctacctatcaggtcccttccctgggcacaggcctgagtgtgtagcctaggtagccactggcaccagagatggaacctgtctgaacccaagggagccccttgtggccaactctagctccataaactggaagggtgtggcaggcagccggagtccagtggcccacagtgtctctcctgggctggcaggcctgtgccccggccacctgcccctcagcaagccaggtctggacatcacggttggctgagtgcaagccagcctctgtcttggcagctccccctcctgcctgtgagggtgacttcactttgacttcatatctgcagtgatgtgcagatcacttattcagccctgagctcagccaggcaagagggcggggttctgcacacagcaagcaagggagcggctggctcaagggtgccctgggcccaggttccctggcttttcctcctcaagggcccatgggcttcccttcttccatccctctgcgcctaagtgcaggccagacctcaaaaagcagccggggatggggcgagaacagaggacttccccactgagcccacatccaacctcacccagaaccccttctcaggtccagttgctgctccctattaggggtaaatgtgtttatgcgcatcatttccatcatttctttgggggaaaattggattctttcctcctcctcgctactcgctctccgactctgccagcccatctcctgagagttctcctgtgtaagggatgcaagggccaccagcaccaggtctctgaaaggacgccggagccagtttccggtttccaagggttggaccagtgctggaggggggaatcacaaactgcccttccaggaccctaccctctctactaccccaggatgctgaaaaaggctattctgcctctcttcccctgctcagctcttccccgcctcctgcctccggccccagcagaggccgcgctcccactgcgcctctcgcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttccatccccgccgcgcacctcggggtccgcacccggctcctgccgggcccttttcggccgcaccccgctcccgcaccccgctcctccccaagccccacccggcccaagccgcgcgtcccgcactgagctcctacacgcgccgcgccccggccgcaccccgcgcagccagagcaagcactggagccccgccccttcccgcaccccacccgcctccggccccgcctggcccacccctggaccgcccccgccccgccccgcccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggcgtcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcggcgggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgatcggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccaggggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggccttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagtgacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccgtacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacattgagcacaaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggagcccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagctgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctgtcctgccactgacagcctgcccgtggctccagtgcccgtgagaccatgtcacagtatctccccgtccccttactcccttccccttcccaaattctgaccatttcccaaatgtgcctagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacatgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccacctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactgtgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcacggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatcccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcatcctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggcccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttccagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcgaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtctgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacacatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgtgtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatgctgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccactctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacgtgtgggcctgggagagcccagccctgctctggcccgcccccgtctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctgggatggtctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactatgatgaggtgccgttcccatctaggtgagaggcagtggtcagggtcacagcatcgggcaggggagcagcagtgtggatggaggggcaccgaagtcagaagggggtgcctttctggggagcctggcctgcaggtctgcatgtgctactcagagcctccaggctgtgccgagtatcctggagcctccttgtcctggccaggcaggcctctgccctctcctggtggtggcctgccccttcagtgttcctactagcactgtccagggcgctggaagccaagcccagttctggaagtaacagaggctcatagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcggaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcccgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctcttgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagcttcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccatggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcagggggctgctcaaaggccatgccgcccagacgttcagagcagaccctgctcaaaaaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttacaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcgtagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcactggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcaaagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagggttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccagggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtcttcgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtgtaaactttttttctttttaacattctagttggaaacaacagatttctgattttgtagtttccatacaatatttaaaacatcacaaagaattctatcatgataaccactgaggcatcaatagtggtcgaggactaggggctctggagatatcgctggcttatctggtacatttgcgtgtgaataggcacattgatagaaactgaaaaactcagctaactccactgttcaaggaatcccttccttaaaagtgtccatccctagaacaaagcagcagccagtgtcaagtttaggtcttcacagttctctagcaatttgcttgttgctgatcttttgaagttggccttagagctgtgggagacagaatacaaaatgccaagtcctgaggaaggccattagaagtgtgagggaaaatgctgtcctgaaccaccatgaagcctgacatactcactacttctgtttatgtcttccccgaggaattctctgagcttctcatgccgggcgtggagctgatgggtcagtgggcaaacgggagttgttgtcaacatcagtctcatctgcgattgcattgtgtcagatgccaacggcctgtgtcacacacatacacgtgtgtatacgtgggcctttgcacgcctcgccaggtggtgtacatgcaggccttggcacgcctcgcccagtgcccgccccaggcccatgaggccccgcttcccagccgtgggtgtctgtgtctgctcacggcttcctccttcagcctggaccacgggctggaagtgaacgtaatctccagagccagctgtttgctgtagcctttacctctgaaagtagaaatctacgccaagaaaagttaatgctaaaagccacccctaatgtagactctacattaggactatttgtgtgtgtatgtttgctgttttattttcccctaaaaacacattttctgccaaccttcacgaaggatttcttcccaccacgaggccagcttatgtgggcagaaatctagttgaatgtgcctgagaacagggcttgaacaaatacttcatacacaaaagaaattttgaagggaaagcataatttctaacatataaagaaagcctctcccgcaggcaggtggagcagttagcggtgcctctctctgcctcgggtgcgttcacgcatagtgtctggcacaccttgttttattgctctttgctttattgcgtttttcacaaattgaagttttgtggcaacgctgagtcgtcgagaaagtctatcagggccattcttccaacagcccacactcacttcatgtctctctatcagtactgttaagcagtaaagaatctttaaaccaaggtatgtacattgttttttagacatagttctgtcacacacttaacagactccagtacagtgtaaagtgtaacttttatatgcactgggaaaccaagagacttgtgtggctcacttatttgggatcttcaatcttctttgctttaccggggtggtctggaacagtatctctgaggttcgcctgtgtttagtggtcctcacaactggggggtggttctaggaagtcctagggaatcctaacctctgtggccctgaaaaagcagaaaggtgggtcttcagggtgcatgcagcagtgtgcgtggccccacacgtcttccacatgaagatgctccaggtgcaagtcctaggcttgtgcgcctgcagggaaagcaccctctctgccagggctcctgctgtggccctgtcccttctccatggcagcagccttgaccgaaactgtgtagagtctcccacctcttcagggagctgggactcaggaaggatcatcttagctgaggtcataagaacctgcatgtagagaacttttcagcgtggggccactactgtgtcctgctgctgaggccaggtagtggccgtctgagggctgcaagggcaggctgctcccaggagttaaggaggcaaacactctgaacaccctggagaaatcacagtttatctttgcaac

SEQ ID NO: 11797 - DNA, 23925 bp, Human
gattgcctatcctcgccaccagctgaaggcaaggccgttctgctacgagcgcctcttaatctctacaaaatgaaaagaaaaaaagagaggattattagcccattactcagaggaatggggaggctgcaaaaatcgtcgatgggcagaggtgaagatgtctttctcggactgcactttccggtgtcctgtaactagagttcagttgtgggacttgttgaagaaatttgattttcttgcctcggcgagatttcaaaaaccagaaatagaaattctcagagtcagagaggaaatacaattaaacagcacgtgggcattttccccctcatttctctccccttaaataacactgctttgagtttccactgggtaaagagagaaagtttgagttttcacggatgttacgtggaggttagaaatggcttaaaatgtagatctctaatcagttttcttcgtggctgaagaggctaaccctttccataaaatgagtccatctgtcgactgttagctatttcaaagtgaagggatttagcactcaaaacaaattgagcaagtttgtttgcctgtttttactgctaactcaaatgaattcaaaacacggagtaattcaagaaaacacataacatgttccagacagcccccaaaagtagggaaagcccagcacctatatagtgactagggttagttttaagcgccaagcttttttaaacgtatctattttatgcacattctcccgagtcactatatatttctaaaattgcgagtattggtatattgatttaggaagagcaatacaacttttagagggaactttattctcaattagggaccaaagagatgtctttttaatagcgggcctgagttttgctctcaagcaggaattaatattggtgggaaaatccgaatccaggagcaatggctgtgttccggcactttccaaaaacatacattaacaggatgcccttgagattgaaaaaacattgtcccatatgcctggcagaagccttcacacctggtcctccaggcgaattatatttatagtccttccactcagaggcaggacagagccaaaatattctgctcactaccaaaatacacatctttgctcaagtcaagaaatcagaaaatcagggttcagaagtaaggcacacttttcgagtgagaatatgccctgtaatttcacatactctttgctttgcaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggccggctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccggtaagtggaggccatctatcccgcagggatgtgagataatgcgagtctggaaatttgttccacttcggagaatcttcaccgtaggtgatttgtggcttttggggctaagtttcgcccaaggtaacgcagtcggcaaacagaccttgcaaagccctgttcctttcgtcccccgccacagacactaacaatctacagggtgctgaagtcgagagggaagccagaccgtggctggcatttaaaacgaggtatcttcccttaaatctcggtgccaacactgcaggaacaaatcctcgggccaaggattagcattctcaagataaagggctgggtacaaagtttcagctactggaagattagcccccttcccattgttatccattgggaaaaaaaagaaaagaaaaagattccatcttaactggcagttagtgacctctcaggcccaagcgaattacctgggagccaggcctggatgccaagctctcaccatttctttggattgtaactcctttaaattgatcaccagtcaactccaatctggcacttcaggagatacactttaaatggatgcagagaattattttccagctggagattaagaaaaaaattttcgattctaaacctccgaaatatgttcctcttttccagtttaaccactttactttcttaagcaatttagaaatcaaactatcataaggtggtgtgatttttttttactcttttgtgtgagtattgtcttactaaactaaacggaaaaaacttttaccattataaatgtaaatatcagaattcatacattctaaaatatttttatgaaaaattaatctgatttaaagaaatttccttgcatttgttttagtctatcaatcaaaactaaagatgcttttatcacacaaaatatcattttggcagaaatccacctaaaattcaaataccaataatatcaagaaaacaaagcacataagcaaaataaattgaagatttttgttgatgtaacatgagcatacaacatttcaataaccaaactttccctaaaaaattaaatagccacttcatttgtggaatgttttactttaactcagcaaaattacacttaaattatttaggtgctttgttccttaagttaagcgtgtttgtcttcaaatgttcctaaagcacttatattaattggttgtaaagaacgcatacacatggtaaaatacagaactgaactgagcagtattttaatttccttaaataattacttactacaaattaatttactggctaatttcacaatttagttcatttaaaacacatgttcctgtgctgtttatttttaaactttccattaaagattttgttatggggtaacaaagtgtatgaaaaggggggaaatgtgaaaggatctgggattattcgaactgtatttttcctgcactttcagtcttgcggtagtcatcagaaattattttttagcaaattgttttatttcttagggcttgcctgcctgctttgccatggttcctcgtcctccattagccgtgtagtgctttttgtgtgctcacaatataaaacccaagttggccaaaacaagagtccttggcatatacattccaactagaacatgaactttgggggtgagaactacctcccatcaggaaaagtctcccatctcaatttgtgagattagccattgaagccagttccgaagtctggcagccaaatttctcacagaagacttgtcttgatagggcaagtttaaggatcagcaggcgggaattggaggtctctttttaaaaaattatcttccccagttatttagactcagttcttctagtaggcctggtcattaaatgaagcataaaaatgcaagtctcaaggctcattttgactgcaaaataaatctccaagtcacaaggacatgtaggagtgagctaaggaacacgccttgaccttcttttcagtccttagagtggagctctatgagttcttgaagatttgttttgtattgctttgtttggtcttcagcactgaagcacggggaagtggggggaagaatgtgtaataattgactgactttacaccaagcaacgcaatctttttcttttgtatatttcattctttaaaaaaaataaataaataaaaactatttgcagttaccatctgcagtgctccggctaccagctaataatgcagccagttcagacatataaaaaaaaaagattatcgaaatgatgatgacatgcaaatttcctccgaaattatcataagtaaacatttgaagtctggactaataaaatcccatctgtgttacttcatatcgagttagtagaaagctgtgataatgaattttgtaatatctcacgaacagacatctcaatcagggactaatcctgtgattttactgcagaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacggtactcaggccagaggcaggcccgcagctccctgccccgcctctgtgcctccgccaacccgacaacgcttgctcccaccccgatccccgcacccgcgcgaagtgggccctccggtcgtcggcgtaccctggttagcgtggagagaggcaggcgctgagatcgaaggggcctagggagccctggaccttcttttcttgtctttaaagcaaccgcggctcttctacccacccggtggagcccctcgagacccacctctcccggcttgcctgtggcagagaagggggagcgcgttaaatgcttggctcgctgcgttgcggttgaaaacgtgaaaaagatttggctcgcccgggagagaaagggggagaactgggtagcagttataccagagctatttctccgtccttggcgggcagtaaaccctccaagaacgtttgccctgctctcctcagtctcgctcagtccacccagtgtctctcctctgcgatcttaaatcatactttagggtaattatttgtagtaagtaaataaatggccgggttagtatctctaggagaaagtgtggctaaatatggaaaagtggctcctgatggatgagaggcccgaagtcagctcgctcctgaaacaccctaggccaagagcccgttcgtttcagaattacagaaaaccgagggaaactgctgtctaggacaggggcacgttggcgctgatgttctacaaatgtttaccgagctccaactaatggacaagcactgaagggtggtctttgcatacagcttcccaaagagaaaagtcctctccacccacccactcccgctgccattgcgttcagatgagttcttaaccccggcaccgagattcttgaaagtaggtccacagcctccccagcacactgtggctttatagtcctctaacctctgggcacttttgcggcaactctggagggagatcccctcttgataaataaatgtcctgggcccgaggctaggctggagatgctgctgcacagccagaggctgtcaggtcggaaaaacacgcctgaagcctagcacacagtaggcgcctaacagctagtgtaacgtagtctcatctgagccctgctcactcgacggccgccgcttcttacagccttccttctcttctgttttgcagataacggggaatggagaccaactgccgcaaactggtgtcggcgtgtgtgcaattaggtaagaacccccttctcctgcccgggtcatcggacgggaggccgcgccacgtgagggcggcaagagggcactggccctgcggcgaggccccagcgaggggcgcttccccgaggggccagcctgggcaggaaggaaatcagaaccaaatcgccagtggcctctccctgtggcggggcggtggactaggaagcagcggcgcgctgtgtaccgaagccccccagcctactcctcccggctggaaccgccggcaaccggggaggcgcagaaagagtacgccatcctgccccgggttgccagagggtccgggggacggggatgccgtcagctctttcctctaactgggtctttgctctttgtccctctttctcctccggcctgcctcgcccctccccctcctcccgtccccggctcctttcggccgcggtccgggacgcctctctccgcacgtggggcgggcgcgcgcgtggcccaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatggtaaggccgggagggaagcgcaggccgcgcgctgggcacccgcctccgggactctgggcctcgggcgaagcgcaagaaggcgaggccgccagacctgacgcgcctgctgcttgaacttagacactccgcctctgggtgggacgggaagcagccgtcccagggacgttaattcctttccccaaattatactgcactcctgagacccaacacctctctctccctctcgctcgctccctgtggtctgatcccctgcgcacgctccagcaaacctcggcgtctaggctggcgtggaaaagtggtccaacagcgacctctgtcgctcgttatatcccgctgcgcgcagcaccaccagggcccactcagtccctcaggctctcagccacgccccacccagacttgtgggtgcgcggttcatcgcgggaggcaagcaagggaaacttgagttggcgaaggtttgctttggctggttgggggaggggcggggggccgacaacatccctgaagagctggagggcagccactgtgcttagcagcccagggtagaatggaggtttgcccctgtcgacgcgaacctgcctgaagtactggttgccaggccttgggttttggcgatgtcgttgcttgattggctggtttcactctggaggaatcgagggacattgccagaggaggtctacaggcttatgtaaaaagttaaaaagtctccaacctacgccacaggcctttcctgaattgaagcttgttctatggggcggaggggggggtgtaagggatggaggagggaagatgcctttcttttcaaatacatggaaaaaaacccctcagatttactgttcctctattttcctggctccgtagtaaataagtgcctagccttaggaggctattgacctttgataatgtgagcagataaagccccccccccccacagccctcggcccctaaccccctctttccggattaaagtgtaagaatacaaatgtaatatgggatggaggggggcgatttgggaccccggtcaaaaaaacaaaccgtattactaagaagaaaacaaaggtcttgcattggagtttccccgtgaatctgagagaaaatgatcgtttgttgaaatgaagcgtctaaagcgatccagtgcttcacgcccggacactgcactacaccgccagtcgccctgctgggccagttaaacgctcacttgtccgggattaaccccatggggttaaatgggggcaatgcagagataacgtcgcgtgatttctgtcatttagattgtgttaaattcttcttctgtttgataatcggtagtaaaaataaattattagaccgtagtatgtttgggatatggttaaaaatcaagagcagcgatgacttctggggagaatgctttgcgcgggctcagcctggctccggccagactagaggagctccccaatctcgcttcgcgcgggcggcggctcgcagtcgccaagccgaggctgacatttcttattgtgctgggagccagagagacgcaaaatgtctccttcccccagtccctaccccaggtttcctagacatggggaatgcattctgaggacaggtggagaagcctacggtaggatggggtcctcgtaggtgagcaggaaacggctaagagcagaggagttctgcttgcgccagtcacaagccgcgcaggcgcccctggtcgttcgcttttgataactagcacataaagaactagaaataatgaatgattgctttcttaaccattactttcaggcccgcattgttttagtgcacgtgaaaggctcttcccctacactcaatatgtctttttctactttttgaccgaaaagaaaaattgctgcctaaacacgtttaatgccattaattaagaaaaggcatgtaatgggaagaaatgctgaaaatcttgatttaattggcttttaaggaactagtagacgacaaaaaaaaaatcacacgagtgggcaaagctatagcactgctgaaggatagagcacctatccttccctgattttaagttaacttatggaatatccaaagtcctggccacagcctgcttgtaaaacaaaaggatttatttcttgtgtttttttaaagtttttctttgcttttaaagagaaaaaaagttcacaatgacatatgacttcttcaaaaggccgtgatagtctattacgctaccctctccgcctctgcccccaacgccgcccaaaaataccatgtcctcgttaaagactaaacgttctgtataggcagagtccacctctaagcagtccaggctctgccttccttccctagtgagtcccattctccttggtatccattgggcggatgcccagcctggatagaaccccgaaacgggggtagcacgagagcgactggagacccctaaaagccagaggtttgagagagggtggacgcagctagcagaagatggtgtagaagccagctgagaacgaccccctagagcaaagagacctttctttggcttttcttgctttgggggtcctgaaaggaactcataaaatggtcttcaccctcaggaggaggacggactgaccctcctctgtcactggcttaaaaagtttcagggcggcggctctgggttccgtgctgaaatcggactgcactgcagcccctttggacctgacgcctggctttgcgtcccgacaaggggcgggtacttcccccggcctcccccaggaacgcattaattgttaaatagctttggcccagtggatgggctgaaagtgttcgacccaagtcgctggtgtgcaaagacttcctccctctgggaggtgggctccatggcccgttgtggcacccccagccgcgacacacaccttcacacgcggcagcagctcggtcccaaccttcttcgaaggacctgggttaaccctggcggccttggcggccgcagacccctctccgccgccccgcccccgcgcctctcattcaatcagcgaatgtttgcggagcatatactacgtggactcctaatgtaccccctgaaagcaaataatacagttttcctcgccgtcatgaagggattttaatcctaacatggacaccagcgagatcagcccagaccgtctctagcaaaacgcaaaatggtggtgcgtggggtggtgaccaaggtcctgagccttgtcagaaagaaggggatgtgtagagaaaggtggagaactctagctgtggctagcgcggaagggacaggtgcttgccgaagggggcatgaggcttgaggaaaaagcaacgaaataggggtaaggagagttttccattttctttcctccgcccgacctccgccatcccattctcccctcccctcccccaccccccgcgccaatcaaatctgcagctcacttgaaaggtgccccgccgcgttgtggtttttcacccccaggggaaattgtaccagttgtccgaaagtagtcagtccctgcggatccctgcccgcaaaagtggtcttcacaggtcgcgttcctcgctgctgactcggtacacaaagtttcttaaggctggttcggctgttattcctcaccgcccgctgctaatatatgcagcagttgttagagcggctcgggggaaaaggaaatgtataacgaaagcttattcgtgagcaggaatatactaatggaacaatctgatgtcttcttaatcctatgtaaaaagctttgtcgtcttcctaatattgactgaatgggtaattaatggctcttcatctaggcgaataccctgtaatccaagataggcaaaagacaacaagcccaaggtagaagacaaaaggcccaactgcagcggcgtttgcccgcctcctaccccccagggtctctgactaggaaagttttctctcagaggagaaaaaggcaggagtgggagaatatatacctatcatttcggggctagacttcaccgcagcacctgaccacccagctcagttttctgttactctgtctttccacctccagtccttctccctgcatttttttttcttcttaactcctctaggatgacctcctaccaccaccgccattatggtcctaataacctttccccctaaaccccacatctttcacttcagcaaccaatgaggctgttttctgatccaggaggagattcttttcttttagaacccaatgcgtagagtctttgagaactaaagtagttggtaggggaggaagaaattaatagaaagggagagagcatacagaattgtgtgtgtatgttaaagagcgaccaggaatgacagagtcaacttctttgtgaggatctgacgggaagagtgtccaagactctaccagcatgtttttaacaggctgacattttaatttaaacctttagaagtaatatattacttgggttactacaatgaggtgggttcctttttttttgtcagctgacagcttttaaaatattatttcgctagggaaataaaagcttcatctcagattataggtgggtatttttggatttaggtgatttatggtcaccatgacaactaatgctgaatgttagctaccagcatgtctgggagagagaaaacagaaagaagggagagcaaaagaaatagaaaagggagatggacataagctggagagggaagaaaagagaaaaagaggaagacagatgagtgtttaatccaactgttgtttaaaaaagtggcgggggggtgggacttcatttagccccttgccacttccttctttcctgacctggatatctatgctcaatttcatattccacccttccttccccttctccaaacacatgtgctataccattctccttattttacttagttcggcaagtagttgctttctggagactcagtgacacctaggaaaactgtggcagtaacatgcaaatgtgaggaagcattaacagcatgttcgttgagtgattttagcaaatgccccctcctctaatctctttctcttctcttccccaggccactgtgaggtggtaactcccactgccatctgaacactgttcccccaggtagttaccccaaatctcaaatggttgagcagctagagctgtgggttggaaaaatgggtaccatttgcagggacccagagagggtggctgttgctcaatatatctacagacttccaattcagaaaataatcttccccttttgacaagccagagctttttaaattccatttaggaaatggggaaaaggacagctacagtgaagcttttaatttctgggttatttggttccatagctatgaggggtggtgggtagtggactgttttcagcttggtttgtatgcagagaaaagccagatattggagggggtggggcacttctcgggcaggatgcaaggtctccatctgacctctgcgccttaccaggagctcacacactcacgcccatcacgtggctccaagctgagtccaggcgggcctcgtccttgagctagcttgggcagggcaggactcccacccgtctaaggcctaacagctcagggagatgtctaattaagccatcttctgggtgaactctgaagacagactctttccaaaagtcagagatcacttggttgagtcccaggccagattgatacggagagtttggcggcacagcccaaccgctcactgccatggccagagggactttgcacaactaacactgaagagtgtgaaattaaataagactttaagactggtaatcggtggcaaataccagcacaaaacacggctgaccccatgtcacacatttccctcctctagggtctttctttgaaagaataagcaagaaaccccaatcgagacaacccctgatgtctcccagactcaaaacctcacgccggcactgggctttccttctttgccccacgtgagccatgcagcacctctagtttccctaccaggatcccaccaatgttctccgtattggaaatttctgtgttagaggctgaactcatagtaatttctaaaaccaattaagaagaacttagccagaggtcacagtaatgctggaatcacaaaatgcataagatttattttcttctggcccctttctcatccatgctgcctatgcctgtgcacccacaagtcttatgtacattaaatctccaaaatcaaccaccaccatgccacagagttttcactggacagtgtttcttagttcccaccacatacctccttttccccatgcagacttatcatgttggtgtcctgccacacagggggcctgagaagaatgtcacccaatcgccgctgctgtgagtgtgtaaagtgattaggagattaggagaatgttgaaactcctgctggaaaaatgcaaagaaaatcctcactttgagtcagttgtttacagagccagtgtgtgtgtgcgtgtgtgtgtctgtaatataaaatggatgtgaatatatatatacaaatagatatggttttgcttttactttaatctgaattatctagataattgtctttattcaccacttgacttcaatgggtccacacaaattaggacaccttatctttttaggcatctaggctgctgctgatccccagtgcttccaacatctcgcacacgttggcactatgaggagcagtcacgtgcccttgggtttttcaaccactttggaggctgattgaggtccttcatacatgtatatttgtcgtgatgaaagttccatcggtagagtggagccaccagagcttttatcaaaattctgtgggtttatgagagatgggtttagaaatctatatggctctgtggggcttctcggctttctaaaataaggcattaacacccaagcttccaaaaatatttgcagctctggggtttgaatcttgaaaaacaaggagtgaggggctgtgtatactaactacagtggagatttttttcattctttaatgtgatggagtcccttcatgaaatgaagctttaaggggcatggtattgtggggaccacagctattctgaggtttaaaagaagaaactggaatatgattagtaaacacattcagcagaaaagagctggattcttattgacttagttataggtcatcggctggcagtgcaatgggaggaaatatttactttacacatatactttatgatcttgggggaattagaggaaattcaataagaaaacggctagaaacatttaaaacccttatttaaaagacttaagcaaattagagtcttatcagattaaaaaccactacaaatgtaagagcattgtcttcagtgaaacgctgtggggtctgagaaggagattctccgccaaatctccgggataaaatgcgtcatttaagcaccagataatgagcagaatgtaaattaatttaaccttctttaccaacaggctgctagtgtaatgtgtataatttagtgataagattgcaggacctaatatagctggatgtatgagcctcagctaatgcagacctgtcacatgaggatgtgttttactctgagcaggtgtctgtatgtgtggaatggggtaaagtggaataaaaggttaaaagcagaaatgctgatttaaagcttactatgaagaaattcctcccttgcagctaaattattcttaaagtgggatgatactggtgaagaaagactgaaaaacaattctcatgtgcgtctttggactgcaagtttaaaatggggaggagttgcagatagggtttgggggtggtcagggcaaaggagagacacataagttgcaaatatatttgtagtctgcttcatccactttgttccacatcgaataagtttcccaatcttgtgaacaaggacaaggagggagtgttttaaagatacttcatgctggcattgcaaatcattgactgtaatgtcaaacaaatacacattcagagatgataacactaactccatagtaaaacaatcgcccatgcagaaacccagaggagattagtttgtcctctccagctgacctatgctgggggacaaaaggactttcaaaaattattttgaatatgtttggatttctttctttaatttctttggaaattaaatttgcttggaaacagtgctataaagagttgatgtctccaaaggtgattttttttgttttatataaataaggttttgcttttgctagttgagcgcagttctaggcttttcgcccttagctcacacacaccccttctgcctgcttggactttaatggctcaagacagccttgagctcaccgggaaaagaaaatgactgttaaaaattatccttgaaattggttatttggcaacattcttaattgtatggaaattcattaaggcatatttcatatataattagctcaaggttgttgattctacaggctttatggatttaaatctgattgataataaagtaaacaagagagtcgaatttaaagcgtggctctctcgggttaggacgagcttaatacagtgtacaaggaatttgaaagatctaggatatgtgtcttaatcaacgttaagtagaatggataagctttcagcattttgaaaacgctgggttagggtttctcttctattgtgtgttttctgtctggggactaataagcatcacagagaacgtgatctgaggcgactttttattcttgtataaatccagagtgaaccaccaaacagttgttcgtttaaagtcaaggtaattttcttttgacgggtccatttgcttctcgatttctaatttattagcctgccttttcagggctctgtcttctttgcaattaaagcttcttcagattagcgcagcattcacttgacaggctgtttggaaaatttaagatcggagaggtgatttgttgctgtttttcaaattttctagttttaagtaacgtgtctcctttttatatggggtgggggattggaaatggatgtagtgagacacaaagagtgggtgtcttgttgatccttgtacctttctcttcttgaccattccactctcttctcccaagccttcgactcctagcctcatctcttcacctttgggttcgtactaaaagccggatcgccttgggctgggcaggagctgaattcccgggagcttgcctgtgtagacccagtgcgcacggcgaggcagtagcccggccccgcactgctgataggtgcaggcaggacagtccctccaccgcggctcggggcgtcctgattggtgcggagccacgtcagtcgcacccggagaagggtctgggaggaggcggaggcggagagggctggggagggccgcggcggagtgacgtctcggcaccaggaagcccgcctctggttttaagatgttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtgggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcaggtaaggcgccgcgccgccctgcagacattcccgctcagctgctctgcgccacccgctccctctcgccccaaggaagtcagcccctccggggggaggcgtggtgggagtggtcgttcgcctggctccccgcagaacttccgggagccggaattttgactaccccgcatccctttagttctccctcgaccggcccggctcctggggcgctaagggcgcgagcaattctgccgccctctctattcgtaccctggcctcccttctgtttcctgggtcacaaaaatcccagcatcttgattcgaggaccttcagaggccgccgacctctgtccctgttttcctctcggctttcagctcccgaggagctccactcgttaggaaattgcctgaaaccactcagaaatgcccttcgcgaagaggcatttttttttttttttgggaaagggccggcgaacttcggtgcccaaccgaatccccacatcttttcctagccttcccaaaccgcatggaaatctgagctttctgcgagggggaggggggtctgtaaaccacgcgcgtgtgcgcgtcccaggagatttggtgtgtctgcgcagaggtgtataaatatacttgaaagcacaggctataaaagtgaatgtgccgctgcagtgagataaacatgtaaataaaacgtgcggcgctgggggaggggaggaaatggggcgcggacacccacacttgcgcctgcacaccccacaggcgcagcgctcctcgcggcccggagccgccgcgcgcaccctcctccggcgccaggcagcccagctcttccacggcttctgccgccggtccagttggcgtccgcgttgcaggtgggcatgctgacgggaaagtgtgtgtgtttcgttttcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtaggagccagcacggagtctgggagggatggggggaggatgttgtggaggtacaggccaagtagaccaggagagaatgtggaaggcagcgccgcctgggagggcgccggtggggcgcagctttgcaaaggcagaaggcctcgcggcggcctggttgcgagattacagttccctctccgaggccgacaggactgccgccctggctcaggctcccagagcggcaccggctcactgccccgccatcccgcgatctcacgagctgggctgcatgggcaatcccctgcacaggacattgtgttcctggcttgcagttgccagagcagagctaataaaatccctaccaggccaagagccgcgaacaggctccaacctgtgagcctttaacaaggaaaacccgccagagacacggaagagttggccctccctgggaaacctttgtcccggccctggcccagctttttccctcctgggctcgcgcttcttacaccttctttacggttgtttcggccattcaggtctctcccacacaccctatttcctagttttgtgatctccgggagcaaagttttaatacacaactactagtcctcttagaaggagaaagaaaaaaagaagaaagacttttctgcttggtttatttatcttctctcaggagttgaactctggaaattgaaactcacaccccctcttctaaattataatcatagttttgtaaaaagggcttaccttaactttgtagcaaatctgtactttatggattggcaaaaatgagctcaaataaataacccaatagcaacgtcctggtttatgctggtcggtggaagattccaaatttgttaggattctggaagcagaaaacagaatcaagcaaatcaagcggcatccagaggctttgctgttaaaaaaaaaaaattaagtgctctgggtagaaaaaataaagcccccggttagagcagagcaaacaaaaagaagaaaacaacgataaaaagaataaagaccaaaatgctctcccaaatcagagggaatgaagacactctctgggtggcatttgtgcaaggcatgaggctatgctggtggataaaaggccgggaagaagttgaaaatggttttagtttaactgtccagagccagagctgggtcctgggcggcgtggttttgagcaaggtcagtctttcattagctctcttgcacatcaagggaacgggcctctcacgtactcttctcgcctgagcaaagtttagatggcctagggtagaaatggcaagtaattaaagacagagtctatgggttttctgggatccttcgaaaacgccctcccaccccgcccgctattccgcagctccaccctagtgctttgtagccgcggcgctgggctctccttgcagctgcctctccttccagggcggctgcttgtcgagccaagtgggagtgaggcgtgctttttatagcagtcgggtgcaaagaggaagggggataaaaaggaaatcaagaatgaaaggaaaaagagaaaaagcggattacacggctgggcccggcggagatgtgtaatgtgaaacatcactggtgtcagctcggatatctcaggccaggcctctctccaatacacaaaagccgccgtctggggcgacagggaggcccgatgtggattgggatcggggttgcggctgggccaccggacacgggtggaagccggccggcctgggtggccgcctgcaaagccaaacgacccggctgggcctggcgcgcggacaggcctgtggtgggcttagggtaaagaagaggcagagcgaaagaagggggaatctccaaaactaccctttccgggttcccggagtttaatatgccaagctcctggagttaacgagctgacgaagaggtggtcttttgctctttatttggttgttttgctaggcgagaaagagtgttggcggcctagtccctgttaagggagcacgtaccagggggtgggggacgacagtggaggtcagggaaggaagggaggaattgcgtgggagaaagagcgatcctctagtgcccttccagccccttctcctcatccgtgggtctgtggctttggaatggaagcaagtttgcaaggtgccccgggaagggttggaaaagcctgctgccccgcgtttgttttacattaagtgtttttggacctggagaaacgcctggctgagtgatcaaaccgtccgcaggtctccatgcgttcggctgaggtttgtggcgtagctccgagtcccagctcgcaggccagagcagaccaggtctcctgcgcttggtggagacccgggccagtaactgaaagctggccctggtatcttggtgtgcagggcggtgcagtgaagcgaggccagggtgtgtgagtgcgctagcgtgtgtgtcgggggaaggcgggggttggcctccgatggaagttttagtaatctgcactgtggcatctgtttgctcccttgccccaaccgcccccaggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaattggtctggattctttctcccctcctctgtcactaacttggccaggacatctcagtcactgcttcctaaacaaaccagttccctctgcctgcctagttaaacatacaaggcagcagtccttatttaaatttggtagaaataaatgatagccattcatcagaaactaaaaagaaaaaaaaaggcattcccgggggggaaaagggctacaaaatctaattttgtctctccaatttttctttggcttaaacctagaggattccattatggctagcaaataatatgaaaaagaaaaaagaagaaagaaatttagcaagtccatcagcttaaaatgactctcaagtttactcctttacggggaaacctacacctctagcaaattgttctggagaaatatttgtgcatgtatacatgtatagtttatatgcatttctctcaggaggaatacatctataataaatttacagggaaacatctccagttcaaaatatttaggcttccacgtttatcttcaggcttaagtagagagatccttcatgttatattgcattactatttccaaatcctttggagacattaaaagaaacaaagatgatttctaataactacagcccttcagtttctcaaagaactcaggggttgagaggttagagtggagtttcctgagtcttgtcgagcaatatgtagttgaggcaaaggtcatgctcccggtgttttgttttaaataatattgacccattaattctaaacctgcttgttcctgaaattatacaggattatagtttgcaaactgcaggacaatgaagcaaatcaagatgaattacagccctggccctccctgccatcctctgacatctaaacagggaatgagttcggtgtgagtgtttaaatgaactttaagcacccgatccttctttatccgcgattttcagctttaaaaaaatgtgaaatttgatttcataacaaatagaaacaaataccacttagtcccagagaattcatcctcatggcgctaggagggtcgttgtggaggtggggggagggatgtgctgagatcttttgttatgcttgtcaaccccccgcacaaccaaagtgggcgagaacaaacaccacgctggggaacttagagcaaaaagtaaccgccgattttctggagccgacaatatcattgttttttcgccttagttgctttcatctgaatgaaactttacctagaagcttttggagctcgaacactgagtctttgttctgcaagaaactgctgctgccacttaaagagatcgcagataatgtccccgatttaagatcagtgctcaacgcacactttctttctttttaaagctctgcctccgacttgcggagggatcacgcagcagtggggggcagataaaagccctttggacgagggtcacctcccaccatgttgttcacttgagagcagtggagaggaaaacggtccccacgggcggactttggcttctggagccgcagggcccagcggtcccggcctctccgcctctcagcctggtagggggcggggagggccaaagggcggaggggaaggaaggagctagaagaggggatttggggatgggggctggaagcgctaacgagacctgcccggaggatttaggtctcctgcaggttggtgagtgatttgggagctctgggtagaagaggtgtacctcggcctagtttggttgctgaactagaacaacgcgaggacatcaatcaatctgcaggaaacaaaaaatggaagtcgaggtttaggaagagttgtcacttccccgacttgagtggtgcaggctgggggcggagacttgggacctaagagaggccatttctctcacctcagctcccttcccttggacttccaaaaggaataattttactctctcctccgttctccccacaactctcatccccgctagcccgcaggccgcctgcccctttccgcacctccttttcccatccagcgagagaaacctagctcccagagc

SEQ ID NO: 11798 - DNA, 13711 bp, Human
tggccgagcaggaactccagagcaggagcacacaaaggagggctttgatgcgcctccagccaggcccaggcctctcccctctcccctttctctctgggtcttcctttgccccactgagggcctcctgtgagcccgatttaacggaaactgtgggcggtgagaagttccttatgacacactaatcccaacctgctgaccggaccacgcctccagcggagggaacctctagagctccaggacattcaggtaccaggtagccccaaggaggagctgccgacctggcaggtaagtcaatacctggggcttgcctgggccagggagcccaggactggggtgaggactcaggggagcagggagaccacgtcccaagatgcctgtaaaactgaaaccacctggccattctccaggttgagccagaccaatttgatggcagatttagcaaataaaaatacaggacacccagttaaatgtgaatttcagatgaacagcaaatacttttttagtattaaaaaagttcacatttaggctcacgcctgtaatcccagcactttgggaggccgaggcaggcagatcacctgaggtcaggagttcgagaccagcctggccaacatggtgaaaccccatctctactaaaaataccaaaaattagccaggcgtgctggtgggcacctgtagttccagctactcaggaggctaaggcaggagaattgcttgaacctgggaggcagaggttgcagtgagctgagatcgcaccattgcactctagcctgggcgacaagaacaaaactccatctcaaaaaaaaaaaaaaaaaaaaagttcacatttaactgggcattctgtatttaattggtaatctgagatggcagggaacagcatcagcatggtgtgagggataggcattttttcattgtgtacagcttgtaaatcagtatttttaaaactcaaagttaatggcttgggcatatttagaaaagagttgccgcacggacttgaaccctgtattcctaaaatctaggatcttgttctgatggtctgcacaactggctgggggtgtccagccactgtccctcttgcctgggctccccagggcagttctgtcagcctctccatttccattcctgttccagcaaaacccaactgatagcacagcagcatttcagcctgtctacctctgtgcccacatacctggatgtctaccagccagaaaggtggcttagatttggttcctgtgggtggattatggcccccagaacttccctgtgcttgctgggggtgtggagtggaaagagcaggaaatgggggaccctccgatactctatgggggtcctccaagtctctttgtgcaagttagggtaataatcaatatggagctaagaaagagaaggggaactatgctttagaacaggacactgtgccaggagcattgcagaaattatatggttttcacgacagttctttttggtaggtactgttattatcctcagtttgcagatgaggaaactgagacccagaaaggttaaataacttgctagggtcacacaagtcataactgacaaagcctgattcaaacccaggtctccctaacctttaaggtttctatgacgccagctctcctagggagtttgtcttcagatgtcttggctctaggtgtcaaaaaaagacttggtgtcaggcaggcataggttcaagtcccaactctgtcacttaccaactgtgactaggtgattgaactgaccatggaacctggtcacatgcaggagcaggatggtgaagggttcttgaaggcacttaggcaggacatttaggcaggagagaaaacctggaaacagaagagctgtctccaaaaatacccactggggaagcaggttgtcatgtgggccatgaatgggacctgttctggtaaccaagcattgcttatgtgtccattacatttcataacacttccatcctactttacagggaacaaccaagactggggttaaatctcacagcctgcaagtggaagagaagaacttgaacccaggtccaacttttgcgccacagcaggctgcctcttggtcctgacaggaagtcacaacttgggtctgagtactgatccctggctattttttggctgtgttaccttggacaagtcacttattcctcctcccgtttcctcctatgtaaaatggaaataataatgttgaccctgggtctgagagagtggatttgaaagtacttagtgcatcacaaagcacagaacacacttccagtctcgtgattatgtacttatgtaactggtcatcacccatcttgagaatgaatgcattggggaaagggccatccactaggctgcgaagtttctgagggactccttcgggctggagaaggatggccacaggagggaggagagattgccttatcctgcagtgatcatgtcattgagaacagagccagattctttttttcctggcagggccaacttgttttaacatctaaggactgagctatttgtgtctgtgccctttgtccaagcagtgtttcccaaagtgtagcccaagaaccatctccctcagagccaccaggaagtgctttaaattgcaggttcctaggccacagcctgcacctgcagagtcagaatcatggaggttgggacccaggcacctgcgtttctaacaaatgcctcgggtgattctgatgcaattgaaagtttgagatccacagttctgagacaataacagaatggtttttctaacccctgcagccctgacttcctatcctagggaaggggccggctggagaggccaggacagagaaagcagatcccttctttttccaaggactctgtgtcttccataggcaacatgtcagaaggggtaagtaccctgtcctccagggctctcctccacccaccttccctctcttctctctcttccctctccctccctccttacttctctatcttatgctctgcccgggaatataggcacacacttctataacccctgtgtgggtcctgaccccacaaaaggaggaggcttaacaatgaccttgggcaaaagaactgaaggtctgagcaggcccatttccctggctggctcaggctgatgcggttggctgttcctctttttcctttctctgcccaggtgggcacgttccgcatggtacctgaagaggaacaggagctccgtgcccaactggagcagctcacaaccaaggaccatggacctgtctttggcccgtgcagccagctgccccgccacaccttgcagaaggtgaggtggctgacagtgcggagaggagcagcctagggaggcaacatgaggggaacatgactgcattctctctcctgtgaaaagggtccagcctcggcactccagatcatcctggacctgatagactggcctgttctaaggtccttcctggtggtcacggctatggcagcaactgggttgaccagacacccagccaggccagcccaacccaagactacagcccagagcctcggaactagggccctctaaactagactcaatatgagaagcattggtttggaaatggccccggggaacaaggatccaactgctgcccctgctagacaggcaagagacttgagttccagaaccagacctactttcagcttgctgtgtgaccttaggcagattgctttccatctctgggtcttgccttctgtatctatgaaagacggttggtggactagctcagaggtgatcagattgtgctctgtggaggctgacagagctgtcttagggctgctggggaggatgagaagtggctgagctgagcctgggcacccagcttccatctctgcttccttgggcatctcaagggaaaggtgctattagctccttcacactttactccccctcctttcccttccctcctcatgctgtccaaggagagagctgcctgaggcgcacggaggagttctcctgacccagcagaggggaggaatgtgaggctctgggcaggaggcaggctgccatctgccagagagccgtgtttttgaaaaaatcagaatcaagcctgggaggcagcagagtgaaatgatggaaagaggagtcccagctccactcctttctctctgggtgaccttgagcaagaatatcttcacctttatgagcctcagtctgctcatctgagagctggggataagaacacctaccatgatggtctgtggcaaagattaaaaaacacagtgcatttaaaggacttagcaggttgctaggcaaaggctcagtgagtgtaggcagtcatttttagaaacttttagactgttggccatattctgcaaatatgcgaattctctccacacacaacagtctcaggtgttgccagtgcagatgctgcccctggggcagaaaagcaaagctgcggctgcagacccctgggcccccttggctggtctagctctggcaggagactcatcacctgtgtgtcctgcccctcacccgcacctaagtttaacttcatgcacaccccaccctgttctaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggtgaggccagtgcttggagggacggccctgggaagacgggaggccatgaggatgctatccgctctcatcctggcactgaacaggcctgcttccatactgtgggcaagtcagtttctctgagcctccacatccttacctgtaaaatgggtcagctctgataatgagcgaacgaatgaatgaatgaagtgtgtcaggagcagatttctggaggtctgagtcctctcaactctctcccagtcttgggattcaatgagtaaaacttgggtaccccatttgggtgacgaggggaggaatttcccctccagacccccaccatgagaacctaagctttggctctggaatgctgcaggaaggtggatagtgcctctctcagggcagttacctaagcctcatgtgcagtggaactgaagatggtgtcagacctgggaatgaaccccggggacagaaccgctctggcactgctggctggatgaagacaggatgcctcaagaaatcatcggccggttgcggtggctcacgcctgtaatcccagcactttgcgaggccaaggcgggcagatcatctgaagtcgggggtttgagaccagcctgaccaacgtggagaaaccccatctctactaaaaatacaaaactagccgggcgtggtggcgcatgcctgtaatctcagctactggggaggctgaagcaggagaatcgcttgaacgcaggaggcagaggttgcggtgagctgagatcgtgccattgcactccagcctgggcaacaagagcaaaactctatctcaaaaaagaaagaaagaaaaaaaaaaagggggtggttccctcaagaaatcgaatcttgggcactggtggacggaaatggggtctgagtgggccctctgcaggctaatgattttccttttcctacttcttccttctccaaatggtaattcagggccatgctgtgccaagaactgttttaggccaagggatgcagtggagacaaaacagacaagttccctgccctggtggaactcatattctaatggtggaaacaatacatccaataaataaagtaaaattatatagggttaaataatggtaaggaataaggaaagaaattaaggaggtggatataaagtcttgaggggctgaagttttagataaagtggccagggaagtcccagtgcaaagggaattttgaagaaaaacccgaaggaaatgagatatctgtggggaagagcagccagggcagaggcaacagcaaagacaaaggccaggggttgggaggtgcccagagtgttccagagcagtgagcaagttgatgtggcagtctcttggcagaggtgcccaggtcctctaggggctcaaatttggtggtgcaggccacagaggtggggaactgctcaggatgggtaaggatggtgtttgtggaccgtagaggtgctgctggaatcaggagctctgtgtcctgcttggggtttggattttacttgggagcttctcctcagccctgtgcacacctcaccactcagcttatcctgtgcccagctgaaaaatctgtgtcttgtccccatggggaagaaaataacaagtaatgattatcctcatatttaagactatgcctcatgtttgcccaagcttatgatgatgtttacaccttgaatctcatttgattgccacaacaatttggtgagataggccactatctagactatctagaatagataggtcaatatcgagatcccattttttggagaggaaacatggggctcggataggttgagtagccagctcggtcacacataggacctggcaggaggccaggtctctgagtcccactaggagggatggggtagggatgggatggctccctgagggggttcctctgctctccttcctccaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgaggttagtgggggctcgcctggctcccaccctgtgggctgggttccctccctcaaccctggcctctactgggccctcattcctggttctccaggaggcaaggtctgtagagggggaaaggtgggcagccacctgccacctagccctttccaggcagggagagaattcctaggatgtgccagggcagctggaaaacccagtagctttgcaggtggagcttgatggtcaataatacatggctcttcctgggtatccctgccaagtgccaagtgggggtaacagctgtgtgccatgagctgggggctgccctgccacatgctaaatgctgagagcaacagagagaacagggattagtggactataggctggaagagattctggaaagcacaggttccaatctatttaggagcccgagttctttgtgctcatatgtacgcaattttgcttgtctgagccgttaagggggctgccccaagttggggaattagggtttgtcttgggagaactttggcatgcgccactgagcctgaaaaagattcctttaatttaaaaaaaaaaactgctacaaacttattttattttatttatttatttttgagatggagtctcgctctggtcacccaggctggagtgcagtggcatgatcttagctcactgcaacctccgcctcctgggttcgagcgatcctcaagcctcagccttccaagtagctgggattacagacgcacgccaccatgcccagctaatgtttgtatttttagtagagacggggtttcaccatgttggccaggctagtctcaaactcctgagctcaagtgatccgcccacctcggcctcccaaagtgctgggattacaggcatgagacaccgcacctggcccaaactaattttagataatgctatctagttgtgccaacacaatttattaaaaagtccatcttttttcaatgacttgaaatgccatctttatcatgttttatattttcgtatgtgcttggtctatttctggactttctattctgttccattggtctctttatctattcatactccaatatcatactgtttcgatgatagagattttgtggcatgtttaatctgttagggctagttttgtccttagtgatctgctttttggggggcttttctagctacttttgcatgtttatttccccctatgatcttcagaattaatttgtctagctttaggagaaatattaggagtatgttttggggataatattaaacataaataacaagcttggggagagctggcttctttcagaatgtcacattcctggccagttgtcctatccacaaatgtgagatgccttctgttttcttcaagcctacttttgagttttcaggagtgttttaaagatttcttcataagctatgactgtgctactgcacttcatctggggggacagagagagactctgcttctgaaaaataaaaaggttttaaaaattttttcctcacaacgttgtgcacatttttcattaaatttgtcttaggtattaattttgttgtcattgctaaaaatggggctctttcttccattatatcttctagttggttattgtttgtataaatgaaggttattgtttttgttttttaattgtatatccccctattttactgaactcttttaaaatttatgttagttttataatggattctctggggttttctaagtatactataatactatctgtaagtagaggagatagtttttcttctccctttccacttcttatgcccctgatttttttttttttaacaaattgattgcattggttagtactttcaatatagaattaaatggtggcagagatggtgaagtctttatctaattcctgatcttagtaaggatgcctctagggttttcccatcaaataagacactggctgtaggactgaaatgcacacctgcctatctgtgtgtattaaggaagagacttaaatatatgttttttcttattacgtaagtgatatctactcattttagaaaatacaaaaaattggctgggcgcagtggctcatgcctgtaatcccagcactttgggaggccaaggtgggtggattgcctgaagtcaggagttcgagtccagcctggccaacatggtgaaaccctgtctgtctctactaaaaatacaaaaattagccaggcatggtggcaggcacctgtaatcccagctacttgggagactgaggcaggggaatcgcttgaacctgtgaggcagaggttgcagtgagccaagatcgcaccactgcactccagcctgggtgacagagcaagactccatctcaaaaaaaaaattacaaacaaatttaaaatcatttgcaattctactacctagagagctctactattgacatccttccaatcttttcatacatgtatgcacgcacaatacacacacacacacacgcgcacacacacacacatttttctttttttttttttttttgagacacagttttgctcttgtcgcctaggttggagagcagtggcgtgatctcggctcactgcaacctctgcctctcaagttcaagtgattctcctgcctcagcctcccaaagtagctgggattacaggtgcctgccaccatgctcagctgatttttttgtatttttagttgagatggggtttcaccatgttggccaggctggtcttgaattcttgacctcaggtgatccacctgcctcggtctcccaaagtgctgggattataggcgtgagccaccgcacccagcccacacatttttcttacaataatgggattatattctacaataatatatcatgcacattttcctgtattattagtcttctgtattgtttttaattgttccagagtattccatggcataaatgtaccataatttcaccagttcccattgttggacatttaggttgtctccaatgttcccactattgcaagagtactgggataaaccttctggcctctaagcatggatgtgacatttgaacttgttttcttggtatacattcacagaagtggaatgtccgagatcaaagcctgcagcaaattaccccagtgaagaatgtaccaattagctctcccctcaggacctcaagccttaattattgttgcgggttagatcttacagcctgttctctctgtgcccaagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggtgaggcttagagttctgtcgcacggcagcctcccacagctggggaggctgagaggctgggcctcctttcatggtgcttgcagggaactgagaagttggaccacctcgcgccataaagagcagtgacagccacagtcccaaccataagcacctgcatagtgattgacagtttgccaagtattccctttcattcttccatcgactccttgagagcattctctccctccttccctgcttcatttttcaaacctggaaacgaaggctcagagatttaagagacatctcgaggtcacacagcaataaagcggcagaggccagacttgaacctgcatcttctgacctggaatcccatgttgtctgtccacatatgtcgcactgcctctctttgaatgtggattcaccccgagaaagggattatcactaaccctctgataactcactcctatatgtgctgacatgtcaggagtcctttcttagagccatcttagatctgctctgtgtattgggaaaggaggggtgggaggtggaggttgtgggaggggctgatggacaatgagggatgataatactgttcctgtcgtttgtaatagtttgcagtcccttcggcaggcaagtgggtttgaaaaaactcaccaaaaggtcaagcaaggctactttcatttcttttcctaattcccagtttaatttgcatcagcagggagagggttgggtcttatgaatcttggggcttcctccgtgcagtctgggccacagtgagccagggatccctagttgctggcctggaaataggaccttcagtgggcccttctccagggcagccctgtgatgctggacaagtctgttctatgccatgaggagaggcagcagggaatgagtgggagcctctgaggtcactggggccatggggaacggggtatctctctgtcaccgcaggattccttcccagcccggttcaaagccatccacttcatccaccagccatggtacttcaccacgacctacaatgtggtcaagcccttcttgaagagcaagctgcttgagagggtgagtacgtgggccgcccagacaatgagacaagagggctgagggtggggcctcacctgagccctcctcacactctaccatggtcctgagctatgtggatcccactgacacccaacatggagacctgcggagagaggtgtcgccaggcaaagactgcacatgatggggctttgtcctcctgcccctttcctccctcaaccctcatccttagggcacctcctcctgctcagttctgtctcccttgcttccctgcaggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatggggaataaaggagggggaattcccttgaacaagaagaactggggatagttatatttccacctgcccttgaagctttaagacagtgatttttgtgtaaggttgtatttcaaagactcgaattcattttctcagtcatttcctttgtaacagagttttacgacttagagtctgtgaaaacaggcaaggagcccgggttaaaatatccccctattcgcccccaaaatgcaataaaagaagataaaagagagaggatatatgttcaaatgatttggcaaacgcagcagtcctggtggcctctaggcaggctgggagttttccacacagaattccagggtggaagaggcctggaagtggcttcattcaggggtggcctcctccccttgctgaggtgcagtctgacgtgtgtggggtggtcaggaacttggacctctttccagggtggcagtcatgttccctccatctgtctgggagaaggagtctttccaccaaaagctgtctcctccagtccccttgcctggatggacagttctacttcgaattataagtggcatcttctctgagcactcactcagtcctcaagttatagagttaaagctctttttttgtcttcactctcaggcattttacggtgatgaacttacactttccaaatctgcattttttttttttttttttttgagacagggtctcacttgtcacccaggctggagtgcagtggtgcaatcacagttcactgcaacctcaaactcctgggctcaagcaagcctcctgcctcagcctactgagtagctgggactacaggcgcataccactgcacccagctaatatttacatattttttgtagaggtaagtgtctggctctattgcccaggctggtctccaactcctggcttcaagccatccttccacctcagcctctcaaggtgctgggattatagttgtgagccaccatgcctggcccaaatctgcatattttgacaaatacaaatgctttccttctgtggagttggctttcctcaagtgcttggtgattttcaggtgtgtgctcatttctgtaggtgagaatccctgttagatgccctgtttgctgagcatgctgttccctcttgggtaagtgctggcttcttctgggcatgggtctcctgagcattgacagatactttttccaagatgctacactcattttcccacatggaagcagacgctggctggctagtggcagtaggcgaggcttgttgttcccaccaaggcatcccagtcaatcaacccaagacttgtctgctcttgcctgtagggtcacccccattctttgtgggtatcaagcacccttagtgctgcacctaccttttgggccaggatattccaaccgttttctggactttggattcaattcagtcctatctgctttcacacctttgggaatttctctgatccactgagagttctctttcttgcttttcagtgaggctgtgtacatgttcatgtatatgtcaatgtatacatatgtgtgtgtgtgggtgtatatatatatatatttataaatagatatatatatgcacttatttcttacatactttcttctctcactcctagggtttgtagtgtatgctcattacccaagaaacttccttctttataacattcacagtcaacaagccatggtcataaaatccatgaaaacaaaaatggtatttacataggactcctaggctggaggaggaatcacagcaaattattatgggcagaagggtaggagatcaaccagtgaggattttgtcccaaaagttgaggcttcatttttgcaaatgaaatctcacatggaaccttggtatttaaacctaaaaagggcaggcatgtggctcatgcctataatctcagcactttgggaggccgaggcaggaggattgcttgaacgtgggagtttgagaccaacctgggcaacatggtgaaacccacctctacaaaaaatacacaaattagttgggcatggtggtgcacgcctgtagtccccacta

SEQ ID NO: 11799 - DNA, 39552 bp, Human
  misc_feature (1)...(39552): n = A,T,C or G
aaacaatcttgaaaaataacaaagttggaggacccatacttctctatgtcaaaacttactaagctacactaatcaactcagggtgttcaggcatagagacagacatatagatgaacagaactgagagtctggaaatctaatcaactgattttcttttttttgttttgttttacatttagagacggggtctcactctgtcacccaggctggagttcaccctggagtgtaatcatggctcaaggcaaacttgaactcctgggctcaactcccacctcagcctcccaaagtgctgggatttcagatgtgagccaccacgcccagcctacaatcagttgatttttcaacaaagattccatgataatccaatgaagcaaagaatagtctttttagcatgtggtgctggaataaatagaccaggcaatggtttctaatataacactaaaagtacaagtaacaacaacaacaaaacaactggacttcataaaaattaaaaacttctgtgcttttcaagggacactatcaagaaagtgacatgaaagcccacagaatgggagaaaatacttgcaaatcacctatccagtatatatcaggaattcttacaactaaacaataaaaagacaaccaaatttaattataggcaaagaatctgaacagacattactccaaataagacatgcagatgtccaataagcacatgaaaataccctcaacaaaattagccatcagggaaatgcaaaaaaaaaaaaaaaatgcaatgagataacaacttgacactcagtaggaaggccatcatcagaaaggcagaccatcacaaggcttgatgagatgtggaaaaattggaaccctcgtaacattgctggtgggaatgtaaaatggagtaactactttggaaaacagtttggcagttcctcaaatagttaaatgtagacttaccatatgcccagtggagcaattccactcctggatatatatcagagagaattgaaaacatgtttttataaaaacttgtacacaaatgtccatagcatcactattcataatagtccaaaagtgaaaacaaatctctgtcaattcatgatcagataaacaaaatgggctttatggaagttactattcagccataaaaaggaacgatgtactgagacatactacaacatggataaaccttgaaaacactatgttaagtgaaagaagctagacacaaaagtcccatatcgtatagctccatttatatgaaatgccctgaataggcaaatccatagacacggaaagtaggtgagtggttgccagagactgaggacagagagggaggggccatgcgcagttattgctagtggagatgtggtttattttgggggtgatgaaaatgctctggaatgagacattggtgatggttgcataattctgtgaatataccgaaaatccacttaattatatactttaataacggtaaattttggctgggctcagtggctcacacctgtaatcccagcactttgggaggccaagatgggtggatcacctgaggtcaggagttcgagaccagcctggccaacatgatgaaaccccgtgtccctactaaaaatacaaaaaattagctgggtgtggtggtgggcacctgtaatcccagctactctaaaggctgaggcaggagaattacttgaacccaggaggcagaggttgaagtgagccgggatcacaccactgcaccccagcctgggtaacgagcaaaactccgtctcaaaaaaaaaaaaaaaaaaaaaagttttatggtatgtgaattatatctcgacaaagctgttatttaaaaattgtatagttttaatacttacatttaacaaattaaagcttttaccatgcctaaaaatttgagcctctttcccctcaccagacggagaaaggctctggcaatggaaacacacattcctgcctattaaagcatcagaaaagattgaaataagcttaattgtggttcacagattctgccagtgtttttctgcctaggctgcattttctcctttatcctttcaggttttcatcaggctgtgtaagatagctggcaggatctgtgcgaaaagtatcaaaatcataccacttttcagggcccagatcaaacctacaggtattgtgggggtacaacagaagatattgactagtgtaaggcaactctctctctatatataaggcacacctttggtaagtcgctgaactgcatacgaataacaacagcaccagtaacaaacaaaccctgagcctgagcacctccgtgtgaggtgggcaccgtgcaaggatgctgggaacctgcctctgcccttaaccagtgaactgtctagtggggaaagcagacatcgtggaattgtgtggactttaaggaaagagaatgaacgggtgctatagtatacaataggtagacctgacacctcatttgggggctccagaaggcttcctgtggtgacacctacctgagacctaaacgatgagaccacagaaacagtctaaggtggtagagatacagagagatggaggattatcgagactaaagaggcattttagagtttacatttataatatattaaagaaaggaagggccaggagtggtggctcatgcccataatcccagcacttttgggaggctgaggtgggggtggatcacgaggtcaggagttcaagaacagcctgacaaacatggtaaaaccccgtctgtactaaaaataaaaaaattagccaggcatggtggcgtgcacctgtaatcccagctactcaggaggctgaggcagaaaaattgcttgaacccaggaggtggaggttgcagtaagccaagatcacgccatgcactccagcctgggcaacagagggaggctccgtctcaaaaaaaaaaaaaaaaagtaagaaaagaaaggttgtcttttatatgagagaaagaaacttgcattttgtttaaaccactattaccgtgggactttgaagcagcagggcttacatctataatactacagacatcttacgaaggagcctaatattgacctctaactcaaacccaaagacagaaaaatcagatcagggaaagcaaccctgatgggtgtggaagtgagaatactggtctgttaccacaggtatgtattgctgtatcttctgttcttcactgaagtaatgtattgccagtcttgaaaaatgttagtgctgggcgtggtagctcatgcctgtattcccagcactttgggagaccaaggtgggcaggcagatcacctgaggtcaggagtttaagacaagcctggccaacatggtgaaactccctccctactaaaaatacaaaaacaaaaataattagccagccatggtggcatgcacctgtagtcccagctactcaggaggctgaggtgggaggattgcttgagcctcagaggtcgaggctgcagtgagccatgactgcaccattgcactccaggctgggtgcagagtgagcccctgtctcaaaaaaaaaaaaaaaaaaaaaaaaaaattgttttcaagagtgtagtacagaagggggagaaattctttctccgacaatctctgtagtttaaatgctttttgcagtgcatcctgccccacaaattggtgttttgtcacagttttatgttgccctgaattgctgtgtacctcttctacacccgaaatcctctttcttcccattgacatcataaactctgagatatgtggggagaaattatggtttgatatccatccccaaaaagcctagcagtgttctgagcatagacaagcactcattcaatattcattccattcagtgggcagtctccctcccttaatgaaaagaacctggcagaggctgtgacaggcctgaccactgaacaatcaccaaataaggcagaggtgatggtcacttagagacaaaggtccattgcattttagagataactggacagcaaaggcaacagcagcacattatgtactctgctgtcatgaggacttaccatccagttaggccattttccttctggcatgttttccatccaggatgtgataacctcatacacgctgttcccagaaacagtgtctagcatgctgaggtaattgttgaagggaaaatcagcttcttggataaatggcaatccatagtacatcacggtcctgtcaatactctctgcataggcttcagtccccatgaacctataagagttgacaaggttcagtgtcatcggggcctgtcagaagactgggaaggcactccacagctgcttatcttgcatgtacaagatgtaggggctgaatgcacactattaaccatataggactagcaccttctagaaagcataatcaagctgtcaccaaatgttagactggattaagaaaatgtggcacatacacaccatggaatactatgcagccataaaaaaggatgagtccatgtcctttgcagggacatggatgaagctggaaaccatcattctaagcaaactatcacaaggacagaaaaccaaacaccgcatgttctcactcataggtgggagttgaataacgagaacacatggacacagggcagggaacatcacacaccggggcctgtcagtgggtggggggctaagggaaggatagcattaggagaaatacctaatgtaaatgacaagttgatgggtgcagcaaaccaacatggcacatgtatacctatgtaacaaacctgcatgttgtacacatgtaccccagaactaaaagtataataataaaaaataaggcagaaaaatccaccccccccaaaaaaaatgaaacacatttgggtgccaggtgcagtggctcacacctgtaatcccaacactttgggaggccgaggcaggtggataacttgaggtcaggagtttgagaccagcctggccaacgtggagaaacatctctaccaaatatacaaaaattaggtgtggtgatatgcgcctgtaatcccagctactcggaaggccaaggcaggagaatcacttgaatttgggaggtgaaggttgcagtgagatgagatcatgccaccacactccagcctggacaacaaagtgagaatgtctttaaaaaaaaaaaaaaaaaaattggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacctcccggtgcaagtgattctcctgcctcagcctcccggtagctaggattacaggcacccgccaccacgcccagctaatttttttgtgtttttagtagacacagggtttcaccatgttggccaggctggtctcaaactcctgacctctgatgatgtgcctgccttggcctcccaaactattgggattacaggcatgagccaccgcaccaagcctgttcttttctttctaaacctagaatcctaggagaaataatctcctagaatcaaaattcagtaacatcctgacactaaaactcgttgacatccatgaagactttctttagcaattctcatcactccatttagaatctaaagtttatgtctgcaaattaggtggggtattttcttcaaaagaacttcccccttgtattggagtccctataacatcttgccttattattggtgtgcactctcaattgctgaaagcaaaaccctgggggaagacacattcacctgaaatgactccgatcaatgctggctttagctatttgaggcagcatatttatggataagtgcatggtctctggagcccaactgcttcagttcaaatcccatagctgccactcctacctgtggacattacttacatgctcagagcctcagtttccttgtctataaaatggagacagagtaatcggagtacctactttaaggagatgaaatttctttaattccttcctattgattctgttgagtgatctatgtaaacttaatgatgggtaattttattgagtgtttactatgatccaggcactactttatatacattatctaatttaatctcacaacagccttatagaggttattgctatcacttttttattgatgagacaactgagacttatgttaattaactggccctaggtcacacagctacagagcaggactccttcagacctacctgattccaaagctgtgttcctgatactttagctgaaacatatggatttatatactgtactaggaaactatagatccaataacaatgataaaaataatactgcagagaaggagctggtatttttatttttttcttgagatggagtattgctctgttgcccagactggagcacagtggcatgatctcagctcactgcaacctccacctccccggttcaagcaattctcctgcctcagcctcccgagtagctggtattacaggcatgtgccaccttgcccatttttgtagttctagtagaggaggggtttcgccatgttgcccaggctggtctcgaacaccgtcaggtgatccaccagcctcgacctcacacagtgctgggattacaggcatgagctaccgcacccagctggagctggttttgtttttttggttcttttttttttttttttttgtgatggagtctcgctctgtcgcccaggctggagtgcagtggtgcaatcttgactcgctgcaacctctgcttcccgggttcaagtgattctcctgcctcagcctcccaagtagctgggattacaggcacccaccaccacacccagctaatttttgtatttttagtagagatggggtttcaccatgttggccaggctggtctcaaactcctgacctcgtgatccgcctgccttggcctcctacagtgctgggtttacaggcgtgagccactgtgcccggcctggaactggtttttgaaaaagaaaaaataatagctcatggctaacatttagctaatataatctctttttcattaacctaattttcacaaaactcctgtgaagtacgtagtgtgatctgcatcattttacaaaagaggaaactgaaagtcagcaaaataagcaaacaggaaaggaatatggcaggccctggtacaaccaaactgtaatcaattagagttatgcaggcttgttacattattacttgaacctccaaatacacttggttgtgagggatacactgcagatcacacactaagcctgggaagaaatgagagcatatgccgtggtcaacctgtatctgccgggctccgtgctgtattggtccatggtctgccggaagctgcggacaatgtcgtgcattcccacctgcgtggtggtgaagtcatggtacagctccgagtattgtgtgaccgtgtcctttgaaaaccaggacgacatggttaccctcatttcatacattgcatgcccacagctcgctctatatgaatgtagacaacctcttcaaagggctcaagccaagcgagacgcacactcaaacatggttttgtggatggagaagaatgcttcatttgatgctcaagttgttaactttataaatctactaagcaatatttctctaataaactgtcacccattttagcaaataaattttaccaagcaaaacactgattacaaagttctcaacacgtaattgtcaaaatgtttcagacccttttaaaaacaaaaaaaaagatcttagtggttatagagctcattattacatgtatactttatctgctcacaaaactattaacatcatgcacttaaatttgtttctttaccatcactatcctttctcctaactgttatactttctcggggtttcagtaaatttttcctagtttctgtatctttgtaggatttctatgtcagtgtctcatttctatgtctttctaggatgacaataatctcctagaatcaaaacaaaaaattacatctcatccaagccaaggcctcctcacttgagcctatgtcagatgataaaattgcaggagtaaatgtcctctattttgtggcccttggtagagcccacactgtccatgtcttcagaacccttgtcactgaaggactcctcaagggatccctcgctctggagggaaccagtggaaaaaaacatcgagtgcatatgcatttcaaactcttgcacatttcctaaagaaataaatcagggtacttgctagacacaggacaaaactcatctttgtaactggtatctcaggctgagaaagaaaacactctgatgacattttcagaaaaggcaaaagaaaaacgtttaaaataaaactttaccgggatttgggtcttatttacttggatctcatctctcaggtgctttgcttctaggaggaatttaacagcatccaaactaaaaccatcaacaccctttgtgagccagaaccgtaaaatttcctaaagatgaagaagcaaaatgcttggttacattaactacgttattatcacaacgtttaatcaaagttttgactgttaacaacttggcatcataaaacagatatctacatacagaacaagcacagtattcacagtctatttttatctatttagcataactgtcttactaaaatgcactctaactgcatttagcgactcccacacctccttcatatgtgaattcagaattacaattagttacatttgtaatggatgttataaggatgttttcaaagtttagagagtctactaaaaatgaaagaatgaaaccataagaaaagataggactcagaataaactaggaaagtttctcatctccctcatgcccaactccttaactgtcactgcaaactcaaagaaaataacacattgttcaatagttaaatatttcactccttactaggaaggcagatgagaggtgaagtgcttagatattaaaggatctcctgctaggagtaatatggaaggaacacacagaaaaaaaatagaatcaaccatcaaccaagtaaataactaagaatagtgacgatcctgtggtaaaactcagatactagtgttgtcttgaatacactcagataataaaagatgaaatgggctgggcacagtggctcatgcctgtaatcccagcactctgggaggccgaggcaggcggatcacctgaggtcaggagtttgacaccagcctggccaacatgatgaaaccctgtctctactaaaaatacaaaaagtagccaggcatggtggcgggtgcccataatcccagctactcgggaggccgaggcaggagaatcacttgaacccgggaggtggaagttgtggtgagccgagattgggccattgcactccagcctgggcaacaagagcaaaactctgtcttttaaaaaaaaaaaaaaaaaaaaaaggaatctacattattccactggctttaatttcacaaataaattgatcccaaacacaaatggttaagctaaaaatccaggttctcatacatttaattttattctttggtgacagactttcttccaaaggtgtgtgctagaaacccaattattgtatgactgtccctggctcactctcctctcctgccctactcttccaacacaccttgctagagagaaggtagtcattgcctgctcagcctctcccctgcctcacctgctcctgagagcatcatcgtgggctgccttgttcccaggcatttttaatgctgaagccaaagattagagagatgaagactggtgcaaataagtggttagtccgggcgcagcggctcacgcctataatcccagcactttgggaggccgaggcaagtggatcacttgaggccaggagtttgtgaccagcctggccaacatggtaaaaccccgcctctactaaacatacaaaaattagttgggcatggagccatgcacctgtagtcccagctacttgggaggctgagcatgagaattgcttgaacctaaaaatcggaggttgcagtgagccaagatcatgccactgcactccagcctgggtggcagaaggagatcctgtttcaagaaaaaaaaaggcagtggcagggataggggggtggccagtgtggccagaggagcataagtaagagtaggaggaggtaaagaaaactaactcatcatgctcagctttgtagttaacaggaaagatctgggatttttgtgagggtgatgggaaacccctggagggatttttaatcagaaaaggctgtgggctgacttaacattttttttaaagatctgatgtatgaagaatcaactgtatagtatggcatttcctcaaaaggttaaacatcaagttaccataagacccagcaatttcacgcataggtatatacccgagagaaatgaaaacttatgtccacgcaaaaacttgttcacaaatattcatagcagcattattcataatagccagaaagtggaaacaacccaatggtctatccatacgatgaatatttggccatggaaaggaacaatgtgctgacacatgctacgacatggatgaaccttgaaaagatttttctagccaggtgtgacggctcacacctgtaatctcagcaatttaggaggctgaggtgggaggatcgcttgagcccaggagttctagaccagccgggcaacatgacaaaaccctgtctctacaaaaaatgaaaaattagctgcgtgtggtggtacatgtctgtaggcctctgaaacagcacctggtacttagtgaacaaattgtagcatgaaagaatgacatattgagcctgaatgaccaaacattacagaagtacagcatgttccctggcttcaggtctacagaacagttggggacatgtgggacaagggatggttacctaataatgcaggtcctcatgagaggagacacctctgcctacagggctgcaagagcttcaagacatttcaaaatatgtgggtgggcacagcaggagaaggaagagctagagcttgaacttgacctagatgacctggtgggatttcaatggagggtgggaatgggacaacatgagccaagtgtggaggcagaggctggcctgtactgggacaggtgggaggaccaggtgaccgtgaaaagcagaggtcctgagcctcagctacctgcctcaaccccacagccagcctctcccagcaaggcctgctccggctccggcacctgctcacaagctctgcaaaggaacagtggctctccctacttttctcatcccttgctgtatggaaggtttcacaggaatgtatatatcattttagagcagaaccatctgtaaagtactaaacagccaattttcacctatggagggaaacagagccacagatcccaaatgacaactatcccacagttcacttgtgtattagagtttgttctcatgctgctaatagagacatatctaagactgggtaatttgtaaagctgtttaattgactcacagtttcacagggctggggaggcctcacaatcatggcagaaggcgaatgaggagcaaagtcacatcttacatgacagcaggcgagagagtttgtgcagaagaactcccacttataaaaccatcagaactcactatcacgagaacaggatggaggaaaccacacccatgattcaattatctccacctgctccaccccacaacacatggggattatgagaattacaattcaagatgagactggggtgaggacacagccaaaccatatcaacttgtttgacttgaagtgcgtttctatctgcacgtgaatatggaggtttcaagtcaagtcaagggtctcaacagctaaatgcaagggttaatactgctcctgtcaattcactttaagctgagattttgaatggtgaagcttgaatcaattttttatgcctaagagcaagttctggggtgaataactcttatcatgggcacaggtgacccaaataacctccagtaatctctacccagtggaatttttctctggggcataaaaaacaaatttgttcttactagtgcctttatcttttaccaaattcattcattcaataagtatttgaactcctagtgtataccaggcacttaggcaagccctggaactacaaccacaagaaaaatacaacagacacagtcctaggtctcccggattattttagaatctccagctagacaaatagcaacacaaaaatatttaaatcacagctgagacaaaggagagaaacatggtaatacaagagggtaaaacagcaattcaccctggggagggtttgcagctggcaaacaggaagtgacagccattcatcagagaatgggctagagaagtctggtggggcaaagaaaggcacctcatttctagaacaggttttcagtggcttcaggagtgaccttactatgaagctaaccaaacttaagcttcaagacctctcacttgcactcatctaactccccttctttgctcattttaagtaaataccaacttttctgtacttaattttgtgctctattttaagaaggccctaatttactatcagcttcagaccccgcgcaacctgggtccacacccaggtggtgctgttctttaaaagtgtgaacattggttggggcagagcacgaataactgaaggcatccaagcggcctctgacaaaaatgtgggaaaacattaagcaccattctgtgtaaacatcaagcttttgggcactgatttcctaaaataaagccagtccttttctttacggagtccggatctcagcattgtgaaatgttgacctgacattaaacatgagaaacttgtaccgcacagaaggtttatggccctagcataatcagaaataatatcattgtttaatgagacaaaacagtaaaagcttgatggacattttctgaaagtcattttaaatgctgataattcagattatcaccaagataatccaaagtttgctcttgaaaaatatttgcttcatgctatttattctctcaaccaggagggaaaagagagcttcagattttaattgttaaccctctttactcccatgaaggtctctcagggttccagatgcaaaaatgggcacagagcctgggtcagctaggtctagtgacccatgtaggtgccgtggactctgggaactggactatacactacgtccttgactcctgtctgactcccatgacatcacgcactcctggtttttccactgggcaccttttaactcctttctctttaaatagctcgctgctctgagtgaaaagaaagcaagtcaacattaaggaagcaagttaacatatccaaatacatggaaccttgagccaagcctttccttttcagatggctgacatttgggggcccgtttacctaaaaacccatgtttgggaaaagctctgtctactcttacatgggatgatagagaagacatcctcttaagccaggtgtggtggctcatgcctgtaatcctagcactttcagagaccgaggtgggaggatcacttaagctcaggagttcaagaccagcctgggcaacaaagtgagaccctgtctctattaagaaaacaaaaacaaaccaaaaaaacaaacagaagacatcatcttgaaaatgtcataaatcacaggttgtccatctcaagaaggaatgagaaaggatgtttcagagtacagaggaaactggttctctacttagaggcaagagaaagaaaactgaccctactcatgttcagaaatcttggaaaaattctttgctaactcctccagaagcaggaagtagaggaaagatcaaggacttcagaatttgaccctctgggtacaacccagctctctcgctgtccagctgcatgacatagggcatctgcaagaccagctaagcctcagtgtctccatcaataacatagtatggagggtttctgtatggagtaaataaggtattgctgccagagtcaattgacttttcaattttttttttttttttttgagatggagtctcactctgtcacccaggctggcgtacagtggtgtgatctcagctctgcaacctttgcctcccgggttcaagcaattctcctgcctcagcctcctgagtagctgggattacaggtgcccgtcaccacatctggctaatttttgtatttttagtagagatggagtttcaccatgttgaccaggctcatctcgaactcctgacctcaagtgatccacccacctcagcctcccaaagtgctgagattacaggcatgagccaccacgcccagacccctttcagtctttatattacccaatctctctgcatcatttgacactgttgaccaatctcgtcttctggaaacactcagataccttagctccgttataccctgccccttggtttgtctcccttctctgtctcttctgcagctctttgatgtcagtgctccttggggctccatcttacaccctctcgacattgcacttcacaatagtatttatttacttaccaatttactgactatttaacaagtactgtatacagtaaaaaaaatagcatcctaagtgctttacaaaggttaaaccatttaatcttcaagtaaccccattaggtacgtaccattattgttccccctttaccagtgaggaaactgtggctcaggaagatgatgtgcctttgacaaggtcatggttggtaagtggtggcagcagaattgcaactgtacggcgccctgacttatttgctagcctggctcccttggatttttcttttaattggaaggtctaccaacaccaggccctcattcacatgtgagcaattcgctccagctacgttgcagttggccctcttgctcaccttacccagcctgcttctctcaccaaacacctgcctgagctctgtagacatcagccacatcaacaagtcccaaagttttatctctagactagacttttccctgagctccgtgtccttatatcttttttttttcccccctaaaacggtgtcttgctctgttgcccaggctggagtgcagtggcatgatctcggctcactgcaacctctgcctcatgggctcaagcaattctcctgcctcagcgtcccaagtagttgggattacaggtgcccaccaccatgcctggctaatttttgtatttttaggagagatggggtttcaccatgttggccaggctggtcttgaactcctgaccatgtgatccacctgcctcagcctcccaaagtgctgggattacaggcataagccactgtgcccagcccagtgtccttatatctaactgtccactgaacacttggatgtgtcacaggcagctccaactctacatacctaagatatttccctctctcttcctgtgtctcccatctcagacaatggttctgccacccaccccatattcaaatctgaaacctgggattcacaggggactcctctcagagccctgatgatttctctgcacctctatgcctccatcactggcctaaagccaccagaatttctttcccgattactgcaccatcctcctccctggccccaaagcctccaaacctgccctactcaaaccccttctccaaaaccagactgatttctcaaattgaaaaaaaataaaaataaaaaataaatacctaagaccttttaagcccaaatccttaccagggccttcagtggtgctcctgacctcacccccagtgacctctctagtctcatcgggtcactccctgctctatatatcacatcccagtgatactggacaactcccagcacctctaatgtgtcacgatccacgctttcctctgctggaaacactcccacccatgcctcttcacttagctcatgcctgttcctcaggtatctcacctcctctgcaaatgtgtccaggttaggcgcttgccctgtgtattcctacctcctactgtcatgaccgcttggcacattttattgtaatcgcctgtttaattgtccacctcccaccccagaatataagccccaggatggccacaagaggtatctatcttaccagcccccacacccttagcacatggtcaagacacacaatacctatcattaaatgagtgaatgattataataaagtgcctggcatagaggaggtgcaataaatggcacaattattattatcaagcatagagatggctaatcaagcaggtagtgagcgaattgtgttttgaattgagctgctgcctccagcagtatcatgcttagtagggacagaacggagcctacgcctgtgctctgggttccctctcagctgggtctccccagcagtccctaccctggggctcagcattcccatatggcaggtgtaggatcactccaaaccccagatacgaggccaggccatctggagtctcttccttgccatgctgctaacccgctgggttacttcacctctctgtgtctcagtttcctcatttgtcaaataagaaatgtggaggaccagtaaaaaccaaagtgattgggaaagtataaagtattacacaaatatatacccctgatacctcagagaaggttttctgacttcttcagctgaaagcactcaagccccaagaggttcagagcagagccaagtcccctgatggccagtacaaagaggaggagaaagagaaggacagcagagggtgctctctgctggatttccccagcatgccagcttcccactgtgcagataaagcaaaatctgataggagcggggaggaagtgggctcaggctccaggagtacaagttggtatgcaagcaagtcattccaaacgccgcctccacacaaaccctctgagctgcaaattattaacctgcttaactctattgcagaaacaagcgctgctgggggtaaggtggggaggagggtgacagaagtctccttcatgccaaaggtccctttccaggagcaaagaggctttcctctcagcttctcagcatttcttatttacttctaatagtaaatcttctaaaccagtcttgcaaataaagtctaatctctcaaccggaggcattaatgattcatcacatgagggatttcagccagaagaccagtaaataaggatcctgtccacacactccacggcttgggtatctggaagagcacagctgggttagtcaaaaaaataattaatgtattggctggcacatttttgcagaatttatcacacttgtctaaacatccccagacaattcatcactattgccacaaggagcctggaaaaatctactgcctgataaaccaactgtaaaccagctggtttatactcacatttatcaatttataactgaaaacctccttgacaaatctgtgcagaaaaagtgaagcatggagagggaaacacatacattgcctcaaagcaggtgtaggattgtggttaagagcatgaactcaagtccgagtgtctggatttcagtcctgctccatgactcccaaggatggtgactttacctatctaagcctcaatttccttctctgtaaaatgatcacaaaacctcgtaaattaggcttattctgagcattaaattatccaggaacagcacttagcacatagaatgtgtggggagagcatgaggcgtgggtgataaggagttttggtgatgaagaagaggagagtccacaggctaccagagaagtttaaaactaacccctagttagtctgctgaccatgtctacaactacccaccccacaaccccacaaccccacaaccccatggaggcaaggtgccctcactcatggtgcttacttccagaaccaattccaaaacaattcatacaaattctggaaacaccaaacatatacagtaaaaaaaaaaaaagtcttaaaaataagtagtctataggaatacatttaacgaaagaagtacaagacatgtactctgagaactgcaaaacattgttgaaagaaatgaaagaacacgtaaataaatggaaagacatctcatgttcatgaattggaagacttaacataagatggctatgttccccagagtgaaccacagattcaatgcaatccctatcaaaaccacagcaggcttctttgcaaacattgtcaagctgactcagaaattcacatggaaatccaaaggacttggaatagtgaaacaatactgaaaaagaacaaagttgtaggattctcacttcccgatttcaaaacttactacaaagcgctagtaattcagacagtgtgtggtactgacataaggacagacatatagatgaatggaacagaactgagagtccagaaataaacccatgcatttatggtcaattgattttcaacaaaagttgccagacaattcagtagggaaagaatagtatttttaaacatacgtgattggaataactgaatagccacatgcaaaaaaaaaaaaaaaaaagtcggacagcttaccttcacaccctatataaaaattaacaaaaaatggatcacagacaatctaaaatgtaagactaaaactgtgaaactgagaagaaaacataggagtaaatcttcatgaccttggattaagcaatggttcttagatacgacactaaaggcacaagcaacaaaagaaaaaaataaataaattgggccaggcgcagtggctcatgcctgtaatccctgcactttgggaggccgaggcgggtggatcacctgaggtcaggagttcgagaccagcctagccaacatgataaaacgcgtctctactaaaaatacaaaaaattagctgggcatggtggtgcgcacctataatcccagctactcaggaggctgcagcaggaaaatcacttgaacccaggaggcggaggttgcagtgagctgagattgcgccactgcaccccagcctgggtaacaagagcataactctgtctcaaaaaacaaataaataaataggacatcatcaaaattaaaaacgcttgtgcttcaaaaggcaccatcaagaaagtaaaaagacaaccaacagaataggaaaaattatttgtaaatcatgtatcaagaatatgaaaagaggccaggtgtggtggctcatgcctataatcccagcactttgggaggctgaggcaggaggattgcttgagaccacgagttcgagaccagcctggccaacatggtgaaaccccgtctctactaaaaatacaaaaatttgccaggtatggtgatgcgcacctgtaatctcagctacttgggtggctgaggtaggagagtcacttgaacccaggaggtggaggttgcagtgagccgagatcacgccactgcactccagcctgggtaacagagtgagaccctgtctcaaaaaaaaaaagaaaaaaagaaaaagaaaaagaatatgtaagaacttttacaacccaataataaaaagacaaccctgtttaacaacgggcaaagggccaggtgcggtggctcacacctgtaatcccagcactgtgggaggccaaggagggaggattgcttgagaccaggagctcgagaccagcctggccaacatggagaaaccccatctctacaaaaaatacaaaaattagttgggcatggtggcacgtgcctatagtcccaggtactcaggaagctgaggcgcaagaatcacttgagcctgggagactggggttgcagtgagccgagactgcaccactgcactccagcctgggtgacagagtgaaactctatctcaaaaaaaataaataaataaaaatgaaataaaaatgggcaaaggatttaaatagacatttctacaatgcagatatacaaatgaactataagcacataaaaagatgttcaacgtctttagccatttggcaaatacaaccagtgagatgccacttcatacccactagggtgactgtaataaaaaatatatgcaataacaagtgttggtgagaatgtggagaaattagaacgcttacccattgttaatggaaatgtaaaattatgcagctgctttgaaaaacaacttggcagtttctcaaataaacacagatacagacacctaccagggatatacagatacagcatgattctgttgtacaaagtgtccagaataggcaaaacctatctaactgaggcttaggtgggtaaaaagatagaaagtagatttgtggtttcccagggggtgggggaagaaagggagggggccataaggagtgactgttgatggatatggggtttctttttgagaagataaaagtgttctgaaattaggccaggtgcagtggctcatacctgtaatcccagcattttgggaagctgagacgggtggatcatttgaggccaggagtttgagaccagcctggccaacatggcaaaaccctgtctctacaaaaatacaaaaattagccgggcatggtggtacatgcctgtagtcccagctactcggaggctgaggcaggagaatcgcttgaacctgggaggcacaagttgcagtgagccaagatcatgccactacactccagcctgggcgacagagcaagactgtctcaaaaaaaaaaaaaaagttcagaaattagtagtgattgtgaaactctgtgaagatactaaaaccactgaattacacactcaaaaggggtgaattttatggtatgtgaattatatgtcaattaaactgttatttcaaaattaaactaaaccaagggttctaggtgcccctagtgactccagcatgacagcttgcatccactctatctggctgacgtggtgagctgtggaaaggcacccaatgctccccgttctgttagggtctccttcccacctacttggctcagaggactcccctactcccctaagtttctgcccactgtagccataggagcagcaagaacaagaacaagaacatagctgatatgttttgtgaattgtattgtgagaaatgatcagcccccacctcttacttcagcgccctaacccatttcactccagcatactggtagggttgccagataaaatacaagacactcaattacatttcaatttcaggtaatcaatgaacaattttttggtagcagtatgtctcaaatgttgcatcattcatttaaaatttaactggacatcctgtatttttctttgctaagtttggcaaccctacactctggcctccatgccatccctgaaacacatgaaccacactctcacctcgggacctttccatttgttcttctttctgcccgaaattctcttcccccagatagtcacatggttcctttctcacttcaggtttttgtccaaacagcatctcatcataagaaggtgtctcctacacactttatatagaagagccacttctacctgacactccgatgccccttccccttggcattcaccaccacctaacatatatatatttagtggctaattgcctgctttcccctcagtatattggagactccttgagggtaaggcttcttttattcactgctgcattcccagtgcttagaacagggcctggcacggagtaggcaatatgttaatatttactcaatgagtacagaagtgtcgtgcatgtgttatctcatctaatcttccaaacagccctatgagacaaatattgccaccaactgtgtttcatagatgagacagctaagacatgaaagccaaataaccatcaagaagcccattttagatgcaggagccagaccccaaatgacccacctccctgcagcagctcactgtcacagacaccgcacagctcaccatcacaggcaccgcacagctcaccgtcacaggcaccgcacagctcaccgtcacaggcaccgcacagctcaccgtcacagacaccgcacagctcagtcacaggcactgcacagctcagtcacagacaccgcacagctcagtcacaggcactgcacagctcagtcacagacaccgcacagctcagtcacaggcaccgcacagctcaccgtcacagacaccgcacagctcaccgtcacagacaccgcacagctcaccgtcacaggcaccgcacagctcaccgtcacaggcaccgcacagctcaccgtcacaggcaccgcacagctcaccgtcacaggcaccgtacagctcactgtcacaggtggcggggcaacttggagctagggtggcaggtgtttctgactccttccatttagggtactctgagttagatgaaggaaggagtcacagacatgtctgagagtctacatttgcaccagagagcttaatcctgggatttaattcaggcttgattattgcctacacaattattgtgcaatataaagtgtttcaaataactatagagtatttcaaataattaaagacttgattttgcctacacaattactgtgcaatataaagtgttttaaataaatacctaaacctccattaatggagaagtctgtgtgggtatctatactcacttttatttcttcttgaacatcaggattgcggaaatttaaatcaggttgctctttcataaactgatgaaaataacattggtttcgcacttcgtcaaagtgccaactggagtttccatacacacttaactggcaaacaaagaaaacagcacatcagtgacctataatggtattgcccacaaataaagatcattgccctccctgatcctttgcaggcagagtatgtaaatcctgagagttttccttctacagagagcagcaggttaaagaaaccccttccaaataccccccaccccattggcctaatgcctcacaaacatggttgcaacgtatttttacagtagatgctgtttgtaacaactgcaacagcaaaccaatgttctcaaacccaagacaaggtcaacttaaggaactgacattactaatgtattttcttgaatcttctgtccaggatccaaactcttgtttgtgaagagaagcaaaatggtagtcaatttggaagaaagaaacattccgctcatcttggagcttgagcccagatagactgaatatttaaattatatccccagaaaattattagaatccttcacttaaaatctctaccagtctccaagaataaaaagcaacttcaagtgttggtactcagcaatagttgacgatgtcgctggtctcctctgtctggaaatgctcacatttatggccccatggtatgactctcccggctgccctcccacatctctggccactccttaagtcaacgctgtgggcccttgaatgtgagagtttcatggggctctgtcctaggccttttgtccatttcatgttaaagagaacatctggaaaacatttaacaactgggagattttacataaatctttttgagttggaagacgtagttacactgagtccacatgtccatggcaacacaggcagatgctgagtagtagctgctgcctttcaaggacatgcaccctttccaattcaacacacagcccacctggacacaaccagggcaagagatttttagtgtacataaacaataaaaaatcagtatccagaatacaaaaggaactgaagaaagcaatttcaaagggataaataattcaaaagaaagtaggggaaagaaaccataaagaggtgtttcacagaaatggacacttaaatgaataaatgtaagaaaagatgttcaacatcattaggaattagataattactgtattaggaattagacacatcatcattagtaattaaataaatataaaattaagatctcaaggcaatattgttttaagtctgggctgggcatggtagctcatgccagtaatcacagcactttgagagctgaagcgggaggactgcttgaggccagaggttcaagaccagcttgggcaacatagtgagagcccatatttacaaaaaaataaaaaaactcagccacgcatgatggtgtgtgcctgtggtcccagctactaaggaggctgaggtggcgaggattgcttgagcctaggagctcgagactgcagtaagctatgattgagccactatgcttcagcctgggtgacagaatgagaccctgacacaaaataataataatttttaaataaaaattacaaagttgggcaatatcaggaattaatgagaatgtgtattttttatacttctgtgggggatataaattggtacaaccattttgataatgaatttgacactatcctgtagagctgagcatgcgatatcctgcacagcaattttactcctagttatttacctaaaagaagcccttggttgggcgtggtggctcacgcctgtaatcctagcactctgggaagccgacgtgggcagatcacaaggtcaggagttcaagaccagcctggccaatatggtgaaaccctgtctctactaaagatacaaaaattaggtgggcatggtgatgggtgcctgtagttccagctacttgagaggctgaggcaggagaatcgcttgaactgaggaggcagaggttgcagtgagccaagatcacgccactgcagtccagcctgggcgacagagcaagaccatctcaaaaataaaaaaaagaagcccttgcacatgtaccccaagatagattaatgacagtgtttatagtaacattgttcataataaaaaaaacggaagtagcccaacttcccatcaactgaagagtggataagtaaaccatggattgttcacactgtgaaatatacaacaatgaaaatgtatgaaccatagctacctgaagttacatgaataaatcatgaaaaagttagttaagaagactatacctagcatgacacttttcataaagttcaaaatagaggaaactaaaaaataatttttttagagtcgaagtcttgcaatatatggttatatatatgatatactacaaggtgtttatccatcatatacatatacatatttttgaacatattaactattacattagaaaatgcaaccttgactatagtggagaactaaaaaagcaatggaaaaactggatcacaaggcagctgtgatcattctataagcaagaaatgatatagtttgagtatggcagcaatttttaaaagcagactatggagctgaaatgactagatcccatctttagccctgtcatttattagctgagtaacctcagtctgcctatctgcaaaacaggaattacaccagactcataggattatagagtggattaactaaattaatgaatataaaacacttagcacagagcctggcacagagtaagtattttgtaaatgtttgctaatgtcattgcaattttaacaagtcagtgaactggaggaaaaaaagaggtgaaactgccaggacttgctgacagcctgttcctcaggctgcatggtagtaccattcactgaacctgggagacggaaggttatagggagaaaatcacacatcacaaagttgacctgcaaatatatcaattctgagtgtccttggatcacctaaaagttgatgtttaaatatttatggagaaggtccagaagagagaaggagggactggaggagggagggatgatccagaataaaggcaggagagaacacaaacccgggcaaggggaagctctggcctgagacagaagcagagctgccagatgaagtgcaggatgcccagttacaactgaattcagatcaacacgcatattgttgagtataagtattactcatgtggccgggcacagtggcttacacctgtaatcccagcactttgcaaggccgaagcgggaggatcacttgagcccaggagttcaagaccagcctggacaacagagtgaggccctgtctttacaaaaaaataaaatattagctgggcatggtggcacacatttgtggtcccagctacttgggaggaatagctgggaggattgcttgagcccaggaggcaaagactgcggtgagccatgatcaagccactgcagtaagccatgatcaagccactgcactccagcctgggagaaagagcaagaccctgtctctgaaaaataaaaataaaaaagaaagtatggtccacactaaaaaattttttatgcactgcttgtccaaaattcagatttaactgggcattctgaatttttatttgctaaatctggtcaccccagaaaggagggatctggcttctgttgtaaaaggagtgagtaggaagagggtgggaatggggcaggcaggcttgatggcttctgttttctctgtgaagtcgagtttgctgctgagagtgataagatggggtagaggcagatacgatgtttgaaatgagggagggagggaaagttgatcggttgaaattagcaaaattcccaagaagagtggatggctcagttcaggtggggacaatgaaggtgtgatgtctccagagactcaactactaaggtttaggcaaaaagaaaatagataattgggttcattcatggctagggttttgtcagacagaggagacaaaaagtcagaaaggcaaagggggccaggagcggtggcttacacctgtaatcccagcgctttgggaggccgaggcaggtggatcacctgaggtcaggagttcaagaccagagtggccaacatggtgaaaccctacctctactaaaaatacaaaaattagccgagtatgatgacgcgcgcctgtaatcatagctactggtaaggctgaggcaagagaattgcttgaacccaggtggagtttgcagtgagctgagattgtgctattgcactccagcctgggagacaagagcaaaactacatctcaagaaaaaaaaatgcaaaggggtatggatagtagaaaaatggttatcaaactaatgggacatggaatccaagttggaccgggtaggaagtgaaggaagggtggaaggagagaaaataggtttgaatttgctagaacacatcatctctatgatgaaatcagaaatctaaataataattggaagcctgagtaaataacaactggaaaccttatttctatttctttcagaaacttgcccccttccgataaactatattcattcatttttccctcaaaagggttttactaaatcagttcaatcactacatatctgccttttacccctttgtaagtcagacaggttgatacttacccagttgttgggtggaatggttttgccattttcatgggtacagtcatgccagatataataatcagtatattttcctgtccgtgtccgactcaattgaaaccaaatatgtttatcactcgtgtggtttggtatgaaatcgatgattaattttaaacctaatgagtaaaagacatttcaaatgctagggaaagattgtattagaataacatatgacaggccaggcacagtaatggctaacgcctgtaaccccaatacactgggaggctaaggtaggaggattgcttgagcccaggaggtggaggctgaagtgagccatgattgcaccactgcactccagcctgggagacagagcaagaccctgcctggaaaaaaaaaaaaaaaagcagggaaaggagaggggaggggaggggaggggaagaaaggagatagggaaggaaaaaggaaaggagaaaggaaaaaaggaaacagaagggaagggaaggaaaggaagaaagagaaagcgggaaggaaagaaagaaggaagggagggagggagggaaagaaatagtatatgacagttaaggagaagaaatgctttaagtaaacatttgaaaaagtgcttctctcaaacctcatccccatcttgcccactttccattcaacttacctttatcatgtatggctgcaaccagattctcaaaatcttccatcgttccaaaaatgggatcaacttcccggaaatcttcaacaccatatctgaaatctttaagggacgatttataaaatgaagtaatccaaacagtttttatatttaaagctgtgatgtagtccagtttatcttgaatacctgaagaaaaaagtcaaagtcatgaataaaccctactttgttttagttaaaggacaaaaaatataacaaatatgcctaagatagaaatatttacatgaaggcaaaaatacttagaattttgttgaatttgagtataattcaaataggaagatctagctctacaaaaaatatcaaattaggtcgggtgtagtggttcacgcctgtaatcccagcactttgggaggccaaggtgggaggatacctaaggtcaagagctcgagaccatcctggccaacatgacaaaaccccgtctctattaaaaatacaaaaattagctgggtacagtaccacatgcctatgatcccagctacctgggaggctgaggcaggagaatctcttgaacctgggaatcggaggctacaatgactcaagatcacaccactgtactctagcctgggcgacagagcaagaccctttctcaaaaaaaaaagaaagagaaaatcaaattagtcatctatcagtaatcgatgacatttaacatagcattaaaaaaaatctctgtgacttactcatattttatatttaaaaccaagactgtggtattgttcatttattctacacatggtttttgagcagctaatctatgccagctgctgggctaagtgtcaaggaacagagcagagtaacgcatggcccctgtcggtcatgtggtctacactgcactgttctgtctaagagccacatgtggctactgagcacttgcagggtggctggttggaattgagatgtgctgtaagggaacaacatgtattggattttgaagaccctgtacaaaaagaaagaatgtaaaaatctcattaatatttttatactgggccgggcatggtggcacgtgcctgtaatcccagcactttgggaggccatggtgggcagattgtttgggctcaggtgttcgagaccagtctgggtaacatgataaaaccccgtcttaaaatacaaaaaaaaataacaatatgtatatatttttatactgattatgtgttgaaatgatacattggattaaacagaacatatgaaaattaatttcacctgcttcttttttcctttttttaatgtggctactacaaaatttacaatttcttatgtggctcccattgtatttcttttgggcggtgttggtctcggaagtgtctgcaggcaggggtgggatgatgatcagactgaagagctaaggaagagctgcagaaagtgctttaagggcatcagggcattggcccttgacccccaggggcagaggaagctgatgacccctgagggtaaggacagagaaggtccaggatggtgtgggcaaaggggatcagagtgaagggcttccaggcacagcaaaggaaaggagggagcaagaatagacagggcatgtctaaaaaagggtgagaaggcaggacacagtggcttacgcctgtaatcccaacacttagggaggctgagacaggtggatcacttgaggtcaggaggtcaagaccagcctggtcaacatggtgaaaccccatttctactaaaaaatacaaaaattagctggggacgatggtgcattcctgtaatcccagctactcgggaggctgaggcaggagaattgcttgaacctgggaggcggaggttgtagtgaggtgagattgtgccactgcactccagcctaggtgacagagtgagactccatctcaaaaaaaaaaaaataataaatataaataaataagtaaatgcatcaattaatttaaaaaggtgataaatgttgtcagtgcacggggtctgagaaggagtgcaacctcaacacagaaggtaagtttgtgccaatatttgaggagtctttgtttccactctcagactgcctttgaacttgctaaatttggactatttcccttgttcacttatataggaacccaggaatttatacagaagagaattctaggcttggctgagaagacatgtggaaatgaaactttgtatttagaactttgtaggataatgagcagataatgtgttttctccttctagttcagagtcccaaatgcatattcagcaacttgagtctagaattcaatctccagtaactttctgtgtaatcctgatgtgacttcctagaattagactgtcagaggccacaccgcaggctgaaggtcactaattccaaagcacagagtcattcgacacctgggatctgggcttttcccctataacacactgcttatttattttattttattttatttatttatttatttatttatttttgagatggagtctcgctctgtcgcccaggctggagtgcagtggtgcgatcttagctcactgcaacctccgcctcctgggttcacgccattctcctgcctcagccacccaaatagctgggaatacaggcacccgccaccacgcccagctgattttttttgtatttttttagtagagacggggtttcaccgtgttagccaggatggtctcaatctcctgacctcgtgatccacctgcctcggcctcccaaagtgctgggattacaggcgtgagccaccacgcctggcctgacaggctgcttatttctgtctctgtaccccagttcccccatatgggtagctgcaagatctcacacggtatcaacaggcagcaagagggttttgatctaagccagcacagcaacacaatatatcttatgatgaggcacaaaggaacatgaggatgaaaacaaagtggctggagaaagtaaacaagggatcccaccccacattttagaaggagagagggcaatcaccaaaaccagactcaaagctggaatgggatcttcataataacaacaatgaaatcccttcaacctcaaagacaaatgcctatggattgcaggaagtaaaacattcctccaagaacaggtattggaaatgacaaacatcagagctgattagaaaccaccatgtttacaggaatgttggacctatccagaaggagattattaggaaggcagggccaggaagtggtaaacatatctctggatttagggctttaggtctatgcagtcagagcattgcttttcctaagcactcaatgtgcaaaaggcagcaggtcataggtcatgagtcaggggaaagggagtcactcaaggcaggattaaaggatgctagaaacacatccaaagccgaagatctggggtggggagcccatggtctgattagggaggctaaagaaagagtaatgaaggcaatgggtttgagctgcaccatgaaggacagatacactcttcttcaatgagtgacaatgcaggatgatttttaaaacgagaatgatacagccggatgcggtggctcatgcctgtaatcccagagttttgggaggccaagggggggcaaatcacctgaggtcaggagttcgagactagcctgaccaacatggagaaccctcgtctctattaaaaatacaaaattagccaggcatgatggtgcatgcctgtaatccctgctactcggaacgctgagccgagagaattgcttgaacccaggtgacggaggttgcagtgagctgagattatgccattgcactccagcctgggcaacaagagtgaaactccatccacaaaaaaaaaaaaaaaaaaaaagaagagagagaatgataggagcgtgaaaaagaaaagccttctactagtgattaaagaaagctgcaggtttcaagaattcatttgtagcattttaaagatacattaagcccattcctactttccacattcatatcatcctgttttgttttcttcaaaccaattatcattgtaaaacattagtttgttagtttccttatttgtttcctattgttgccttgaagtagagtgaccataccaaccaatttgctcagaagttcccagtgtatgcctgccatctggcataattttactctgaagtatgttctggtttgagcaatatattgtaaggatgttttacacataacccaccaagaaattaacttagcttttaaaaaataatttttcacttttttttttttctttttggagacggggtctccctatgttgcctaagctggctggctgagagctcctgggctcaagcgatcctcccacctcagcctcccaagtagctgcaactacagtcatgcgccactacccctggttaattctttacttgttttatactaatacggacatggttttaaacaatccttaattcaagtaatgacgaatgcatactgctaccccttttctacttcccttccttttttagaatttaaactttaagactcagcctatactttttacagatatcacttgatttttaaaaaaatattatttatgctttattcactaatacactcccagccacacagccaaactagctgcttcgtatactgggaaagcaattcccaactgccaccctgacatattcaactataaagtccccagaaacaggacatagattttagaaggaaggctgctctaagaagttagaattgatgactgaacaactgtatgtacttagtgggcaataaattaaacaactcgtttggctcaaaggccttcagcaaatagcccttcagctagtaaaataactgctgggttctgctgagtgattttctaagaatatcataaacaaggagcaacttggcatgaccagtcataatggaatgtgcttactgaacaacccaggcataatttggttctgaagaacaaaagaaccataaaccaatctcatcctggcacccaccctaaatgatctctgggcatgtacctttcagatctccgttcccatccttgttactgtccttgaaagaccttgggtagatctggtacatgggcccctcctgccaccagtctaggcactttggagagagggcaatgatggctatggtggccgcgatgagcaccagcacagaagccactgtgagccagaagaggatctcccgaggtatgcggtagcgggcctggccagagaactggaacagcacctccttgggcatccccgcatagggctggacgcccttgaagtcgggctcctgggagccaaggatgcccctggtgctgtgcttcaggttgtctgttgagctgcctggatccggggtctgctccagaatgtcttcattatggacaaacccgttgtttgtctggcatcccttcatactcatctcgatggagtctctcttgcttttatcttcagccatgtctcaccgacttatgtcttcggagtgccttcctgcagtaagggaggtggaagagtggcttgctgaatgcttggtcttgttaatgaactttgtgtggtttataaataaacctagctggacaaagtccagccaaggaagaaagggtaaaagtacagaggtttaaaaaaaaaatctcgggactggcgcggtggttcatgcctgtaatcccagcactttgggaggccgaggcgggcagatcaccaagggcaggagtttgagactagcctggccaacatggccaaaccccgtctctactaaaggtataaaaattagccaggcgtggtggtgtgcacctgtaatcccagctgctcgggaggctgaggcaggagaatcgtttgaccccggaagacagacgttgcagtgagccgagatcgtaccactgcactccagcctgggcgacaagagcgagaatccatcccacaaaaaaaaaaaaaaatctccactgggcatcttggctcacacctgtaatcccagcagtttgggaggctgaggcaggcaggtcacccgaggtcaagagtttaagaccagcctggccaacatggtgaaaccccgtctctactaaaaatacaaaaattagccgggcgtggtggtgcatgcctgtaatcccagctactcaggaggctgaggcaggagaatcacttgaacccaggaggcagaggttgcagtgagctgacatcgagccatggcactccaccctgggtgacagagggagactctgtctcaaaaaataaaataaataaataagaaagaaaataaaaataaaatgaaactaaaaataaattaaaaaattaaaaattggaaacaacccaggtagctatcatcagatggatagataaacaatgtggttatacatatagtgaaatattattcagctttgaaaaggaatgaaggctgggcatggtggatcacgcctgtaatcccaacactttgggaggacaaggcgggtggatcacttgaggtcaggaattggagaccagcctggccaacatggcaaaacccatctctattaaaaatacaaaaattaggccaggcgcggtggctcacgcctgtaatctcaatactttaggaggccgaggccagtgaatcacctgaggttgggagttcaagaccagcctgaccaacatggagaaaccccgtctctactaaaaatacaaaattagccaggtgtggtggcgcatgcctgtagtcccagctacttgggaggctgaggcaggagaatcggttgaacctggaaggcggaggttgcggtgaatggagatcacgccattgcggtccagcctgggcaacaagagtgaaactccatctcaaaaaaaaaaaaaaaaaaaatagctgggcatggggacatatgctgtaattccagctacttgggaggctgaggcaggagaatcgcttgaacccaggaggcagaagttgcaatgagctgagatcgcaccactgcactccagcttgggtgatggagtgagactgtctccaatacataaataaaggactgaaattctgacacatgctgcaacatagatgaacctggaggacattatgctaagtgcaataagccagacccaaaagggcaagtgtgatttcacttagatgaggtatcttgagtagtaggattcataggaacagaaaatagaaacgtggttactggaggttggaggaagggaataatggggagttattgttcattgggcagagaatttcagtttgggatgatgaaaagtattcctgagatgatagtggtgatggttgcataacagtataaacatacgtaatgccactgaaatgttacatatgttttaccacaactttttttaaagcttaaagctttctctatttagccaggtataagaaaaatgactttggggggaaattatttttcttatacatggttaaatagagaaagtgggaagatagcttaagcccaggagttggagaccagcctggacaatatagtaacacctcatctctacaaaagaaatttaaaattagctgaacatggtggtgcacccatgtagtcccaattactcaggaggcaggctgatgtgggaggatcacttgagcccaggaggcagaggttgcagtgagctgagatgagccgaggagacagaggttgcagtgagctgagatcacgccactgcactccagcctgggtgacagagcaagattctgtctcaacaacaacaaaaaggaatgtaatgatttatgatgtccctttcatcaggagcacatacagtcctatgaatcgtttgatctgataatgagacttttttttcttttaaatgatgatagttatctggggccctaatcttagtgtctctttgtggagtggcttagaagcattgtatagtatagaggtatggaggaatgagctacttgatcttggacaaattacatttaaaactgagtaaatcccaatacttggctcattgaatgcacccagtgatacctctcattattattaattatgcccattgaatattttttatttttattttttgagatggagtttcactcttattgcccaggctggagtgcaatggcgtgatctcagctcacccacaacctccacctcccgggttcaaccgattctcctgcctcagcctgctgtgcagctgggattacaggtgcccgccaacacacccagctaattttttgtattttcagtagagacagggtttcactaagttggccagactgctctccgactcctgacctcaggtgatccacctgactcggcctcccaaagtgctgggattataggcgtgagccaccgtgccatgccccaaatcattttctaacaaagagcagccagtaaagtcaagctgcagacatagacaagcaagccgggagcttgcacaggtggatgcgacaggaaagaactacctgggactagacatgttcaaaatggcggctgcacctccccttctctgccagccacgtgtacagtaaggagcagacaagatggcaccggccaagtggagagttcatttgcataataagattagagtggggccaccagccttccctgtgtgctatgtaaacgtcacacctgacccaaaaaacctgtgagccctacctaaatcagacacggcctcctcaagctggactataaaatctggcgtatccaccagctgaccttttcctcttggaagtcccttctttctcactagagagagagctattttcctttgtctttctccttcttccgcctattaaacctctgctcctggccaggcgccgtggctcaggcctgtaatcccagcacttttggaggccaaggcgggcagatcacctgaggtcaggagttgaggacaagcctgacaaacatgaggaaaccctgtctctactcaaaaatacaaaattagctgggcggggtggcgtgcgcctgtaatcccagctactcaggaggctaaggcaggattgcttgagcccaggaggccaagactgcagtgagctgtgatcaccccactgcactccagcctaggtgacagagtgaggttcaaaacaaaaaaagaatatacaccacagtttataagtgggcatgtgggatttttttcgtttgtttttggctattataaataaaattgctacgagcaatcatgtacaactctttctaaggatatagcttccttctctcttaggaaccaactagcagtgaaatagctggataatatggtaagtgtataattaatgtttaagaaactgccaaactgttttggaaagtagttgtattgaggcaggagaatatagggattggaggcagggaacctaaggctgtttcacgcagcattcctagaactaaactgaaaggaaaaccctaactttacatgcctaaatcacaaaaggaccagaggctactccctttgcaaaccccccaccttttctgccaggcatgggaaattggcaaccaatcagactgattgcgggttgagtcttcctttgcaactttgtaacttcactccagcctccgaatggttggttgctgtccacaaccaatcagactgattgcgggcggagtcttcgtttgcatagaagtataaatttgtaacttcaccctagcctctgattggttgctttctgcaaccaatcatacgtttgcacaggagtgtcacttttgtaaccacgtcatcctctggttggctgctttctgcaatcaatcagactgattgtgggctaccacttcatttacctgaggtgggcatgaagtagccaatgggaaacttctagagggtatttggacccaagaagattctgtatccggggcccttgagccactgctcagcacgctctcgcactgtggagtgtactttcattttcaataaatccctgctttcgttcttttttaaccagttgtcaaatgatcctttattgaaatattttcctttgtgcttaactggctggtcattccacagcaccactgtagatgtcatctatgatgtcctgagggtggcggccatcaacattacagcccacagactgggcagtccccaggatctctttaatggttccagagagttctctggctaaggatcagtgctgcatctgtcgagcaatgttgacgatctcataaaaagtgatattccccctgtgtttaatgtttttctgtttctttctgtctcttggtagttccttttgatgatcagggcggaggcagaaggtaccacttcaatctgggcctgtctgttctgaatggtcagtttcactgtaatcctcaggcccttccagtcacccgttaccttggcaatgtcatcaccaacctcttttggagacagacccgcggggccaatcttgggggccagagcagaagtggcaccgacttcaactccagtgcacgtgaagtatacgactttgatctcattggggtggaacttcggcggcatggtggaggcggctggtgtcggatgaacccggattcgagacgaccgaagaaagttgcaccttggcctcctccgagccgaaagccgagagagctgctttcgttcttttgttgcttcattctttctttgctgcgtgttttgtccaattctttgttcaaaacgccaagaacctggacaatttgcagtcacgtccctctaccggtgacagtaccattttgggttgccttcattggtgtatgagagtgtgaattcttccacattcttgccagcacttgctctgttgtctgtttaatttcagtgattctagtaggtaagtagcagtgtctcattgtggttttaatttgtacttctgtaaagactaatggtgatgagtatcttttcatgtgcttatttgccatccatacatcttccttggtgcagctgatgctggcagccagctgggtggggagtggggctgggggcatctctgttctcaatacctgtactgcttcaatgtagtctccatgttggctactgtgggcgtcttcatagcatgctggcttggtaccaaatgttagtgtcccagttgagaaagcaggcaaggcagaaacaataccctttttgtgacctagcctcagaagttacatagcttgtttttgactgtactttatgtgccaagcccagaggcagtgtgtgaagggactaagaagttataaggcaaaggacataaatacaggaggctacaaattgggctattaatgcaattatctattgtgcaatttttattgtagtagaaacatataaaatttatcatcttaatcatttttaattaaatggttcagtgtgttaagtatattcacattgctgtgaaaccaatctccagaagtttttcatcttgcaaatctgaaactgtatatatcctttaaacaactcccccttgcctcccctcagcccagggtaaccaacattctactttgtttctatgaattgacgactgtagatatataagtgcaatcctatagcatttgtcttttgtgattggcttatttcacttagcacaatgtcttcaaggttcatacatgttgtagcatgtgacaggatttctttcctttttatttttttcttaaaaacaagatcttgctctgttgcctaggctggagtgcagtggcacaatcatagctcactgtagtcttgaactcctgggctcaagccatcctcctgcctcagcctcctaagtagctgggactacaggcatgcaccaccacatccagctaatttttgttttttgcagagatggggggctgtcactatgttgcccaggctggtctcaaactcctggcctcaggcagtcctcctgccttggcatcccaaagtgctagaatcataggcatgagccactgtgtctggcctttcctttttaaggctggataatattccattgtatgtatatactacattttgtttatccgtttatcagtcaaacacttggtttgcttccatcttttggctattgtgaataacactgctatgaacatgagtgtgcaaatatttctttgagatgctgctttcaattcttttggatatatattcaaaag

SEQ ID NO: 11800 - DNA, 115508 bp, Human
gagacatgatcagccatgcattgaaaaaatgtaaaagttggatgatcttcacatgagagtcctttattctgtctacttttgcatatgtttgaatatttcccataacaaaaagttgaaaatagagtgatcacatgagttaatctcctaatttacaaaaaagaaaactggaaacagaaggagaacaaaacttgttcaaggtctcaaagccagacagcaaactagctcccaagtccaaccttcttgctctggtcctaagcaaacaaaaaatattaatatgagctactgcattaaggaaagtctgcttttccaaagggcagaccaatagttcaaggaagagtttaaataataaatatttgtgatcttactttcatgcttttctattttccactgaacacatatgcattatcttctatatgtcttttatgtataatcatttgcttcctgttccttgtggttttaaagttgttttgtatgtttaaatttgattttactcaaatttcagaacccaaattagcgcaagaatcagacaaagcataactttctataaatataaaaacaattaaaaaaaaaacatacagcaaaaacgagttgttgtttcccccctcctcttccagtgcttaactaatcttccgaatccaggcacagaaagcaaaggctttctgctagtgggaggagcttgcttctccattctggtgtgatccaggaacagctgtcttccagctctgaaagaggtgaaaatgtgttaagcgatgcaaaaattgtcttgaagttcgcgtgtgtatgtctgtgtgcatgtgcgtgtggtgggtggggggagagaaaagggggtgtcaattctgagggcaacgagaatcagaagtcagaaaggtgagtggtgtgtagcatctccctttcagaaggggctgaagaagaaattggatatgatggtccggtaggctaaatcacgctggatttgtctcccagataaagggaggtctgcaaagtaagtcccatttctagagcgaaaagccttaggaccgcttgttttagacggctggggaatatttattccttgttccactgatgggaaaatcagcgtctggcaggcgctgattggtggaaaggaaaatggtgatagtggcgtggaaagaggatttgctgagccttctcctgcctcctcaacctgtgactcttccttagtagtctccctttcaccctcaggaccctttccggctcttcctagattaagagcaaacgaaaaccttgaagatatttgaactaaagcgacccctaacgttgtaacctgtgaccgtgattaaatttcagcgatgcgagggcaaagcgctctcggcggtgcggtgtgagccacctcccggcgctgcctgtctcctccagcagctccccaagggataggctctgcccttggtggtcgaccctcaggccctcggctctcccagggcgactctgacgaggggtagggggtggtccccgggaggacccagaggaaaggcggggacaagaagggaggggaaggggaaagaggaagaggcatcatccctagcccaaccgctcccgatctccacaagagtgctcgtgaccctaaacttaacgtgaggcgcaaaagcgcccccactttcccgccttgcgcggccaggcaggcggctggagttgatggctcaccccgcgccccctgccccatccccatccgagatagggacgaggagcacgctgcagggaaagcagcgagcgccgggagaggggcgggcagaagcgctgacaaatcagcggtgggggcggagagccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcaggtaagtacctgtggatctaaacgggcgtctttggaaatcctggagaacgccggatgggagacgaatggtcgtgggcaccgggagggggtggtgctgccatgaggacccgctgggccaggtctctgggaggtgagtacttgtccctttggggagcctaaggaaagagacttgacctggctttcgtcctgcttctgatattcccttctccacaagggctgagagattaggctgcttctccgggatccgcttttccccgggaaacgcgaggatgctccatggagcgtgagcatccaacttttctctcacataaaatctgtctgcccgctctcttggtttttctctgtaaagtaagcaagctgcgtttggcaaataatgaaatggaagtgcagggaggccaagtcaacaggtggtaacgggttaacaagtgctggcgcggggtccgctagggtggaggctgagaacgccccctcgggtggctggcgcggggttggagacggcccgcgagtgtgagcggcgcctgctcagggtagatagctgagggcgggggtggatgttggatggattagaaccatcacacttgggcccgctgtttgcctgaggttgaaccacaccccgagtgagcagttagttctgttgcctacgcctttccaccatcaacctgttagccttcttctgggattcatgttaaggatacccctgaccctaagcctccagcttccatgcttctaactcatactgttaccctttagaccccgggaatttaaaaaaggggttaatcttttcatgcaactccacttctgaaatgcagtaataacaactcagaggattcatcctaatccgtggttaggtggctagacttttactagccaagatggatgggagatgctaaatttttaatgccagagctaaaaatgtctgctttgtccaatggttaaatgagtgtacacttaaaagagtctcacactttggagggtttctcatgatttttcagtgttttttgtttatttttccccgaaagttctcattcaaagtgtattttatgttttccagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggtaggtaaaccccaaatgtcagtttggtgcttgttcatgagtgatgggttaggataatcaatactctaaatgctggtagttctctctcttgattcatttttgcatcattgcttgtcaaaaaggtggactgagtcagaggtatgtgtaggtaggtgaatgtgaacgtgtgtatttgagctaatagtaaaaaatgcgactgtttgcttttccagatttttaattttgccctaatatttatgactttttaaaaatgaatgtttctgtacctacataattctatttcagagaacagttttaaaaactcatagtcttttaaaaaataatcaagaatattcttaagaatcaaaatcattgatggatctgtgatttcttttaccatcatgaaaaatgtttgtcaattttaatccattctgatttttaaaatatgactttgatatgcccctgtgatgtgtataaagagacctatttgtggccctaaaatggaaagaacagattagtctttgatagagttacttcatgtgatcatttggtctctgtgaacactgaggacagagaaaagtgcttgagggctgctactaatctctcagaaacatttgtatagttcatccatcaaatgacacacatactaaaagaataaagaaattgatgcttattacctacttgttcctaaagttccaccttggggtatacacccaaactctgactctcttttctgtaacttgaactgtattcaattgagtgttattttacaaaccactttgaattccttggaaaagaatagacacacactctcatccacaggcatagacacacacactcaacacagacacattgcccattcttcctctcttctttctcctctgagctttttcacattctctggtggcaactatagcagtaagagtcacaggatgaacagtcaggtggaggatgaccacattgagttgcctagctgaaacatgtgctccgtctatgtctgcaaagtgaaagaaagctacactatctcttcaacatagatcagtgggggaaattttatacttgggatgatttatatgaatgcatctcatcaaagttcacaacacatttttttttcagttttttattttcagtttttagagtcagggccttgctctgtcgcccaggctggactgcagtgatgctatcatagctcactgcatccttgaattcctgggctcaagtcatgcccccacctcagcctcctgagtagccaggattataggcatgtgccactgcctcattatttagacttttcttatgttgacttaatcttcccacaaatcttcaattaaattactttttttctaccttaaaacatattttcagaaagtcattgaaatagggtgttacaagaggaaaaaattgatgagttaattttaaatattttatgaagtgtgaattatacctttttagatggaatttggaatactgaatcagtgacatgcagtttatcaatatctttccgtttgtcctcagatttccaagttctgcaagcacaagtttctttgacttagttaccttttaactgttcattgaaatcattttcaatgtctctcatggcatttaacacatagcacattctataaattttttattggttacattctgagttctaattgagagttgaacttacacacagaatttaagataaaaaatgaccatgtgaagacacaatagtatagtccagggattggcaaaattttgggtaaggaatcagatagcacgtattttaagccatgagatctatgtcttggccaggtgccgtggctcaggtctttaatcccagcactttgagagcccgaggctggtggatcacttgagcccaggggtttgagaccagcctgggccacatggtgaaaccctgtgtctacaaacaacgcaaaaattagccgggtatggtagcatgcatgtgtattgccagctacccaggaggctgaggtaggaggatggcttgagccatacagctcactgcagaggttgcagtgagctgagatcgagccactgcactccagcctgggtggcagagtgataccctgtctaaaaaaaagaaaaaaaaatctatgtctcaattctgctgttgaagtgtgaaggtagtcataaacaataactagtgtggctgtgtcccaataaaacttcatttatcaaaacaggtggtgggctggaattgtcttgtatgttgtagcttgctgactactgatagagtggaaagaacatgcactaatcacacaaaccaaagttttagttgagactacatcacttatcacctttagggtcttggggaagcgtacttaacatctctgagcatcacttccctgattagtaaaaaatatgatttagaaaactgcaactaccttgcagtttttgtgggaatgtcataataagacaggacatatgaataattgagcacacttttatatataggaaccatggttattattatcaaataaactctccaacggaataattactttgccaacacgttttccatttattcttttatccttcattacataactagtttgaaagattggaggcgaccaaagaccattttataatttcacttatggctgaagatgtttggtagaagcctcataagaaaagtaatctcattcctttataagaatatacttttaacaactactttttaactcattgaagaactaccttaatgatcagtgttatttttatgggttttgttccctccatttttgttatctgcgtacaccaattttcaatcaacatacttcaatttaatagacaaaaatttcttcaaatgactcagaaattaattagatctaaatccaaaagcagaaagatttaattatctttatataatgctcagtaatataaatgcaataaatacaagaaaatgatgatctttgagtgtcttccaatgccactctgctcaataagcagcagtggccatcagtgaaattgatagcaaattctcaagtcaaaatgtgcttcacctcactaagctgacaaagtcaacataacatgcacaacagggataactgagttctcaaaactctcaggtattacttctgaccttcttctccactctgtgctcttttgaggttgggaagacaagatagggtgtgtgtgggacacctccgctcagggaagccatcagctctggtgtccctacagcatttataccttgctagtcacataaccacttggcacctattttgtaggtgtacgttatcaattacagattactcataaattaaaggctaaccatcaattacagattattagtaaataattatgacctcaaagaacaactgattggtttgatacatggtaaccttatgaggactctcatttatctcgtttttttaagttatatacctatctctttggggttgcactacaaaaatataaaatatgttgcataagatatttataaaaaataattaattataagttctagtggtgtggtttagtggcattcttttttttttctttttttctgagatagggtctcaatctgtcacttcactccaggctgaagtgcagtggtgtgatctcggctcactgcaacctccgcctcctgggttcaagttattctcctgactcagcctcctgagtagctgaaattacaggcatgcaccaccatgcccggctaatttttgtatttttagtagagatggggtttcaccatgttagccaggatggtctcgaactcctgatctcatcatccccgacctcggcctcccaaaatgctgggattacaggcgtgagccattgcacccggcctagtggcattcttttttaaaaataaatttaattgtgtatatttagggtatgcaacatgatgctatcagatacattagacactaaaaaattactatattgaagcaaattaatatattcataatctctcatagttaccttttttgttgtttttgtggcaagggcagctaaaatccacttatttatcatgaatctcaaatatagtacaattttatcacctacagtcctcatacattagatctgtacactttttcatcttacacatctgctacttgcttggatcctatggcctatatgtccctattttctacctacttttccacccctattaaccctgttttttacgtagtctctgtatatttgaattttgtttcaagcttccacatatatgtgagataatgtaatatttttctttctgtgtttggcttatttcacttagcataattttgtctgggttcatccatgttgtaaatggtaggatcttgtttttttagggctgactgatattccattgtatctatgtaccacaatctttttatctacctatctatcagtagacactttagttgtggctattatgtttttctttttttcttttttggagacagggtcttgctgtcacccaggctgcaatggagtggtgttatcatagctcactgtaacctcaaacttctgggctcaagagatcctcctgccttggcctcccaagtagctgggactacaggcatacattaccatgcctggctaatttttaatattttttgtagatatagcatctcactctgttgcccagactggtctcaaactcctaattcaaatttagaatagagtatgacaattctgtaaaatataaaaaacatgtccactccgtataggaagttatacaatgagaagaagacaaacactatttacattactcttgataagttttttacaaagaaataaaacactttaatttctaatgttttaaattctggtttgctaaataaataaatattagttttagtgtttttaaaattccttatatagttataagtgatcttcctgcctcagcctcccaaagcactgggattccaagcaagagccactgtgttggggcccttggaaacagatatgctgaaatcttttcttgtggatctacacccagaagagggattgctgggtcatatgctactctatttttaatttttcttttatttttagtgaatatgtaataattgtatataattgtgggatccagaattatatttccatacatgtatacaatgtgtgataatcaaattagggtaattaacatatccattacctgaaacatttatcattcctttgtggtgggaacagtaaaaattaaaaattctctcttctagatttttgaacatatgcaataaactattgttaagtatatcaccctacagtactacagaatgctagaactcattcctcatatttggctccaatttcatattctttaaccaacctctccatatcctcccctccctcttaccgttgtcagcctctaataatcataattctactctctacttctatctcattgtctttgatttagaatatgtttcataatttaaccaaaggtcaaattcttaggtactgctaaggcaaagaacaaagatcgcattccagctgttagacatttcttactactagtcatttttaagacaacatggggtgcaggtggtgaggatgagagatagagattgaaacatattctcttaaatatcagctgttctcactctgcatagttccagcacaaacaaattccaggtactatggttagttaaataacaccagccactaacaacacaattcaaatttctgttaccacagtataccgaaagtcattgcataaagtacaaactttgctgctaactcttcagccttcaaatcattacataaataacagaaacccattataatcagtgacaaaaccacagcacttctttcaaagctttttggagattggttgcttcacatctgttatgcagttcatacagacagcaatgcccggacttgtgtggccacattgtctcccagtggtgagcccatgtgatgtttcacgaaaatgcgcaatcaaaagaggaaactggccagcaaagatgaaagagtagcaaacaaaggaagtgaaacattctggaagtaaaatttgaatcaaacataagttgatgtatacaggaagtagctaccctgaggatgttgtcactgctgcaattcaggagactctaaatatgcagtcagaggaacgtagtgaggtgaaggtatccgtataatggggaaagaggttgtgataaagagtgaaggtgtcccagaggaagcgatgctgaaaaatacaccttatgttaaatacactgtcagtatatcatgacattaaagtgcaaatgataacattttgtaaactgatccaaacttaaaaaggagtatgataattctgtaaaacataaaaatcatgccgattccataaattatacagtgtgaattacactgaaaaatccaacattagagaggatatgaatacaattttttacaagcataattttaataatacacataataattatttgtattcaagtttagtaatgttcaaggtttggaagaaattctgatcctgtgtagagaccctagtttgaatgtgcttatagcctattattacatgtgtaatgttacataaattacttaactcggatttttaatttcatcagctatttaaaatgggcataatataactatattaaatggctgttatgaagattaaataagatgatatgtaaaatgtgttttttgtttgtttgtttgtttgtctgtttgtttttttgagacagagtcttgctctgttacccaggctggagtgcagtggcacaatcttggctcactgcaagttctgcctcccgagttcatgccattctcctgcctcagcccctcccaagtagctgggactacaggcacccgccaccacgcctggctaattttttgtatttttggtagagatggggtttcaccatattagccaggatggtctcgatctcctgacctcgtgatctgcccacctcggcctcccaaattgctgggattacaggcatgagccactgcgcccagcctaaaatgttttttttacataatgggtgttcagcacatgttaaagccttctctccatccttcttcccttttgtttcatgggttgactgatctgtctctagtgctgtacttttaaagcttctacagttctgaattcaaaattatcttctcactgggccccggtgttatctcattcttttttctcctctgtaagttgacatgtgatgtgggaacaaaggggataaagtcattattttgtgctaaaatcgtaattggagaggacctcctgttagctgggctttcttctatttattgtggtggttactggagttccttcttctagttttaggatatatatatatatttttttctttccctgaagatataataatatatatacttctgaagattgagatttttaaattagttgtattgaaaactagctaatcagcaatttaaggctagcttgagacttatgtcttgaatttgtttttgtaggctccaaaaccaaggagggagtggtgcatggtgtggcaacaggtaagctccattgtgcttatatccaaagatgatatttaaagtatctagtgattagtgtggcccagtattcaagattcctatgaaattgtaaaacaatcactgagcattctaagaacatatcagtcttattgaaactgaattctttataaagtatttttaaataggtaaatattgattataaataaaaaatatacttgccaagaataatgagggctttgaattgataagctatgtttaatttatagtaagtgggcatttaaatattctgaccaaaaatgtattgacaaactgctgacaaaaataaaatgtgaatattgccataattttaaaaaaagtaaaatttctgttgattacagtaaaatattttgaccttaaattatgttgattacaatattcctttgataattcagagtgcatttcaggaaacacccttggacagtcagtaaattgtttattgtatttatctttgtattgttatggtatagctatttgtacaaatattattgtgcaattattacatttctgattatattattcatttggcctaaatttaccgagaatttgaacaagtcaattaggtttacaatcaagaaatatcaaaaatgatgaaaaggatgataatcatcatcagatgttgaggaagatgaggatgagagtgccagaaatagagaaatcaaaggagaaccaaaatttaacaaattaaaagcccacagacttgctgtaattaagttttctgttgtaagtactccacgtttcctggcagatgtggtgaagcaaaagatataatcagaaatataatttatatgatcggaaagcattaaacacaatagtgcctatacaaataaaatgttcctatcactgacttctaaaatggaaatgaggacaatgatatgggaatcttaatacagtgttgtggatatgactaaaaacacaggagtcagatcttcttggttcaacttcctgcttactccttaccagctgtgtgttttttgcaagattcttcacctctgtgtgatttagcttcctcatctataaaataattcagtgaattaatgtacacaaaacatctggaaaacaaaagcaaacaatatgtattttataagtgttacttatagttttatagtgaactttcttgtgcaacatttttacaactagtggagaaaaatatttctttaaatgaatacttttgatttaaaaatcagagtgtaaaaataaaacagactcctttgaaactagttctgttagaagttaattgtgcacctttaatgggctctgttgcaatccaacagagaagtagttaagtaagtggactatgatgccttctagggacctcctataaatatgatattgtgaagcatgattataataagaactagataacagacaggtggagactccactatctgaagagggtcaacctagatgaatggtgttccatttagtagttgaggaagaacccatgaggtttagaaagcagacaagcatgtggcaagttctggagtcagtggtaaaaattaaagaacccaactattactgtcacctgatgatctaatggagactgtggagatgggctgcatttttttagtcttttccagaatgccaaaatgtaaacacatatctgtgtgtgtgtgtgtgtgtgtgtgtgtgtgcgtgtgtgtgagagagagagagagactgaagtttgtacaattagacattttataaaatgttttctgaaggacagtggctcacaatcttaagtttctaacattgtacaatgttgggagactttgtatactttattttctctttagcgtattaaggaatctgagatgtcctacagtaaagaaatttgcattacatagttaaaatcagggttattcaaactttttgattattgaaaactttcttcattagttactagggttgaatgaaactagtgttccacagaaaactatgggaaatgttgctaggcagtaaggacatggtgatttcagcatgtgcaatatttacagcgattgcacccatggaccaccctggcagtagtgaaataaccaaaaatgctgtcataactagtatggctatgagaaacacattgggataaatcggctgctatcataatcattcctctcccacatcagataaatgaattaactttttgaatagggttatttaatataaagtgcttaagtctaattatgagaagaaataagataattacacttcaatggttaaagagagggagaataatttgcatattatgcctgatgtaaaatgtttattatgggtacatattaagtgctaactaattgttaattgttcttgctacaagtcttaatgcagggaaacaagaaattattacatagtacctaatattatcttctaatattaaagaaacaatttcccctaaattcatcccattagctttttttttttcggtggggcaggggagaaatacagacttcagtaaacttgggctgggaactttctacctacaaagttcaaataaaataaattatcctagttagataatatcaatgaaaaatccaccaacttaaatcctggctgtttgatctcaggaaattatttcagttatcaacttaatgcatcatattatagaaatatatgaaaatgtgtttaattaaacttactgaatgatatgttttttaaggtactttaaaaataaactatgatataaagttacctatttttcatgcaagtatagtataaagaaatttctaacactggagattttctgaaggttttgattcttataaatttattacatcataatgaacaaaactaattttcaacatattatgatttaaatttccttagtaaattgttttaaatttattttctttaaatccatatttacatatgtatatttaaatatacatatttacttgtataacaattcaaaaccatatattaattttataattttgtttaatgtcaaaggttagatttggctatatctattctaaaagttggtatcacatttcctttttggaattttatttttaaagtagctaaagtcaaatataaacctattatttatattaatgcagacattagaggtagacactaaattcgttttagtatattctaaattatttattatctactatgaaataatataaagaaaaataaagcagaatccctgatttcaaagaactcaattgccgaaaaacagttaccatttattagacccaaaatgtactaatatgagtgtgtctcttttccttttgttttgtcacccgtcatttggaatgtcagtgagtagagagatagtgtgaaaggccctcaaggggaaaaatagaggttaaaggtcagcagagaccctactagagaaatcagttctacagaaatgtttttaaatgtgtcgattattgctacatgtacactctgtcattttgtaatgtagccattttatttatgattataataataaaacaacaaaattataataatgtgtagagtacattttactgtgcagtgtattgcattaaaactagattaaaatttatacatatataaaaggctatctagatattataaaatttatggctggatctgtaaaaaattcaaaacctatttttaatctcgctttgagattttataacaagaaaatgttcgtttcaagcaaaattttcaattcacgtccttgaaaaggaaaaaaatgacaacttgaaacacataattgactatttttaaaggatcaacatttcagaaatgttttaaaacataagattttcagtacagcttttcgctggcatttaaatcgaactttgaattgtaaatagctcttgctcttaaggagacatcagccatatccttagaagtggcacggagttgttaggtagttgtacaaaattctagcctaaaagacaaatagggagcaacactactgtggaccgtttctggtcttgggctgtgtggctatgtcaggcttgcccacattgcctgtactaaggagaaagcctcttgtccttacagacccccttagcttacatagtctatttgaaaacaaattgctttgtccacaccatttaaatattggcttcaggccaggcgcggtggctcacgcctgttatcccagcactttgggaggctgaggcgggcagatcacgaggtcaggagatcgagaccatcctggctaacacggtgaaaccctgtctctactaaaaatataaaaaaattagccgggtgtggtggcgcgcacctgtagtcccagctgctggggaggctgaggcaggagaatggcctgaacccgggagtcggagtttgcagtgagccgacatcgtgccactgcactccagcctgggtgacagagcaagactccgtctcaaaataaataaataaataaataaataagtaaatattggcttcttcaactggtgagatgaaacctatacaatagtcatgtgaatagcactaaacagctgacatggtgtaactcctctcagactgaggcttatctggggagtacaaagcatgtcaagaaaatgtgccttcatttccttagatgagtgtccccatcctccactctcctccactgttctcctctctgcttctatgatatcaacttttttttttctttagattccacatgagtgagatcatgtggttgtttgcctttctgtttctggcttatttaactgaacaagaaagtttttgacatgaaattaaacttctgcttgtaaactcaattcaaactatttacactgtcttctcaaaaatgttaacttattttaataaatctactgaatgaccgtatctcattttgttttatgaaaagaaattgtaagggtgctcaatagcctcttcattttcatactgtctagctcctgtgctcctattaaaattactgcaaatttagctttttaagaaccctttgtttcactacctgaagttctataaaaagatccaagttccttcacaaccgtttcttatgctgttattcgtacatatgtgataataccacgtctgaacacgtagataataagtaggggctgggtgcggtggatcatgcctataatcctagcactttgggaggctaaggcgggtggatcacctgaggttaggagttcgagaccggcctggccaacatgatgaaaccctgtttctactaaaaatacaaataataataataataataattagccaggtgtggttgtgggcacctgtaatcccagctactcgggagactgaggcaggagaatagcttgaactcaggaggcggaggttgctgtgagctgagattgtgccattgcattccagcctgaacaacaagaatgaaactccatctcaaataaataaataaatagaagtatgtattgtgttgcttagaaggtgtggtggaaattaacttgctgagtgagatcaaaggattggcactgaattgaaataaagaaatattcatgctgagtctggttcaaatataactgcacctgtaagaattgctttctgtaaactttccatagtataaaccaaatccaaatcactcatggctttacattcctgatcgttaaacttgaagcactttttaatactgcatgactttagccaaaatatcttagccaagattcaatgtttggttgaaccacactcacttggacatcttggtggcttttgtttcttctgaccactcagttatctatggcatgtgtagatacaggtgtatggaagccgatggctagtggaagtggaatgattttaagtcactgttattctaccaccctttaatctgttgttgctctttatttgtaccagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggtatggctgtgtacgttttgtgttacatttataagctggtgagattacggttcattttcatgtgaggcctggaggcaggagcaagatacttactgtggggaacggctacctgaccctccccttgtgaaaaagtgctacctttatattggtcttgcttgtttcaggcattaacccagataaatgccatgcaaattttataattattatgattgtttcaatttctggaagaaagttaatgaaacaaaaaatgtagtaaaatgccaaaggaacagtgacatttcagaaagaatgagggctttcatgttaattgtaagtcttggaatttctcttccttggagtaacaaatccctttgtgcctaatttcctaatttccaaaataaagttcttttacttatttctttatagtgacatcatctcttattaaatggcatatctgcatattacataacagttcattgccaaatacatatttgtgggaaatgagagacttaaaatacataccaaccagagatatagttttgaggtagattttaaaattctgagaagaattttgactgaatttttttgacaaacatgggacacgaataagattataccaaagatattataactttcattttaaatatggaactaatacagtatgaggtgtcaacaacgttgaagtttcacaaacatcaccactacaacagcaaaataatttttgctttttccctgccacaatgacctccttgctatttcttgaataaatcaagcatacccttgccctgacacgttcttggggaggcctgccctaatctatataaaattggagccattcttctcacctctggtattcccagtctccctactttttttccttctttctttctttttctttttctttctttctttccttctttctctcttttctttctttctttactttcctttcctttctttcttttcccttccttccttccttcttcccttccttcctttctccctttctttctttctcttttttctttcttgcttccttccttccttctttccttttctttcttttcccttccttcctccctctctccctcccttccttcctccctttctttctttctcttttttctttcttgcttccttccttccttctttccttttctttctttttcctttctttgccaaagtgttattcacctttaaatataatacataatgtgcttactttaatgtatgatttttattttatttctcccttctagaatgtaggcaccatgagagtgaaatatatttattttgttcattgatatttcacaagtgtctgggagagtttccaacttacagtagacaattaacaaacatttattaaattaaggagggaaggaagtgagtaagcacaacaactttcatttctgggtcttttataatcatatgcttagtataagaacagtgctattcagctatccaaaagttacaatcaaaatgattttggatgaatatcttgaaaattgtgagaaagaagttttatttgctggcaaactattactgggttgtttccacttcatgtaatcctaagtagcagccttaccttgatagcccattaaaactctgataataaaaaggcagaacaaaaatatctgtgatatatttagatttactacatgtacttacatgtctagtgtctggtgcaatggatgctaatgatggcaaatccttactgggcttctagtgaagttcttcagctaatgtttgaatgcatggttggtcatggtggtacccctttgtacaaaatatgcttttcaaataatcttattagggataataattatattaattcctggtttccatctaaaattttaattctatttatagcttcgtaagatttcacaagttaagagggacctcagattaaattagtacacaggcaattaatcagttttgtgtctccgacccttttcacgggctaatagaagctatagaccctcttagcttcagaaaaatgcgcactcacatacgcacatcaaagagcttaatgggaagtccattgacagaccctctgttcagatcaatcttctgattgtagagatgaggaaacagaaatctacagaggaagtgggtagtccaagattgcacagtcatttggaatagactggacaccagtagtacttttccagccactatatcacttccccaagcacttcctcaaaacttaccttcctttgggtctttatacattcagttatggacaactagatttaactagaggattttattgcttcagaatattaagcaacagggaaacatgtaccgtcttttattcacctgcatttaaggcatacaatataaattgcaaatggagcatgaaagtgcttaatcttttacaaaactgggtttgctttccacccatctaaaaatacttctatttattttaatatttaaagcagaaatctaagtgatgtgacaaaattaatcatttggagatatttcccttataggtagtatagtttcttactgatttctaatatgaaaatgaagccatagaacctagaaattgcagcatagttgtggaaataaacattggactgagagtgaaaatggctagtcttcctctctgctcatacaccacctgactggataaccttttgcagatctcctaaaagtctttctcataaaatgaggaagctctactagaaaattgttgaagtctaatttagcaataaagttctgagtttctataataattcaaagaatactctaataaatgtctgcaattgtggtcacatctatgggatgctaaaaaatctggatggtttcaatgaaagtatttaatttgttcattatgaactttgaaataatttatttcattttttaaactttgatcaaaatgaccctggtaaatagaaataagcaaactctttttgcttgaaatgcttattaatgactgcattgagacactcattcatcattcaagaaagaatgtttgctcacactgtgccagaaacttggaggaagagggatgtgacaagtaggggtactggatgtctagcttgtagaagtggattaatggctctgcttttaagatcaggaacactgaaagggagtaatggcaccggttttcacctttcatgccctttgagggtatctggtccatcaccctctagttgatgagggagggaaagttccctctcccttcacaaataggtggaaattaaatgacataattctgaacaaccaataaatcgagagtaaatcaaagcagatacctgttttgttaatttgatcatatgaatgtagctgcccttagtaataatttctaagtataagactagttaaaggacaaatgagttatcttgaattataagattttgttttacagaacaatattaactcttgtgtttagtacattagaataatagatcttttgatccatatttttactcatgtgcacataagaagttatcagtcatacaattcatttcttgaagttcatacctttcattggcagagtagaaacaggttaaaagtgcacaggcagaaattttaagtgcaaagcaacagtgatgttatatagagaaaatttatatttcctacttctattgaagaagaaagatctgcttgttctaagaatattgtacaaagaaagtgacttgaatcagcgttattctgtaatgctactatgcgtgcagtgtggagtagccactagaacacttggtctatcccagctcctcaacagtgtcttgcttgtggctggtgctcaaataaatccttgctgaactaatgagcatctctttcatgccacatggaatgctctaaaagagttggatcctgaagtttttatatttttgtaattttctggagttttagagagcaaaagtcctgaataaactgtgaagccactgcctgacaaataatacagcagtcagcttcgttatcatatcccattgagacacgacttatctacatgatgattaatagttttcacgcaagaaataagcttgaaatgtctgttgccttggatacttaaaacatccaggttcagcgatgttatttattgttgttcaaaatcagaatgaagttcctaagcaatgccattttggaaaaattacatcaatatattatgaacaactttttttaaatcttgatttcaaatggattgacacgtgtatattctgtaataatcctgacttaattcataaaaggatagctagccagttgtgtgctagatgaataaaaaaaaagcaggttttaaaatgtcaggtttgacattgtgaatataatatctaagtatccttttactcatttcctttgacttactatggctgtcatgttgggcttcatgaaaatttatttttaaacacttgagtgttatggaccctctgattaaatgattaatcagatgatgtatgttgccatcagctgaatcatttaatgttgatttcacaaacaagcacaggtcacaggcaacatttcagatttctttgaagaagcacacacaggtcacaggcataatcttaaaataattttataacaaggtagtaataagagatgtcaggactggagaaatattttaatttatagtaagctttccccttaagtgtctaataattgttaatataatacattgcctcaaataattaaaagtttggttcttgtccttgtgcttgacttcagaagataaccagatgactattaggtatatttagacctaaattaaaagctttgagacacaatgaattgcctgatttgtatttgtgtttcgagtggcatatactattactggcactataatcttagattaaagcatactgtgattattaaagaaaaatttaagattgatttgtttctaaaggtatgtaacagtgacattttgcaatgtggtatgtaaaagttggtatttctcactcatatgagagcccactaatggtacataaactgtccccacttagaaacacaattattatggcctttctttgtatctgacaaaatttcactgggttcaagatggatgaatagtgaattctaatgacccttaatcctgtaaggttctaggtgggaaagtactctgtaattatgtataaaattataaggaaaataggcttactgctatgttttcattaaaaatcattaactgagtacttaatatgtgccagacactcagctgggcaccatgagaaatacaaaactgagtaacatatgggtggctcctgccttcaagaaatgggcagttcaggccgggagactgacatatttaccctgggaaaaagggagcagctgtggtctctgagaacaatatggtttgttacaagtatatatccatcatggaaaaaaagagatttatcttagaaatgagagaggctgatgctctcaataaatatcatacattaaattgtgtttttgtcagtagactgaaattacctcacatacacgcacagatagtagccatgatattttagctgcttagatatagagacaaatacttccacccaaatcttaggatcagtggttaatagtctgtaagcattacaatcccacaacatatgcatgactatacatccaattttaatattcaaagaactgattgcgatgatagttttgtttgtcaaagaaatgtattataggatgagtgggatagaactgcatcacgttacaccaacaaataggtttaaatcatatttgtgcacttcccttgttccttcataaatgtttaacatagcttaaaattctgtggactgcaacgtgagagcaatgaccacacttctgtgaacccatttttactgtgcatgtgctaacgtctattgttagtattccttcacttgcaaagatggcatgataattttgctggtttcattaatgagatactgttaaatgtaggatgacttcaaacttagttgtattgtaaaattatttttaattgtatacatttaagttgtacagcatgatgttttgagatacttatctttatttatatatatatataatatacacacgtatataaaagtgattcctacattgaagcaaattaacatacccatcatcatatggttatctttgcttttttactatcagtgcctaaaatctactttcttgaaaaattaccagtatgcactacaatattattaacaataatcttcatgttgtacattagatctttagacttactcatcttacatgacttaggtttgtttttacctctactaccatctgagccatatttccactttgtaatttgataataaacttggaaaaatagcacttatatgtttaggtgacgggcataaataggataagatgtgtttatatattattccatatatcttgtctccaactacaatgataaacaacctgtttgtccctaaaaagtaagaaataacttgacttttctgccccttcaagcataggctgttagcttttaagttttagggagacattgatgatgctatttgctttatcaagaggaaattgtcaaaagaggtcttttggttctcaaactattcaaagtatttaaaaatcaggacaaaatatgtttacgtgatattcaagggtacagaaatgaggtaaatgagatgccaattgtatttgtcatgcaaatatataattacgtgtatgagagttagatgatacatctcatcaatttaattgttcttctacaaggagaaaatgaacaatttgtcaactcgtatatgaagtaatttttataagaaattttattaaaacttttaacaacatttggatttttaagttgcaatttaaatatccccttctaccaggtgattctggaatcactaagcagttacttgtgaaaattccaaagtagcatttaattcttattaatgtcatagtgaatactaatgcaaagaatactgagccagaaattatgcttgttgaataaatagattatttattgaacaagtaagtgaaaaaatggaaataaagaacggatatatattttatcttcctgcttagatgtgggactgtcctacttttctctggtgttcacaacaacaatatgataaatctaattggaattcagttcataggaatgaattcagttacattatggattgtgatgaataatgtacacttttaatttaatgaaatcaaatagattttaactatctatgcttacaatggggtgacataagtctgacaatccttaatatcaagtcatctccaattcacatgtatacacactttttttctatttggctattgggaatcctcacaaaaatcgaaaattgccctttcagtgtacgttacggtatttcatgccacacagattttctgaggttgtacatacagctttgccttgaggttccaatttttgctcagtggattgagtatatattatttgctatatatcagaagaggcatgtgcttcctacttatgtcacgtaactttgggattaatgtaattgtcctacaaagcatagatagatagaaatacttcatccttaatttctaatattatgacatatctaaagtaggcacctttaaaagataatctccactaaatacgaatgactgcttatagtggcaattcatctttcatggtagtcctcctacaaaggtatactaacatttatgagtttgaaacaaaggcaattcacaagtgttctgctagagatggtctatatctgctgtttgatccagcatgatggccagctggccctcctgtgcatgacggctcgtggtttaactgcaccattttgtttggtcatatacagggaaaacatggcatggtgtggagggcatgggcttgaattcagggaacagagagttggtcttctctctctcactctactggatgatgtcatctcccctctctaagcatgagttttcttatctgtgaaataaaaatgttgaattaaatgagttcaaaatgctttcagtctgtgtttaatagcttgaatcttaagacaatgtattcaattatgcgttgccagatccctggcaactcatgtaacctttctaaaccatagctactcatctgtaactggccagccaactgcccagggttggagtgtgaatgaaataagataatgcagacaaaagatttttaaaaattgtagtgcattatacagttgtaatattttgccaagaacttacattttctctaagaagtgtgtcgatacatgatcacagaaaatcttttccatattcctttgtagtttgatgatattaagtaagtaaattgtataacacaaagagggaaaagcatcactgaacatgccgttttatttagctaaataaaatgtaatcactattagttttcctctgatttccccaaagtcatgtgattccattgagtattatgcacatggtataattagaatggattctctgctcaaataattttgggaaacatttaaattaacaaagtttaaaagtatctctgttaagctgaagcaaatctcaaaggccttaatattgtatgtaagaggaatagttaccatctttcctaatgcctctttgacgccaaacccatggagaatagttctaggtgttcagtaaaacacagatttgggatgccacaggttaattggaactgtcccctgcaatctttttctctttttcttaataatggctgattgcaggtcctagatgaaagacatttagagagattatcaggactcagcatcccatatcagaatccattcttttatagtcattttctgttacatttcttgggacaacaccaaagaaatgaccatcttcattcacataggctttgtaccaaatgctgacaaagatccttggtgacctagatgggggcaggtctaagtagattgcagctgtaaaattggctgatgaatgatctcagccccttttactcacactcaaaggcaggacagtccattaaggggaaggagggcagagtttttccttaggccaattccctatgccagaactttttagaatggaagcatttccagaggagaaacaaccccaagcacagttcaaagccccctcctcccaagttcatttgaaagtgggatggtttatctgcaaagggggaaaagatgagggatagggacgggaatatccctacccttcagagagtctggtttcatcctgcacttttactgcacagccacaaatgccttggggtgaatctacaatatgatacatcatatggtctaaacgtgcctggctgatcctctctaatacttcaggggtctaaaagggataacatgctctcctgttactcaccgactctgtccgccatatttcacccagccagccactgccttcacttccgtccgaggcctaatctgagcccatgggaaacctaagaacccctaccacaactgcctcaactcttgggaatcagggtgtatgggggtgacaggaagtgagcatacattctccaacttgatatgtcagcccccacgtctgtatgaatgtttgctcacactgtgactgccggccttgctcctcaggctgcatcctaccagggagtaagacccaagtccttcctgctttcagacaacaccaagcctcatgagtccccactcagaggaaggaccagagacaaactctaatgttccactaatacttcccttcttattactttccttgaaaatcccttctccctctttctttttatacttcgctaatgaaaggtaatgaaagggtctggcacttggaatttagaattgatacatggtttttaacccgcggacgtattccacaataacccttgcatcttctactaagatgtgggctaggaagggaccagccagttcccagggtcacagtgcctcagctgatgtttcatattttcagcaactttatgttagagatgtccatcaatcagaacaatatggttagagaataaactaataaaagtcatttttgaggacatgttggaagtctatcaaaagcattgaaattatgcatgctctgaccagtcgcatgtctaagaatttaaatatgatcataagtttaaatatgaagatgtttatcacagaattgattataaaacaaaattgaaaaaaatagtgctagaagtttgatcatagggacctcattaaatgcattatggttgatccatgcagtggtttgctgaacagccattaaaatgttgtagaataattattaatggtgtggaaggatgctattgttgcagtatgtgaaaagaacaaattacaaagcagtttgtgcagcataatatttttattttttaaaaacctgtatgtggcttatgtacatataaagacgtggaataaatgcacaaggtactcagtttttctcagtgaagcccattttgcattttgggctgggtaattcttcgctgtggagaactctcattcattgtaggatgtttacaagccctgggccttacctctttaacgccagtaggcacccccagcatggcaacaagcacaaaatggtctctctcatattgcccttgaggaaattttgcaactaagtaactattactgggtcctagattacagtctggattattgcgttcctttcttatttttattttctccaattccctttaataagcatgtactggattcataaaaaaacaacataaatggtaattacaatattccgcactggttaaaacttatgtaaataagcattctgctgctttagccacaattgcaatttatgctccttctctttcttaagttcccagttcccacgtacattcattcgactgattcaaaagtcattttagcttgatagactcttaaaagttagagttatcatttctgctatttattctttcaattatccatttgtccacccatccatctgatccattttgttgatgcatgctgtgtataaaatactacaccagcctggtgcggtggctcacgcctgtaattccaggactttgggaggccaaggcgggtggatcacctgaagtcaggtgtttgagaccagcctggccaacgtggaaaaaccctgtctctactaaaaatacaaaaattagccaggcatggtggcagacgactctaatcccagctacttaggaggctgaaccaggagaatcgctcgaacccaggagatggagtttgcagtgagctgagatcatgccaatacactccagcctgggtgacagagcaagactccgtctcaaaaacaaacaaaaaaaatacaatgccaagcatcataaaaaatatagtgatatataagacctatttgttgtgctctaggcattgacatctagctgtcaaccattaatatgtgtaggagtctatctatcaatattatggactgtgcttgaagacttcttccccaatctttttctcttcccattaagtttgaagtgaggttttctgagtgaagtatcatagtacatacagtctcattatttttcaaaaatctctggttatagtacatttctttcctttatcccctttgttcccaactatcaaaccattttggatatccagtattggtatccagtattattaaaaagcaaaacagagaactattaacaaaaaaatttgtaggagtaattggttgtatggtatccagtactattagatagtaaatcagaaaattattaacaaaaattttagacgaataatggattgtcttgcccaagtgaattgagtgatttagttgttctttcatttttagcaagtacagctgatcatttgaggccttactcattgtttgattttgcaaattcttactattataaatgttttgggctctgagaaagctgttgtcttaatctgtttgtgctgttataacaaaatacatgagactgggtaatttacaaacaacagaaatttatttctcatagctctggaggctgggaactccaagatcaaggcatttgtcttcaggttcagtatctggcgagggccggttctctactcccaagatggtgtcttgtcactgtatcctccagagggccaaatgctgtgttctcacatggtagagagatagaaagggccaactcactccctcaaggcctttcataatgttaccaattccacttgtcagggctctgcccccgtgactttattacctctgcaaggccccaccacttaatactatcacgttggttattacgatttatcacatgaatttcgaccatactagttgccatcctttcattttcatatatccttaaaactttgcctttctcattttaatgtactttatccacagtatgccaacttttcgatacttttgttaacctgtctgacgatatataggaaactgtaaaagtgcagtttttgatacactctttagctgcccgtttacttctactgtcgttagagaaccccatccatagtgcatgtgtttattttgtgtatgaacaaagactttatatatagtttgggtcatttttattcattagtgcttcccttataatctctgaataccattttattagtacatactgctattcttaatagtaactagcatgcctgatcatcccaaatgtctaggttcacattttaaaataagttatatctttgggcttaacagtttattgaaaggtaacaaggattgagtcatagttgtatgtttttggaagtagaattcaactgtaaatagaaattggttgtttagatctcactatatatgaaaaaatgaaggctttaggagaaaatctccccaaagtacccatttttcatgtgataaatatcatgaaatgatttgagaaaaaaatgtatatttgttacagctaacaaatatttgtgttttttattcttcatggagagaatgaaatttcttctcttctttacacatttctttttcttattagaaactaattggtgcctttataaaaattaactgcagagcactaacgtgtatatataagtattatgtagggtgtagggtatgttcagggtatggtgtgtgtgtgtgtgtgtgtgtgtgtgtgtgtgtagctgtgtgtgtatataatgaaatatatggtagtgttgtttcagaaatctgcttggtcttcccagagttcattcatcttataaattcatctacattgatctctatttttggaatccatgaaatgttttttggcagtacttcctttaatatagtgtgctggaaatctggaaatttctagccagattagttacaaaaaattagccagtggttttgcactctctatagaatcaaggcccaaggcctactcttgttactcagggccttgttttatctggcctctttcttttcagccatatagctctcaaatactcaacaaaattcttcattctaggtagacaagtatcttcaaaatacttcccaattatctaataactgtcttaccactaagaaggcttttatgtctcctgtctgaattttatccatgcaaaaaagtccagcccaagcctccagaactccaaaaagttatccctaactgctgaaacacagtaatttcactatgtgaaatttcactttggtctcctagcatttgcagatataccatacatatccttgatccttttcctttcataccttttatatctaacccttaagctaataattttacctacactgtaattcaaaatgtatccccagtcttaccatgtctcccttctctactgttaccaccctaggctaggccttcatcatttctcacctggactccttccctaacctctgaactgatctgcctgcttccacttagacacccaacctagtccattcttgagcagtcggaataattcttttaagaaagaaaccagatcacatccccctctgctcccaaccatccagtgacctcttatcatacatagaatgaaatgcaaatctttactgtgttttaaaggccctacattatctggccctcagtaacttcttacttcctatcccttttctccttgtatgccaccctccaactacactctaactacactgtctttttccctgttcttcagacctgccaaccatattttcactgctcaattaatatgtagaaaatgaattgtttgttaaatgtagactgtttccttcttaaagcaaagataaatgacattgtcttcaaaaacaactaactgcccagaattcctgattttaattttaaaaagacaaactgcaagaatgtgttaaacagtaaggaaacaattcactacttcagaattctatatgatttcactgcacgttagtaattttgtatattatagaatatgagggtattctaataaacttaactctatgctgtatacttatcatgatagctcattttcttatatgtttataacagcactacttattgtacatggatacgtgggaaataaattaattttctccttaagaacaaagcaaccatttcactcatgagataaatcttgaagatttaaaaactacttataattaattatacattattcatataatgttaagtattttcttagtaaaccacataatttagaatggcaattggacagatgggcagaaccacatgcatccactattaggcagttggtgagcataagatgccagaaagaagattaggaatatcaaggcagggagcttccgatcgctcttgaaaacattgacccttcactcctcactctccacgatgcatttcctttgaaaagtaatgccttccaaaacaaagttctctgttttatatctaaacttactcaatagtttctcatggttattgatatataaaaaataaagtaaaatgtttaggcagaccaaaagaagaatttccccctccctctgccttttatgccaaggtgacagctatgaaatgtacagtacgtttcctctgcaaggaatgtagcagtgttccattgcaagaagatgagagggagagaaaggttgcacgctgaggaatatagtgtcatttgtcactgcctagactcatcagctgtgtggaactctgagaggcaccaggcttctttatttatttcttcagaaacttcagcaaaaaagatttcattaggagcagagaaaaatgtgaaaaacgaattagcttttgtgatggggagtagtcatctctgaatattgatcaagattaagagggttgtcttcgtaacttcttttatccatagtctatactgatttaactagaaaactaatttcaggtggtatttcgggtgtggcagatctttatagtaaatgaagaatctagtcaaatctactgaaaaactctgcttactttaatgtttgatctggttgaaaccattttagcttaacaatccttcctctgaaacagggaatcaattgatatcctacagcaaaattatgtggaagggccattagcttcacatccaatgcaaattttgcctgtgtttactcttccccaatccaaaatatatcagatcctagatgccagtgaaatcgtttgagctagatggcttgagggtcatagcttttttcatttcctgttctcagacctcttataattgatagaataaaatcagaagagccctagagctgtcccacctattctgcctcacaaaagtagaagtaatggcaaccactatcatagggatcatgctcacctttttcttaccagacaaatttggatattagcttgaaattaataccttccttaaaatgttggaatttggttatatgcgaaattttgctctatttattcattatattttgtatggaattatttttgccctatattttcacttaagtgttctctacccaagattttaattgaacccaaatcagccagacacacagacatggattttgctgccaccaaggttaattcttcttttaaagttaacttttaaaatttggtaaaatatagctttgaaaatttgcattcgtctagtgtttgttatgtatttcccccttttgtttgattatatgtctatatttttcttgtagaaattgatttttaacctgctttttatgttagcttttatgagcttctgtctgaattctgaatatgtctttcttaatgtcttctaaatgtttctttctggattattaaaagatttattaggcttttaataattatatttgttaccttagggaatgtgtttgaaaatattttaaatggaattgccagttaacacagcattgaactttttcttgttagagatacattgttttctaggcattttattgggagagaagttagtatgatataatgtctttggctgatattaactcttctaagatgcattgtttctgagaacaccattgtctgatttcattcagggaaatttcacacaagccagtagagtcaatacttttttcaagacctgttaattgatatatataaaaacttgccattgtttacatgcccatttcagatcctttatgtgacctaagctagaaatgcattttaacagcatttgtttttccaaaaatatttatttatttatttattatagagacagcgtctctctatgttgcccaggctggcctcgaactcctgggctcaagcaattctcctgcctcggcctcccaacagtgctgggatacaggtgtgagccattgtgccaggcccttgtttttattttttttaaacattgtattttgaaaggggtttgaaggtgatccctagatagcaaccagtaatgattcgagcagcaaaacaatctaaaaagtaattttataagaaaatgcagaacataaatgagcccataaaaaattatattaggttctatttacattactaccttctttcacatgtaatatttcactaacatttaatgaatttctgtgcagtgccatataccattatgaattctaggatagaagaatgagtgagaaatgttcttaggccttaggaagaaggaacaagcatctctgtgtaatagttatttcaactcttcttttacacctcattcccatattaaatctcagaaaagctaaagtaatagctatcccagatctattttagactccagacacttacttcaatgtcttgttctccttatcagactggaatcattccaaacctcttaacttctgggcaaccatgataatgcgacagaaaggacactaaatctgtcgcaaatttatcttgatattctatccagtcttacttggtactgaaggtcacaagtaaaataaggtggttgttttttgtttgtttttttttttttgacagaagagaaaagaacactgtgagcacagagtgaatgtctaacattgattcttgagtagcaggaattctctatgcgagaggatctctatgcaaaaagatctcatattctagcacaatttaaggatctctatgcaaagatatcccatattttagcattatcaataagctatggggtaatatattgtatgtggtgtggcttgaattctagaaatttgatttctagaaatggtccctgtagttaaggatatataatgtggccgtctccagttttctatgaggaataggaaaatactatcattattagctgtgtgaccatggacaacttgcttcgttcttcagttgcatcatctgtataaaataagaataagaaaatttacatctgcaaggtgtgatggagatcacatgggataattgtggtcccagagcctggcacaaaagggcttaatatttataatcctccccatttctccgtatactctaaaggaagtttattgcttatcaaattgtgccgtggttagttgtacagcttccctgccaaattgtaaactccaacactaatgtgacgttacattttatatagtgctatgattttcaaattgtttgcataatttcaaatacacagtaaattgctttttattagtataattattgctattgtcaatattattattacaacagcttcacagtaagatgggcagaaaaaaatttaatttccattttacaaatgcacttttgaggctcacagaagtcaaatagaccaaagtcacagggctagtgagggacccagaagaaacaaattgtaattcactgattccaagttcagtggttgccttactgcatcataaaggctattacacaatccaggtgtatcatatgattcttgtctatatattcatacatatcagaaaaagtgttctactcaaaattgctagcaatcaacagatactgatagtcattagtacttaaatctttatcaaatgaaatattaatacccatgaaagagaggacaatgaaaggtttgtatcatttgtatgtcacaagtcaacttttttcaatcactcattattagtttaactgtaaaaaattatttacatttagcgtgaaactttcctgtattctcaacatatttccttcggtagaaaagcaaacctccagttctctgttctttgcttggatacttgccagtttgtaactcagctatcaaacagtaaagctcacaaaacacttattaaaatgactaaaatccaaaacaccaagagcacagcatgctggtgagatgtggagcaacaagaactttcattcattcactaatgctggcaatacaaaatggtacagtaactttggaagataggttgacaatttcttacgaagctaaactatacttaacatatatatttgtccattttcacagtgctaaaaagaagttcccgagactgggaaatttataaaggaaagaggtttatttaattgactcacagctcagcatggctgaggaggcctcagaaagcttataatcatggtggaaggagaaggggaagcaaggcacctacttcacaaggtgacaggaaggagaatgaatgcaggaggaactaccaaacacataaaaccattagctctcgtgagaactcactcgttatcatgagaacagcatgggggaaacagctctcatgatctagttacctccacctggtctctcccttgacatgtggggattatggggattataattcaagatgagatttgggtggggacacaaagcctaaccatatcaccatatgatccaaaatcatgctacatgatattcacccaaaggaaatgtaaactgtgtccacaccaaaacctgcacatgcacgtttatagcagctttattcataattgccaaaacttggaagcaaccaagatgttcctcaataggtgaatgaacaaaaagactggcacatgtactcaatggaatattattcagtgataaaaagaaatgagctatcaagccacaaaaacacatggagaaaacttaggtacgtaagccagtttgaaaggttgcattctatatgattccaatatatgacattctgaaagagacaaaattctggagacagtaaaaagatcagtgattgcctggggctctgagaaagtgcagagggatgaatgggtgaagcacatggcatgtttaggacagtgaaactattctctatgatactgtcatggtggatacatgaccttatacctttgttaaaactcagaattttacaatacagagtgaattctaatataaactatggactttagttgtaataaggtatcaatgttatttcataagttttaataatgtaccacactaatgcaaaattataataataggggaattgggggaagggtaatggagtatatgggaatgcactgtaatctcagtacaattattccacaaacctaaaacttctttcaaaaatacaagctattggtcaggtgtgatggcttataccagtaatctcagcactttgggaagtcaagaccctcagatcacttgaggccaggagttcgagaccagcctggccaacatggtgaaatcctgtctctactaaaaatacaaaaaaaaaaaaagaaagaaagaaaagaaagaaagaacagaagaaatgaaagaaaggaaagaaagaaagaagaaaagaaagaaagagaaagagagaaagaaagaaggaaagaaagaaacagaaagagagaaagaaagaaagaaaaagaaagaaagaaagaaagaaagaaaagaaagacagatgcggttgctcatgcttgtaatcacaactactcgggagactgaggcatgagaatcgcctgaactcagaaggtggaggttgcagtagggtgagattacgccactgcactccagcctgggtgacagagcaaggctctgtctcaaaaaaaaaaaaaaaaagctattaaaaatatgtaaagctcagtctagatacagtaccagaatagtaggaactttatttcacctgtcctacaaattatggttgtgtgccacttgggtaaaactcagaatccaaatatgtgaatgtaagatttatggggaaattatttgtatttcaaaataatccttaatgaatgcactccttctaaagtagccattaataaagcagttaatgtttcatttaattatagattaatgtacataagatatgccaggaatgcaattaggaactgggaagggggtgttattctaataacttccacatagcattgtgagacattttctgctttcttcaaatttcatttaattacattttaaacaaatatttttgtgagcctattatatagtccttcgctagcactgaggagacatgctttgtgaccttggtgatttcacattcaaatttccctttcacctacactcttccttgttttttcatgcctgtgtagattgtaaattcttcctcagattaagacattttattcacctttgtaacatccacagtatctagcacaatcagtgccttcaaaaacaattggcctcaagaattgattgactcaatgagtgactgaaagactaaattaataagtacacatctatttgtacttccctgcttacttataaggtatgacaatgaaatactgagacagttatacattacttacggactcaatctcatttctttacaatctctattcttcttttttgagtataatgttattttacaattccactaacttgtcactctttattataaattcatatctccatttcacctgagaataataaaggcaaggaagtattttaaatgatcttgttttttataactagcattcattgagcaaatcaaagtatgaaaataatataggtgtcagtgattattataaagttgtatgcacaaaacattccaatgattggggccaatacagagaaaacatctcaatatttggaattttgcttttctgtaaatactttgatatgtacttacatcatatcaattataactcctgctgaaaacaaacagtgcacacaaatttggtagttggaggagactttataaagggactaattacgaaggtttagaccgggttaggaaaaacacacggaatagtgcaatactttaggatggcaacagcgagcaccgttataaccactaggccaaaatgaactaaatgaacagggagattaccatttatcagaaaaagagggagaaaggaaggagagatgaccaagcaagtcctatgtgaagacggctgcctgacttgagctgtgtgatctttggactgataccacctgcctgcactggcctagcagggcgagaatagtcaatatctggaaaatggatcacctgaccttactttcctccctccctgtttcctctttgtggtgtttccactggccaaactcacagcgtagacaaaaggagtgcattgatgtagcagtggttctaatccagggccaattgtgctcccagggaacattagtggttatcacagctcaggggaggaagggagaggagtggagtgctactatgattcactgagggatttttttaaacatctacaatgcacaggacatccttccacaacaaagtatccagttaaaaaatgtcattactgccaaggttgaaaaaccgtggtgtagtcagtacaattcatcttctccaggcacagtgcaggagtggggtggagtgtctgaaggggaagaaggaagaaaccagcacaccccacaaaagtaaccaatgcaaataccaaataggaaaagacagcacttaaaatacaaaagtctcaggaatatatctgatagtgttttatggaatttattaaaatttagcctggagtgagtaatatttagcaagccaggtttgtctttagagaaatccttgtggggtttatacaaggatttattaacaaagggcacacacaatactcatattacagtcagtctggttatgtaaaacatgggcaagaatgtaataggacaatgtgatgtattcacaaaggattttaggactacacagataatcctctaatgctttcacttacgtactatgaaaggctatagtttgcatagtgatatagccacgtaagatagtaaacttgacattcatgcagctatacatgtttgcacacaccaggatgcatgccctttctacctggttgattttttattcttttattaatctctaatttattccccagaacactctccataaaaactttctcacaacttaaatctttaatctattgtgtggatttctgactcattctccaagcttttcctcttccctccgcaatgccttatagtcttatgactatttatccctttgcctacatttctagccagatctcttgcctgatacacactctcatatttctctttgcacgctacacatttttatttagatatcacactactactttgatttcaacaggtctcagtttaacttaatttttccttcaagcaaggagtcccttcatatcagttatcaccattggcaccagaatttttcttatgacttcccatgacctacaatataaaccatataaatcactgatgcctccatagttccctccctctcaaatttagccataagatgattttaggatccttgttttttccaatctctctttcattctctcccccatctcttccattatgaaggtttggataggacacaactcatgcctagattagtgcaatagatgctgagcctgtgcagcggtagtttagctttctctcctggttaactttaactgccacatatatcacttcacacgtcatttttcattcaaacgtatttaactggctcttcattcataagaagctggaatttgtcgtttgactgatattttaaagattttatattttttctccatcctcgttctaatgttgtatcttgtgtcatttgttcattcataaacttaagacttagctaaccactgagcatccaggaaattcagtatctatcatgtgaattctctaatactggttgatccattgtcaccagagcatagcaggcttctcctgcctttatgtatgtttgtcatatagttcatgcctaaaattctttcttaaatcttaaattcctaagatacacacttttgcccaagatcacagtaatctctgccataatctctgctggaatctgttcactgtgttgctcctgctaaacttcttacagatgactttttttctttttggtttccctggtatctagtataatttcttatataggtactcaataaatgtttcctgttgatctctacacctactctgtacaataccatagtgactagacacatgttgctatcaagcatttcaaaagtagctagcctgagttgagatataggggtaaaatacacaacagatttcaagacatattatgaaaaaaacccataaaatttctcagtaatttttttatagattacatgtagaaactataacattttgaataagttgtatcaaataaaatataaaattcacccggttctttttaatttgttaaatgtggtggctagaaaatttaaaattacataattggctcacagaataattataatggatggtattgctttagatcaagtttgtctaacccgtggcccatgggccacaagcggcccaggatggttttgaatgagatccaacacaaatgtgtgaacttccttaaaacattatgaattttttgtttgttttgtttttgtttttttctcatcagctatcatgagtgttagtgtattttatgcatggctcaagacaattaattcttcttcaaatatggcccagggaagccaaaagactggacaaccctgctttagatagtaaagcatatgagtagttaatgtgtactataagcagtgtgatctgatagactatttaatgttgtttgatggtacattattcaagtcgattattatgtctacctatgcagtttaacgacggtaatgagagagggcagcttgattacaggtcttatcttttgactaacttgctaggccacctgagaaggacccaaattatctgaatgcttaactcaactaatttgtattcacttgaagaatttcaaggatgtttatatgccatcaacttgctttaaattttttctctcagtgaaaatttttcttaaaatgagtatgtggtattcaaatttatccttgttttctatgattatcttttcatagcactgtggtttccaggaacctttttttttttgagatgcattctacatgtaactattgcacagtttgcatgtagtaaggttcattattcttctacttttccaaacacctggcatgtttacttgaggttggtacaccttgtatcccagattttgctgtttttaacctaaatattgaatattttgattaaacattatggaaagtttaaatgggtcaagaaaaatagcttttcttcccatgaagaacaatacggcataggagttaagagcatagatttaaagtcagaaaacctgtgctgcctacttgtgcaaagtcacttacatgctgtacttctgtttcttcatctgtaagttctacccctaggtatttacttaagattaatggaagcatatgttcatacaatgacttgtacagaattattcacgatagcattactcttaatagctctaactggtaacaacacaataatcaatcaacaattgtgctgtattcatacagcagaatactacttagcaacaaaaatggaatggactactgataacctcaacaacatggatgaatctcaaaactatcatgctgtgtgatgccaggcacaaatcagtacatactataattccagaaaagacaaatgtcatccatagtaacaacaagatccatgcttgctggaggtagaggcatcagttcagtcattcaggaagctgattccaagatggtgttagaattacaaccatccacaagagatttattgcaggcaatagctatgaaaggtagaaagagaacaggagaaaaaccaggcaaggaaaaaccacaatgtagttgtgatatcacttcaaagggaggcagaaggaaggagaattgggtaggaatagccacagattacagtgcagttacaagaaagtcttggcttccaacaaaggttacttgttgaggagtcatgcattaggcagacatgtctgggctgtagtttccttgctgctcccagtcattggctggaggccagtctgggttcctgtgctgtggtggatcccattgctgctgcagcaggaggccaatagcactcctggcagctaattggagagaaaagatccaagaggtgtaccttcatggctacccccatggggctggggtggaggtggaggagaaggagaaggaattaactagaaaaaggcacaaaggaaaattggggaaaataatgaagatatatgatttctcaattgtggtggtcgttacatgggtttattaatgcatcaaaactcaagaaatgtacatttaaaatgagtgcatatgattgtaagtgaattatacctcaatatagttaattttttaaaaatcatagatttctttatatttaatgcatgaacataaacctaagacactcctccactccaaaacttaattaccttgtgatcagcagagcagaaggtactttgtgatatataggtagagaagatgaagtcttgtgacatttaacaagggacaggaaaatggaccttgtcctaagttaccaaactgcaaaaatatcacctacaaaggctattcataacatacattttcaagggggttacaatatttgcctactataaaattttggatctgtaaaggggttaaattatttgtgcaggggaataaacatcaaagaaacattaagaggtccagagaagtaaaataggaagggtcttttggctagaggagatatttaactttcagaacatgtggaattaagttgtattgattatgatctgatcttcttccccctaaatttgatcctcttcctgtaatctattgtttccatcatcttcaactcttccctttccctctcccttgtccctcagttctagtcaatcacaaagtcctacagtttcactttctgtataccttatttctggaattcatctctagacttcaaaatatatatatatatatttttttttttgagatggagtctcgctctgttgcccaggctggagtgccgtggtgcaatctcagctcacagcagcctctgccacccaggttcaagcgattctcctagttcagcctcctgagtagctgggattacaggcatctgccaccacgcctggttaatttttgtattttcagtagagatggggtttcgccatgttggccaggctgatctcgaactcctgacctcaggtgatccacccgcgtcagcctcccaaagtgctggaattacaggtgtgagccactgcttccagcccaaaatatcttaagtagataattgcacgactaatctctgcttttctctcccagcagccttccaaattcatgtctcacagctgacagagttgttcctgccttcagattcatgacctggctctgtgttccagctcaggctttctctctcatatcacctcttgcctctctgttgcccccatattttcccctctggttggttggtgctcctttggaaccctctgcatatcttttcaagaatattatgacttattatgcctataaactttgtttaattatttatttctaaaatttgacagggaactttccgaaggcaggtattgtgtctttctcatttaaaagcaaattctcgcctggcatggtggctcatgcctgtaatcccacactttgggaggctaaggtggacagatcacttgagcctaggagttcatgaccagcctgggcaacacagttagaccaaaaaaaaaatatatacgaaaattagcctggcatggtggcacacccccgtagtctcagctagtctggtagctgaggtgagaggatcacttgagcctggatggttgaggttgcagtgagctgtgattgtatcactgcactccagcctgggcaaaaaagtaagatcctgtctcaaaaaaaaaaaaaaaaaaaattagtgaatcctcagtgtttaaaaagtccataaacatactaaacatagaagacctccaaatgaaattaatcaattattatttagtgggttgcttctcttttgttttaatatagttttaacaaagagtaaaagttatgatctttttatatgtaaaataaataatgccgggtttgacataaattttaggaaaactagagacgctacttcctaaaaattttctttctataatcttcctaaatatttttccataaagtacaaaataatagaaaaaaattaagagattgagtatcctttcaggaagtgatatgacaaatagggttcgagaactatttgaattctcaccacttttcataagggcagatctcaagttaaatttttctattcgaatttaaatgactttcactggaataccattacagaaaagcttctgtgtttagatggcaatatggagtttcttttcttggaatattaattgaaggagaagtcttaattttttaagtctatatctccgtatatatttgaacctattttatatgttagtccttctctttagtaaccttcatccacagtgaacaagatttacccttacctttaagcagtagcggctactttatgtgaagtgaacagctgctttttttatctgcatctagacatcaagtagtccagagtcctttctaacaccctagcaatagaagtaagaatattttgaccattccatgacttgatgatacttctagtaataatactgtattattaaaaacaaacaaacctttgtgcagtggtaattgaagcagttccttgggaacatgtattaagtactttttagcagttaagtccactctctgtaggttaaggaatatttaaataaaataatgtggcaaatgagttcaagatgataaatgcgatgagaactaaaacagctttaattttatgtgggaaataaatagaggaaaagtacattacagggctcctggacttatttctttcttcaaagtgtttctcctagcgaatattattactattttttctcttaagtaaaaaatacacaaagtatgaatctacacaggataataatattgaagttaaggatgatgtctcctccttcactctccaaaatactatttacttggcttcatggaaatctctctcactccaattccaccgtgtcaactgaggtcttctgttctttctctccctatagcatattcctgttacataaatcctaaactgtgtcgtgttagtcacacactgtaacctctagataagcgcctgtccagaggttctcaatcagagccttgcaaatatgtattaaatcaatgggtcatcttcagtgtctcagtgggcccttggatatgttttgcagactgctgtgagtatgtagggatgtccagtatcgagggaagtgtggatggctttcattggttcttatagggctgaagaacacatagagcagtaagcacttctactgtagggagagatcgagcttctcccatccccactgctggcaccaccaccaccctacaccccattttgagttctgaaagtgaatccttgagaaagaacacacaaaacaaccatcataatagtgggcacagctgtgggtggtagaataacattcccaagcttcttttcctacacatgattaatattaattcagcaaacatttattcagctcctacttttaaacaggcactattctaggtactaaagacatagaggcaaagcatacaagactctgcctttgtgaaacaattaagaaataagtaaaaagaaaagaaacagaaaaggcaatttggatagtgtcaggtgctataaagaaaacaaaatgccattttaataaataataataatacaatgttttcatactatgtgctagacactatgctagtaggtatttatagacataacctcaattaatcctcaaaatggcatgttgatatcaataccccaagtttacatatgagacttaagatgtctgagtatattcccccaggtaacaattaatatgcacaataaaactttttgctcattcatttattaacctatgttgattgagtacctattttgtgtcaggcatcattttaaggcacctggatatagttatgaacaaacaaataaaaatctctgccctcaaataattaatatctcacagaggttaggcaaaatataatcagaaaataagtataacgtataggatgccagatcatgaaagaagctatgaatggcatcaagaagctggaaaaggcaaggagacagattttctcctagagtctccaaaacagaacacagtcctgccgacaccttaactttaggctagtgagacccctattggacttcagacttacaatcccacaatgtaataaatttgtggtaattcagtaggggaacaatagaaaactaatacgatatcaaaacaaattatatcatagaacaagaaaatgtaattgtgacaaataatacctacaaaaatgttgtaaatgctaggcaaataatgtgtttaaagcacttaggccaatgttcaacgtaaagtaattcatgctataatatcatcatcatcattaccaatatttaggggctctaacaaatgatgtacgtgtaagcagatgtaagaaaatttccttgctgaagaggaggtattaatagagtatataacaatagataacaaattccaaataaaggcaaactaaatgttttattggattaaatttaattttaaaaactacaagaggccgggcgcggtggctcacgcctgtaatcccagcactttggaaggctgaggtgggtggatcacgaggtcaggagatcgagaccatcctggccaacatggtgaaacgctgtctctactaaaaatacaaaaattagctgggcctggtggcgcgtgcctgtaatctcagctatttgggaggctgaggcaagagaatcacttgaacaaccaaggagtcggaggttgcagtgagccaagattgtgccactgcactccagcctggcaacagagtgagatcccgtctcaacaacaacaacaacaacaacaacaacaacaacaaaactgtgagatccatggtgggcttttaagaggaaaatgcaagctaaggtttgtttagactctgagtactgcatgtgtaaaaataaaggcatgatgaaaagatcaagagattagagtgatactttttatctactagtgtcagagtcatgaccaggggattggctatgagaatacataagctgtgccaggagtaatccaaggagattgtttcaatttggaagagtgtccacagaatgattctcatactagacgttgggctattgtaaagaaagttggtaggtactccatcgctaggatcatatcagggagaaattgaacaggatggccctaatgaccctgttgtacccctagcttatggattaggcaagtcacttctactcgtataccctgtttccccatttgtaaataagaggatgtgttactctaaggatctctaagattctttgcagttgttaaattgcatagctctccactgattccatggtggaaatttgctattctattacaaatattctaaatgtatgagatatcagacatactcatttaaaaaacaaaatacaaaaaataagtattctacaaataaacacagataatgtttaaattctatatgtctttgtttctcttcagaagcatccaaaatacaaaccatctaagaggcaagaaaatgtcgtgatgttcctagtgcaagttaaaaagatttgctttcctcaagtcggaaagcccttctcatttttgaggtttttttcttcttttttttttcaagtgaaagcattttggaggagtcaatatccatctttaaaggtagccaggtcacatgtatacatatgtaactaacctgcacaatgtgcacatgtaccctaaaacttaaagtataatttaaaaaaaaagaatttaaataaaaaaagaaaatcagagagaaaaaaaaaaaagatgcatgtgcaccctgatactaccatccatagtgatacggtttggctttgtgtccccacccaaatctcatcttgaattgtaacccccatgtgttgagggagggaccttatgggaggtgattggatcatgggggtagtttctccatgctgttctcatgatagtgaatgagttctcataagatctaatggtttaaaatcatggcacttccttttgctctctctttctcctgccatgtgaggtgtgccttgcttccccttccccttctgctatgattgtaagtttcctgaggcctcctcagctatgcagaactgtgagtcaattaaacttctttctttataaaaaaaaaaaaaaaaaaaaaaaggtagccaggtaaaaattacttgtttccaggacattttcacctgaaagaagcattgtcatataacatagaagcaagaaatccagtagtgggggttatttaaaaatagctggaaaatttcaatcagcatgagtttgaagcaacaatttatcatcaccttttatggtgggtggggttaagaacatttcagcgggcaaagtggtggtgatggggaagagacaccaggggaggtgattcccattgcattgctttgtaaacagaggcacaggttcttcatttttgtcacacaaaatcacagctatgcagaatttattaatttattcttctgagacaagaaaaaagccaccaaaggaaaccaacagcttgctcctctcacactgggggaaccatatgagagacttatctatccctgactttaattttgacctgaggagagctcctcttaaggaaaacaaattaattcaatgactatactacttaatcattgacctttatttaataagagatttttccataggatatgctgagctgtctcacttacatcagttgtgtctcctgaggtgggtgacaggagaccacaaatattgcatagcacacaaatcgttaatagcagctgtataccaaaccattacctaaatatgtagagtacaattcattctcactaatgtcagagagcatgctataaaatggtgaatccggacagctgaagatactgaataataacctctattttgaacaagtttacagtgttccaatcagtaattaaattgatacctgatgaatatatgtgtgtgtatgtattcatagcagagatggttttcctgagataaggattttgttattcggataggctgctgctggaattgtccttctacccttgtttctttgtccttagtcatcactcatacctctttccactcttctgccatcacttttgtcaccaaagtcatggtcctttccccgccgattgctgctgcaggtctagggcaccaagacttaggcagcactcaccatgtgccaagaactggaccacaggtaccatccagcattgctcatggagactctgtccctttctgtaggacaccctccttttagctagcaacccctccaccacctagagcctctggacctctcattttaatattaagaactaggaaaacttaccgctgagaataactagtacaactagaactggtagagaaatctgggtctcttgggaatggatttttaggctttattgattagaggtgtattaataatgcagtgttatagtttcatgacataacgaataaaaaagttcattttggacttgcctttcagctccctaggagctaaaagacgtatttaatgtaacttgtgtggtggaaataagttcttttttcaggcaaaagatgtgcaaacccatctggggaagaaacattaaaaactaaggagacagtgtcctagataactatgttcttttcctgttttagtctaaaataatgattagttttcttatatatcttcatttgtcttggttccttttagcccaatttaataatattattgcagatattgatgaaaacctttaccttcctcttaattcatcaaagtacttgataaaatttatacatagtacattaattgggaggtttttatgagattaattaatataatgaactgatgttgaaattatttaaaacctgaattattattgtattaagtaggacacttaatacagttaatcagttctgtctttattcatttgtgagaatttttggcaagctattgtgaatattcagggaagggaatgtatttttagcaggaatcttatacctcctacatagaaatgaagcatttactgaaacatccatgaaacaaaatgtttctgaatgtgtactatacacttgttataagccccttttcttctgtagctatattttggagaaaaatctttgctttgacaaaaaaaattatgttgacttacacatatattttataactaagcagtgtttggtttgtgataaaggatacaaaaatataaaaatgttcagcacacgtaagtaaggccttgttgacaatgtgagttatgctactggatactcaaaaggaacattcagtgttctcaggtggtctctagactgtctcaagcctaggaagatattttataagcaaaggaataagagaaggaagattcagatttaatccaagtgaagaattcagttttgtgtgccttatcctgttattttgagaggcagccaaaagatgctggtcagcaaggagaattgtaagttgggcagccaactctgatttctcaacctcttagctgttttcttaaactcagaatttttaatgaatttaaatgtccatatcaggtagactttggggatgcttttaccagtgattttcagaatgttactttctggcatttcttttcacgtagcattatattaaaaatgaattcattcatccaccttcccttgtccttactaattttccctcctactcccttcccccttgttcttgccatggggacatgcaaacactggtggttgatgtctgagcaaggctgctgacagggggaggaaggagatgtcaagcagaggtcaatggcagtgtgcccagcagcctaggaagtaggagggaaaagagagagagacagagatggtggatgaaagagaaagccaggatgattatggtggttatgatacttgtcatgctgaacacccaattgagcacccaataagcacataataatttaatcatcctctggcttggatggcagtgttctatcagtgttgacttcctggttgtgacagttttacagtgttagtgtagaagagaatccttgctttagagaggtacttactgaagtacttagggttaatgcaccattgtgctggaaaaagatacgcacacacacgcacacacacacacacacacactcacacacacgcacaaatacatccatgtgttaggcagagggagcaaatgaggtaaaatgttaataattaggaattctgggtgaagtggatagagggactctttgactgttcttgaaacttctctatacatttgatctgtttcaaattcttcagaaaatcaaactacaaaaacttaattcatttagtgaacatctactgaacatctgtatattaaatagtgttaaatgaatgtcaattaaaatgctcaaacacagtagaggttgattctcattcacataagtccatggtaggtgtttttggcaggtgggtgagtttctcccttagggagattgaggaacccagactcctcccaagttgcagccccaccgtcttctgaggggatgcatccatacccacttcgaagtagcatacattatttcctttctcattcctttggataccagccacaatttattcaaggtagacagaaaattgtagtatatagccatatgccctgacaaagaagggagaacagattttggtggacaactagcaaactctgatacaatctgttattaagcactgtgtgtggatagatgctaactagaaggagattatcttcccttcagcaaatataaactgaatgccgtttatttggttgaaactaagctagatcatgggagtatagaaattttataagaagacatagtcacttctgtcagtgagctcaagaagaattagtatgcggaatgtaatcatacctacagggggcttgtgccacttaagtaaaatgaaacattattttgagtacaatttagcaataaatgtactacgagatcattaaaaatcatgtttgaatgttattgtgtcaaggatgggaaaaagacttttgggttgtagacttgataattatagttaaaaacagtttttattcttgtttagtcttattttttatgtttaaacatatttatacttgctaacatttatacttgctaagtaaagactgtttttacaaccatgacaagaacaaaacatattagtaatgcaaatgccacatttcctacaatcaactaatcacactaacatatttgcatggaagaatcactgggattgatctggccacgtgtgtagtcatgcccaaaatgtgaagtccatctgttttgcaattttttttaaccactgttatccaaatgctccttggattttttttattagtggatatattttggaggtcagacaccctcttggctagatcatcacctttataacaaatatatatactattctcatggaaatatatttagacattgccctactgggaatttttttcaagtaattaatgtacagcttgtgcaacagcttgatcttggcttcatggaaataattcactcttagcagcatctaatgccacaaagcatttatggatgtcagctcagaacttacttttatttatctctgagttacttttttttttttttttttttgagacagagtctcactctgtctttggcttgtccctaacctcttaacagacttaatattaagctccatttcactcagtcgttctgttgtcatataaatgagacattctacaagcatagtttttagtttctgccagagcatcatacaacattgtgagctatgatgaagataaagacctagagaagatatttaatatgaagttcattatctaatatttggtatgtgtggcaaaatagcaatctactgcttggttctgctgtaatctatttacccacccatcccatctttctttcaatttaaaaggataatgattttagtcacgattatacataaacccattaccataggcaataaacaatggggcaaaccattggtcccatagttggagtgtggtctgaagtgtgttttggtggagagagatctatgtctggagatagctaacatggatttggatcccagatctgctcctacctgttgctgtgcctgtgaccaaatcatgtgatctctctggtttcagtttacttgtgaataaagtaaataccttcatcaacacctgtttttgaatacaatgtttttctgtaatttttgcttcttataatgttataatgatcatccttacatctaaatcttggtttacattttcatcaattcttttggaaagattggagaagtaaattttggagatgtatgtcggctattaaaaatgtttaattttttaattaaaaattaaaacgttgaaaaatcctgatgcaaaataaatgcattatgcttagtgaactcttctcatttcgaagtttattcaccttcttgtttttgcaagtttcctgaaaaatgcatataaagtcactaagttagcagaactttataaaattatataactatatataatcttttgatatcagtgaagccagctgatcctatagaaataatgtaggaattataatcactagcacataatttaagagtcctgtggtcttattcatgttatttaccctctctgaatcttacatatagtaagagggttattatacataatatgtgtacatgtatacaggtaagtaagtatatatgcttatgtgtaaaagcagagttattgtgagagtcaaatggaaatgtgaaagtactttgtagttttttattactattattaatttttaataaaatggtaacattcatttaataatcattagttttaacttcagattgtactggatttcctctagtatttcttaagattagtgaataaagtatttctcctaataaatatattgactactgtctttcgatcaaacatattaggtatatttttacagtagcatcaggcagtgaaaatttgaagctctttatagaggactgatttatgatgaaaaggaataacatgaacaaatggaattatatgaagcttccccagaaatatctaagaggggccaattttaagaaatatctgacttctttttcatggacatttcaaaataaacctaactcatatggtacagtttttaagagggaaaagaaaaaaccatctgagaatctctggaattctgccgaaagtatcacttggcattttattctaccttctggatgcagttgattgacagtagtgttatgatgccaggggtatagtgactagaaaaagaaaaccagggaattcagtgttcttgctcatgaagaacagcttggttctttaaaaacaatgagattttgccaccccatctcacaaacctatgatttgtgagaacaatcccttttgtgttgcaagacttttacatttctcttcccacactatattagaagaataaacattgcttcataagtaccgattgatagtctcatttcatatttttaaaatagagttactttaaggttaaatttttcatgtagattaaaatgactaagtaaccattcacatatttcaaataaaatatatttttactacaaaaggaaaataactagattcttaagtgttatagtcaagtgtaattgagtaatatgaattctaaatgaatttctaagatctgctcagctttcactactttaggaaggaacaacttaagaaaaattttaataaagatatctcttcacacacatggcagtgttgtacttagagaacatgacccaaaattttttatgactgcatattgaattcctgatactcttgggaagctccaaaagcaccagtggagtttccagatgtaactgtggctgcagacccgccagtcccggtgttggaagggatcattataggctcttgtgtgcagactcatcttcagacccagaggaattaaataacttgcccaaagtcgcacaactttctcatggtaggttgggcactagaataaatattgctttttcttaagagttttagcctccgtattatgaaatcttctatgttctgctgatgatatctcccttcttcatctgttttctatttttaagcaatggaaatacaaacttgcaactccccatttccaacacaacttagaaaaaacaatatttaaagaaaaaattacaggcatctcatctcctttacctgacagatgcttgatagtaatggcctctagatagggatgacatctaatataaatgtgtcctttcaagtcaagctttctctgttcattagtagaaatattgtatatcaagtgtgcaaaaattttcttcaacagggagctttgtttccctccttttattataacaatctgagctttgtggtcccagggtctcctagtgcctgtctttaggtctgtttattcacatgaagaaagcatgtcatatagtattatctaagactcaggctgcttatgcatgatgacagaagggttcccaggcacaaacattcatccatgcattcatccatccacctattcatccattgatttggctgataattattgactactgttgagttgccctcagatttagtttctgtccttctgccatggggaaatatggggttaagccacaacatactcttctcttctttttctgcaccttcttagtatatttagttccattttgtctagccctgcctctgacttctttgttgtacttcaggttttttatcattgaaagttatttctggatcatagatcattctcttggtcactttgcttgttcacttataaaattaattcagaaaaaatgacccacagtaattactgtaaatcacagaccataaactataatactgtatattgtattatagtacagaaatatttatactttaaaatgttttaaatatagatattataaaaagatatgtctcatataagtaatataaatacttttttattacctcttctctccctattctccaggccagtgttttaaaaatccatctttatatgtccatcctggaaaaaactcatgatcataaatgagtttctcaatagagtttataagcccacagttgaaacacaattgtcttagcatccatttagttgtcatacttttaagatttaatggcaaatattatgttttgtttcttcaaaagaaatattttaaaattttagtaaaggcagttagagaaggtagagataatggactgtttaatcctacttttcatcccacaagtgaacaaaaaaatgataaaacatttttcccaaaatgtagctttaactatacttaaatttggactaaaatgggagatatcttttctactattgaaaagccgtgtctgtagattaatgctaaaatcgggtgtaaaagcaaaatttgtttggcttgattgccaatggcccattcatttggctacagaaacaatagcacatagcaacagataatgatgtgagatcacctagctcaagtaagagtgtctgatccgtcaaaaatatatacatcaagattcaaaagaaatgtgtgttttctcaagtcatctctgtaaaaatacattaaatagaggaatagaagtttgactttgaaaatacattgcagacccaatccgtctttcctattttctggtgaaaagtatcaaatatgtggaacctggaactgctattctccttcttaaaaatctttcttaatattctattgataactggtgcaagcctaactttttgtcttacccgattcttctcacaccaaagtgataggaccttcaggtagcctttggatagaagataaataataatttaactattgatggaagttagtattagaattagacttggaagtctatggaataaaatgattctacaacaatttgtacttcagacattagtataacaaaacatgtttgcccgtgcatgcggaaacaaccaatttcatgtggatgcttatattcacaaaggagtaaccacctggggtttcccactgttgctccagagaaaactagcagcaggagaacttctctgaaggtatcaagacatctttaaaaaacacttgttaagtgttggttcagctaaagcagggagttttcagttagtaatggcttttaaaaattaaaacaagtttagcatgtaggtcattaaccttgaatcactgtcatgattattattaaccatctgttctcaaatcgaaagatatttttcttttctagatcacatttattctcacattgctcaatttcactatatatcaagacatgaaaactgtaaaaatcacaccttctacattattatttttattgaaaaattcctaatgaaacagtgcgctctgggatagagaaaggaactaactgacattttgcttcttaacttgtttttatgcaagttctaagtggtttctggccatgtacataaaagacaaatatctggaaaaaaaactagcagaagtcagttatttggctctatctactttgagaattatgttatataaatgttaggaaattttttgtaatattcttatttagaaatgaaatataaaaagttttaaaaatatctaaggacagtatacagtcctaaagtaaagctgttaggtaaatgctacacaatcctcttattacagagtcacttacctgagaatataagaagagggcctcttgtttaagagtaaatgtgagctgcaatcaggattctgcactcatttggacacttagttttgtttttccatgactggtgttgcctgttactgagacacctacctgtcatgtgaccacagcttatgttacaatgtgtctagtcagacttagagatgtgtgaaagagcagtacctagacgggaaactatgggtctataaaggttttgccttcttgggcggagttcaaactaggaagccacaaaacttccagttgcattttcacagattaatgaaatatattttacacttttcctgaaagatattttatttgtgcaaaccttgttacaaagtacagccagttgattaatcgatgaagtgatttgtagtggattcttatattttgtgtaagggtatatgtgaggccctatatatgaggctttctatataatgaagtataattcagttcagcatttcaattcagcaatcacttattgggcctctactcagttgccttcagggctttataatttaattgataaagggaggttaattaattaattataacaacagatcgcttaatagtgtaactactaatttaattaatgacaaataacaatacattaaaagaaatgcattaataaaaataatatattggtgttatagacaataattttctgattaactttattattattatttcaatagcttttggggagcaggtggtttttggttatatggagaagttgtttaggtatgatttctgagattttggtacactcataacctgagcagcatacactgcacccaatgtgtagtctttcattcctcaccttcctcccacccttcccctcaagtctccagagtccattatatcattcttatgcctttgcatcctttagtttaggtggcagttataaatgagaacatgtaatgtttggttttccactcctgagttacttcacttagaataatggtctccaactctatctacgtagctacaaatgccattattttgttcctttttatggctgagtagtattccatagcatccacacacacccccctatgctttatatatatatgtaaatatatcacattttctttatccactcattggttgatgggtatttaggctggttccatatttttgcaattgtgaattgtgcagctataaacatgcatgtgcaagtgtctttttcatataatgacttcttttcctctgggtagatacctaggagtgggatcgctggaacaaatgattgttctacttttagttctttaaggaatctccataacttttccatggtggttgtactagtttacattcctaccagcagtgtaaaaaaatgttccctttttaccacttccatgccaacgtttatttttttattttttaattatggcaattcttgcaggagtaaggtggtatcacattgtggttttgatttgcatttccctggtcattaaagatgttgagcattttttcatatgtttgttggctgtttgtctatcttcttttgagaattgtctattcatgtccttagcccactttttgataggattatttgttttttcttactgatttgtttgagttccttgtagattctggatattagtcctttgtcagatggatagtttgcagatatttctcccattctgtgggttgtctgtttactctgatgattatttcttttgctgtgcagaagctttatagttttaggtcccatctatttatcttttttgttgttgttgcatttgcttttggtttcttggtcatgaactctttgcttaagccagtgtctagaagagttttaccaatgttatcttctataatttttaaggttttgggtcttagatttaagtctttgatccatcttgagtggatttttgtataagttgagagatgaggatccagcttcattcttctacatgtggcttgccaattatcccaacaccatttgttgaataggatgtcctttccccaccttatgtttttgtttgctttgttgaagatcagttggctgtaagtatttagctttatttctggattttctattctgctccattgatctacatgtctatttttatagtagtaccatgctgttttcctaactatagtcttgtagtatagtttgaagttgggtaatctagtgcctccagatttgttattttttgcttagtcttgctttggctgtatgggctgttgttttgttccatgtgaattttaagattttttttcttgttctttgaagaatgatggtggcattttgatgggagtcgcattgaatttatagattgtttttggcagtgtgctcattttcacaatattgattctgccaatccatgaataagggatgtgttttcattagtttctgttgtctgtgatttctttcagcaatattttgtagttttcctgtagagatcttccacctctttggttaggtatattcctaagcattttttttttttgcagctgttgtaaaaaggctcaagttcttaatttgattctcagttttgttgctgttggtgtatagcactggtactgatttgtgtacattgattttgtatctggaaactttactgaattaacttatcagatctaggagctttttggatgagtctttaggttttctaggtatacaaacatatcatcggcaaagagcaacagtttgacttcctctttagcagtttggatgctctttatttctttctcttgtctgattgctctggctaggatttccagtactatgttgaatagaagtggtgaaagcaggcattcttgtcttattccagttctcgggggaaatgctttcaaattttcccccgttcaatataatgttggctgtgggtttgtcataagtggcttttattaccttaaggtgtgtatcttatatgccagttttgctgagggttttaatcataaagcaatactgaattttgtcaaatgctttttctgcatctattgagtttatcatatgatttttgtttttactcctgcttatatggtgtatcacatttattgacttgcatatgttaaagcaaccctgcatccccggtatgaaacccacctgatcatggtggattatctttttgatatgctgctggattcatttagctagtattttattgaggatttttacatctctgttcatcagggatattggtctgtagttttctttttttgttatgtccttttctggttttgatattagggtaatactggcttcatagaatgatttagggaggattccctctgtctctatcttttggaacagtttcaatagaatttgtaccaatttttctttgaatttctgatagcattcacctgtgaatccatctggtcctagactttttttgtttcctgacattttttctattattgtttcactctcactatgcattattggtctgttaataatttctatttcttcctgttttaatctaggaggtttgtatatatgcaggaatttgtccatctcttcttggttttctagtttgtgtacgtaaatgtgttcacagtagtcttgaataatcttttttatttctgtggtatcagttgtagtatctcccatttcatttctaattgagcttgtttagatcttttttcttgttttcttggttaatcttgccaatggtctattgattttgtttatcttttcaaagaagcaggtttttgtttcatttatcttttgtattgtattttgtgtttcaattttatttatttatttatttatttttatttttattttttgagatggagtctcactcttgttacccaggctggaatgcaacagtatgatcttggctcactgcaacatctgccttccaggttcaagtgattctcttgcctcagctgcccgagtagctgggactacaggtgcctgccaccacacctggctaatttttgtatttttagtagagacggggtttcaccatgttggccaggcaggtctcaaactcctgacttatggtgatccgcctgccttggcctcccaaagtgctgcgattacaggtgtgagccaccacactaagactcaattttatttatttctattctgatctttgttatttcttttcttctgctgggtttgggtttgctttgtcttgtttttccagttcctagaggtgtaagctcagattgtctatttgtgctctttcagactttttgatgtagatatttaatgctatgaactttgctcttaacatggcttttgctgtatcccagaggttgtgataggttttgtcattattattgttgaattcaaatatttttaaaattttcatctttcttgatttcattgttgacccaaagatcattcaggagcagattattcgatttccatgtatttgtatagttttgagggtttcttttggagttaatttttaattttattccactgtggtctgagagaatacttgatataattttgattttcttaaatttattgagacttgttcatatggtctgtcttggagaatattccatgtgttgatgaaaaggatgtagttgttgggtaggattttttgtaaatatctgttaagtccatttgttctagggtatagtttaagtccatgtttctttgttgactttctgtcttgatgacctgtctagtgctgtcagtggagtactgaagtcccccactattattgtgttgctgtctatctcatgtcttaggtctagtagtgattgctttataaatttgggagcccaagtgttagatgcatatacacttaagattgtaaatttttcctgttgaactaattattttatcattatataatgtctctctttgtcttttttaattgttgttgctttaaaatcttttttgtctgatataagaattgctattctttctcactttgagtttccatttgcatggaatatctttttccacccctttaccttaagtttatgtgagtccttacgtgttaggtgagtctcttgaagacagcagatacttggttgatggatttttatccattctgccattctgtatcttttaagtggagcatttaggccatttacattcaacattagtattgaggtatgaggtactgttctattcatcatgatagttgttgcctcaataccttcttgttgttgctgttgttaattgtgttattattttatgggtcctgttaaatttatgctttaaggaggttctattttgatgtattcaagttactgtttcaagatttagagctccttttagcatttctcagtgctggcttggtagtggcaaattcagcatttgtttgtctgaaaaagactttatctctctttcatttatgaagcttagtttcactggatacaaaattcttggctgataattattttgtttaagaggctaaatatagggcccaatctcttctggctagcagggtttatgctgagaaatctgctattaatctgctatgttttcttttataggatacctgatgcttttgcctcacagctcttaagattctttccttcatcttgactttagacaacctgatggctgtgtgcccaggtggtaatctttttgcattgaatttcccaggtgttctttgtgcttcttatatttggatatctagatctctagcaagactaggaagtttttcttgattattccctcaaataagtccttaatgaccccactatataacatgaaatatctgttgttggtactgaggtgctggccacaaacaattctgtgtgtcctgaaaactcttcagaatattcgtcatctttagcacttgttatcttagtgtttgggcttggcttagagtgatacatctcataacagggcaacagaaagaaccaggaaccaagatttatataacataagtcagtaaaactagaggcaccagaggtttacatttacattaggttacattttctaacaggtagcaaagcacatgaatgaagttcagtggaaggccttcctcaggaatccagtaaaaaccaaacatacacacacacacacggacatccgtgaggcaggaagggaggtccactatagtacagacaagcatcctggaaggccatcaaggagtaggtgggtttcagttgcctcaggaatgtggcatggacccaaactaagtgagtacagatacttgtcattgaggagaagattcaaaatagcatcctaggtgtaaaaactgaggcacctggggcaggggaactaggtctctggaatgttggcttaaaagcacccctctcaggaaaggcctcatatgccatgcagggggttatatatgtgttgtgggacacagatggcaaggagataattctatgcaccaggctccactactaacaggtaaacagaccaacattaacagagacttaggtaaaaaggtaggtgcccagtggtcagttctcaggcacttccaagatgcacctaacagaaatgtaacttggtgtctattgtgtcctaggtctaacaactgaagagaagtgaattagtacctcttgtggacagagaaacaggggcagagacccattacaaagctgtctcagataggcatttgaagctgtttaagtatgtagaggcttaagtcaggctggttctgaaatgtgagagagggttaagcttcatgggaaatcagcagggtagtttgctattttttattataaccaatctcacaatagtttgggacatcaaatatcaaattgttgggaatatttatccatattagtctttttgccactaatatttaaaaatagtttacaatatacaacaaaaagttgtaaaatttccatctccacttaatcgatcttatgtaacccatacaatacatcaaatgtcctttccccactttatgtttttatttgctttgtcaaagatcacttggctgttagcatttgggtttatttctaggttctctattctgttttattggtctgtgtgcctatttttataccagtgccatgctgttttggtgactatggccttatagtatagtttgaaagcaggtaatgtgatgcctccagatttttctttttgcttaatcttgctttggctatgtgggctcttttttggttccatatgaattttaggattgttttttctagttctgtgaagaatgatggtggtattttgatgggaattgcatttaattgtagatttctcttggcagtattacccaggcttttcttattttggcaccctgtgctgctgtctccttttccttctttctgcttctcttaaccaactgttacctacacttcaatactttctgagggcaattcatcctccagtaagtctccctgaatcttctcttccttccctggcttattatatatccttcctcttggttcccatagcacctatgcacacttctgtcattgcacttgccaatttgttttataatgatctgctcatctgtctcctcacttagactatgagctcactgagagcaatggctgttgcattcaccttatatcctcaacaccattctgaaggcaagagaaagaatacccagaggtggagctgggaagctggttgtccaagtagtgaatgactctagtttgaattgaactctatagccagtgggcaatgtggatgtgttgacagttttttaacaggggactagtgaaaacacattttgggtttagaaaaaattgcaagtctgatgacatacataggagaagagattagagataggaatttcacttcagaaatttaaccacaagagcaagtgacagatcacggaagtctgaaccagactataaatgtgagaatagagaaaaaagttaacaatttgggtgtgaaagggcgagggagagaggtgtgaagaatgactaagtgtggatctgtttttaaggattgaatggaaatttgagcattttagctaatcaggcctaatattgagcaaagcaaaactcttgcaaattgttatttcaagtgtgggctgagaaaatgaaaaaatataaattctcacgttataacctcttccgtgtgtctgatttgatagaatccagccccattgcctccaaattccattgcatcttagaccagcaaacacaagtgaattctacttaaccccagaattctgtatgaaaatcttactgcctttttttttctaatcatgtgtcaaagtgtgggaagaacttttatttatgttttaataaattgtcagtataaccatttttacttgaaaatattataatttttcaagtaaacaaattgtttctctaagttgaaaattttatgatggaataaaagtatttttcctcaaaacacatagaaattttacaacaatattttagagttaactaaatgtttctttagtagtttagtcacttaaaaagtgatatgattatgaaaatacttaaactttgtcttttaactatttctaataatgctattggtataatttcatatttttatactgatcttttctccaaactttagtaaaacatacttctgtaaacccctgcccacaaaactgaagtccacatttacttctgaatgactgataagtttgtaaaagtatgcatgaatttcgttattaaattaaagtttttattatattttatgcacaatggtataaattattaaattaattttcaagcttatagaacattgataaagattgtcattagaaaaccctgagttgattgttatacattacataacctttcattggtggattagtgaatatgttatagggtgaccatgaatccaaagaatcaaagctggctacagcaaacagagggtcaaaaggatatggaactatgcatgatccagcaaaacactcaatatctgttttcctggaatgttaaaagacaaagaagaaaacttggggaacactagatgcatatagttctggttctttaagaataaaaatatgggccgggcccggtggctcatgcctgtaatcccagcactttgtgggaggccaaggcgggtggatcacaaggttaggagttcaagaccagccaggccaacatagtgaaaccctgtctctactaaaaatacaaaaaaaaattacaaaaaaaatacaaaaaaaaaaatagccaggtgtggtgacaggcacctgtattcccagctacttgggaggctgaggcaggagaatcacttgaacccgggaggcagaggttgcagtgagccaagatagtgccactgtgctccagcctgggtgacatagtgagactctgtctcaaaaaaaaaaaaaagaataaaaacaagaatggtcagagtcctagtaccttgtccagtgtagtgctgccttgagattgcattgcaatctgtctgagagatagtaaaagaaagtgataccttccttagccctgtttctctttagactatgctttcccctctccaagttaatatctctcagtctaaagcctgggaaaaggtgccaattttgtttttctttcttcctcacacctcctagaagttacactgggacactattacttttttccaggctttggccatgtgtattgttttggagagtcaacttccttttttctttcattctgcaaatagttttgagctgtcactctgtactaggtgctataaaacttacaggtgcattttacatgcctatttcctataggccacgatttaacaaaatgttcataaatgagaattaggagtgcatgtattgaatcaccacacattaactgaacagctttcattggccagagactatattgacagtggagattcaaagataaactagagaaatctcatgcttaaataactttctataataaattatataagagaagtaggttcagggatcttgggagctcagaagcaggatgagttaaacaaaagttggattttgcctttagcttggtttcattatcctgaaggaagagcctgaaatatagtgtagggtgcaagtagtatatgtgggtggcaatctcgggaaacaggagcatgtgatgaataaggagaaaaagccaatataaaggtactgcattgagggcaatgagggctctaattctctgcaccttctcaagcattgtgcagattggttttctggattatcagcctgaaggacaaaacgaagaaacagccattagctcctgtctcccattgtctgagagctgccactaggatattaacttcctgaaattctgcagaaatctcctcttactttggcactggagatgcccatacgcagaaagcaaaaaggcacagcatatttaaggaagctcataagaaacagtgcatccagaagtggcgagaattggaggaatggacatgagactctaagaaccagcgcctttgatgttccttttgatctgttatgtagctcttcttgtacacaggtgagcaaaggcatgctggacaaatggattcacatgtgctaaagcatggggcaaaaaccacatattaattcaggaaaagacaagatgcgtggccctctctgtctctgtctaagggtgaattaaagaggggatatatgtacagagtggcagggcaggacttgagataagaaggctaggtgggtgctctcatgctagtagcattatagtacaggtgatgagaagctcctgaagaatcatcttaacatttgtattttagagcaacagtattgagttctgacttagagacagcaaaactaaagacagaaagactattttgattattaatgatgtagatataagaatatcgtcaatgtgaactaaagcatgaagctacttatgatatatcattaaaaggatttaactgattggagacaaacgagagggatggggaaaagaattcatttgtttttagttgctctttttttcctacttattcctttgttccgagtgtgaataaactttgtaaacttttatactaaaacattctgctcattcatacttatttctttgatgaaacaaggaaacccttgtatagttataaacgtgtgaatcaatttaaatattaggaaatttttttaaataaagctagttttctgaaggggaaaaacttggttcaattttttgctggcaatctgctttgtgatttttgaacatgatatctacatctagactcatgttttgctagctggaattttttttcaaattaacgctaccattattatatgctttactatttagcttttgcagccttggaaatctatgattaatacaaataattctctatggcaattttaaaaatacatgtaaaagccttcaatctacattgctactgtgtcgtagcacaaaaaaagaaaatgtgatcaaattttaataaaatctacaatttattcccttctaaatacagtcctagctcaggagaaaggaagctatttgtatttttcagaatcaaatttccctaaatgaatatagagaaagaattataactgaaatattgttgaaacagtggtcatctcaaatctgaaggtcattccaaaaaagtttctgagttttcattgcctcaatctaaaagttggcctttttggtaatagatgaaagtaaaataattgaaagggtctgttgcagttttggaatatcttgaaaatatagtagagtgaagccttcttcccttaaataaaagacaagttgctgattgttttctttctagccagataagaataatgccttctttctcttgttagtcttaacacctcacttgttactatgtgtcagaaaggcgagacaccataaatggagatactactgatggaggtcatctgacatggggctggtaggcagtgggaagactggtatggacacaggtggcttaggggttgggggatgatatggaactaaggaaatgataattagcagaacccagtgtgcatgtgtgtgcattcgtgtgtccgtgtatgtgtgtactgtagcacaatgcaagaaagaaaaaacaaggcagacttttcataatttcagggataaataaatcctttatcacttcatgtagaatattggctacttggaggtatatctaaacgtaaatatataactatataactacatgctaattaaaaacatacaaagaagaagtgcctaaagaattacaacagaaagtggcatagtgattattagagttaatataatataaataaggccaggcatggtggctcatgcctataatcccagcacttttggaggtcaagttgcagggatcacttgaggacaggggatagagacaagcctagccaacatggtgaaacccatctctactaaaaatacagaaattagctgggtgtggtgatgggcgctggtaatcccagctactcaagaaactgaagcaggagaattgcttgaacccggaagctggggctgcagtgagccaagatcgcgcactgcactccagactgggtgacagagaaagacccggtctcaaaaaattaaaaaatagtataaataatatttcaaaacacaagtctgttaagataaaaggtacagaggaatggtgagatgacttttttatttgtgtgataagggactgttttctgtgattgtgagaaagaccaggagttaagaaaaagtggccatcaataaatcagccacttatggggaagaaccataaaccactctcagatgaaatacaaatgcagtcattatttaatattattggaatatttgtattagtttttggtatgtgctgctagtgctggtacattttagtagtcaattaatattttgttaatcttaatttctaactaaattccagagtgaaatggaaataataatgaaaaaattttatttacaaaacagattttgtttttttctgttaagaatgatacacagttgtccttcagtagccataggggattggtttcaggacctcccttgggtactaaaatctgcagatgcctaagcccctgttataaaatggcttagtatttgtatataacctatgcacatcctctcatatactttcaatcaggggtccccaaccccagggccatgaccagtactggtccatagcctgttaggctgttcgataccaggctgcacagcaagagctgagctcctcctcctgtcagctcagtggtggcattagattgccataggagcacgaaccctattgtgaactgcacatgtgagggatctaggttgtgcgctccttatgagaatctaatgataaatgtaatgtgcttgaatcatcccaaaaccattccccttcccctcaccatccctgtccgtggaaacatttcttccagaaaaccagtccctggtgccagaaaggttggggactgctgctttaaataatctctagattactgataatgcccaatacaatgtaaattctatgtaaatagtttttatactatattgtttagagaataatgaaaagaaaaagtctacatgttcagtttaagtgttgataagtgtgtagagaaaagggaacccttgtacattgttggtggaaatatagattggtgcagtcattatggacaatagtacggaggttcctaaagaaattaaaattagaattacctaagacccagcaatccctcctctggatgtacccaaaggaaataaaatcatcacctcataaagatatctgcactgctatattcattgcagcattatttacagtagccaagatatggaaaccacctaggtatgtgttggtgcatgaatggataaaagaaactgtggtatatgtatatacaatggaatattattcagccttaaaaaaggagaagaccctgtcatttgccacaacatgcatggacctggaggatattaagctgtgggaaataagtccaacacacatccacacacaaaattgcataatctcacttatatgtggaatctaaaaagaaaaagttcaaatataaagttagaataaaacagtggttaccggccggatgtggtagctcacgcctgtaatcctagccctttgggaagccgaggtgggtgaatcacctgaggtcaggagttcaagaccagcctgaccaacatggtgaaatcctgtttctactaaaagtacaaaaattagccgggcatagtggcaggtgcctgtaatcccagctactcaggcagttgagaaaggagaatcacttgaactcaggaggcataggttgcagtgagccgagatggcgccacttcactccagcctgggcaaaagagcaaaactctgtctcaaaataaaaaaacaaaaaacacagtccacacactggttaccatgagtgaggtggcagggaggagattgggagatgtagatctaaggatacaaagtagcagatatgtaggaggaactaaaaagctgacatgcaggatgacaactatagttagtaatagtgtattgtattcaggatttttgctaattgagtagattatagctgctcttgccacaggggaaaaagtgggtaactacgtgagatagacaatggatgtgttaatttttgtcactataataaccttttcaccatatacattcatcttataacagcatgttgtttactgtaaatatatacaataaaatttatttttaaatatctgagtatgatttgatgatttgtgaaaatagagtgaattataataattttaaatgtaagttaatgttattagaaaagaaacagaaagaacataccacacagaaagtctgtctgaaggatctttgttttctccaccaatacaagtgttcattgattcagaggtggattatgagatatgaccataaaacaaaaatttcaagggaaatatattttattcaatgaaaaattctcaacacaactgttatatgccagtaaacactatatcttttaaataacaggtcatatctattatatttaaaattcaaggagagactacattagagatgctattagatcaacttctaatttcaaagatttctaagatatggaacagttactccttatacaaattaaaaaagcaaatgctgaagaaattcagctacatggatacaccatgaggtggaaagatgctccataactcttagttaaactgcactaattacacataaaaggaaaatgtttcatttcattgtaatttggaaaccaaagaaagaaaagactgaatttttacatactgttaaagagattgcgtatctgttctaagtttaagacagaggcaaaatgtattttattcatttgtcctgcaccgtttagaaataaaattcaacttccttttaattttttttaagaataaaaaactcagtctaaggaaagtcttaaagttttcattttaagtgatccactgttctagaagtttaatattttgtttaaaatgtttatgttctgtattccaccaagtctagttttaaaacaaaacaaacaacaacaaaatacttctctaacttggagtttaaggtgaaagaaaccaattacgtggtttggaaatgtcacacttttcatctcttttttaaaaaaatttttaattcaggacagaaattgtatggatttagtgtaagtcttgggatctcacaagtgtcagtatttcactctcctccatatcttgatagcaataacttgaaataggatctcagtagctcaagcaatactgggctctgagagttggttaaaaattatttggctgagcgcctgttgctgagggaagaactaatctcgagcatatttttggagccaaataccaaattgtttgtgcttagcaacacagcaccaggcttgcccttcagaatgattctagaccaaatgccagaaatgctctggttctgactacagagttctattcacaaatgacaggaggcaagaggtcctcctcactttcagaagaaaggtcctttgctttcttagtcaatggtaggaaaaccattgtggttttcattgcattacataatttttaaggtgattacttcaataagaagtgctctgtgtatatgtgtgtttatagacgcattttttaaacactggagaatttctgaaagtagtacaaaccttgtaatgtcaagtagatgtgggaaaaagggagtttacaacattctctcctgacattgctctcctttggcatctgcatttttaaaatgttaaaaatgtttaaaaacgtgtgcttaacacttaatttggtgatagttgctgttaccaaggcaactctgtaactccacccagataaaaataaatcttgaagatgagtttctgtgtctctgagcaaatatttttgtgaatagtagaagcagagaaagttaaagatacctgagcttttgatctttactagttttatagatatgtttatagttatacatttttattcatacattttagataaataactttgtaaagcaattgattcttcttgtaaaaatcaagtatattcttaatagactgataaactttctttttttgagacagagtcttgctctattgcccaggctggaatacagtgccatgatcttggctcactgcaacctacctctgcctcctgggttcaagcaattctcctgcctcagcctcttgagtagctgagattacaggtgcatggtaccacaccccactaatttttgtattcttagtagagatggggttttgccattttggccaggctctgagaaactttttaaggtctcttttgcagccagctatttgtctaccttatttcattcttaatctcactagccaatattttttctgtttaagtgctttcagcaaatattaaatgcttgtgccttcagtcttatcctgtggaaacactggtaatgacaaaaacacatatttcaacctaatatacaatagaaacagaatgccagttattcatggaggagaagaatagacttctgtatttaaaataacattttgctctgtgttttaaaatcattcttccttcatcaattgtaagcatcttgactataatttatacacctaaagataaataattcagtagcaatgataactgaaaacaggacacatacaatgaactagctaaattaccatacattctcatccatttcaaaaatagctctgtacttttttcagattttgttagaagaatattcaatacaaatttttattcaatgaacacttcagatgtcaagattgttacccacatggacaacagtaacctaggtaaagattctgcagccaggcgtggtggctcacacctgtaatcccagcactttgggaggctgaggcgggcagatcacgaggtcagatcgagaccatcctggctaacatggtgaaaccccatctctactaaaaatacaaaaaattagccaggtgtggtgtcatgtgcttgtagtcccagctgctcgggaggctaaggcaggagaatcgcttgaacccgggaggtggaggttgcggtgagccgagattgcaccactgcactccagcctgggtgacagagcgagactctgtctcaaaaaaaaaaaaaaaaattttatacctgggctctgtgctcaccagcagaaggggtaacatggcttcttaggacaaccttacttgaccatttacttctttgacactaggggtattcttagatcagcaggtccttccctccacttatgcacatgaggctcacagagagtctgggaggcagggaatttatgattggaaacagtatactttttatctaagaaattattaatgtcactgcattcaagtgattaacaccatcaatatcttcaagactaaggggattacatgatgtgtaaaattagaaaactgtcatctactagtggctaggcactttaattatattaagcatgcaacaagagaactcttcaaatgaatccatctctcctctgtattatttccaacccttggatccccatctgtttctgcagacaacagctatgctgctgaatgtcttaatggtttgctgccccaactagcttcaagatactgcaggtcaagcatagcatcttactcttccctgcatctccagcacctctcagaatgttggtcacatagaagatgtttgctgaggagttgaataagaatatgtacaagggacacaattagcattgtttaaaaaagatgtaacaagatagggtaaaggaaagctttggaggataaatctttagaacaatcaataatatcttctcctctgttggttagttgcccttcaatctcagccactgaatcaaatacaacataattactattctgatatgttcttgaatcgaatatccaataataagatattcggatgcatagccatgtctaatatcaaagcccatgcttttcgctattattgtactccatacattagcttccaaatttatttgcaatccaaatattaaaagcaagtcataagcttagtatcgccaatgtgatactaagtatccacttactaaactttattttcaaaatgtggttttatctcagtttaatgaacacggcatgttttaatttacactttcatattatatagtaagggcgtggttacagatatgttaatttcctgtgctgcttcacaatgatggaacataatagcaaatgaaactgttaatttgcagatacccataggcctttggtgtctgaatagaaataaacacacctacaactgagagaggaagcatgtgaagcattccagtgaacagaggccatttattcagtcacagacacaggagaaaaacaacaattaaaaaaaaatctctgatgaaaagttcataaaaagttcactcagtttaagcatatgtcctataactacttaaaatagagttcttcttaaatatcattctttgctgtttttagatttcttctgcctgtatcaaattaatagaacacagcatacttttaatttgctctggtttcttagtggggcatttattaaacacattaaaacaatagtctcagggttttactgctgatgttaaagttctgctttcctacttaccaactgtgtcatcttaaggcacatactttgcctctctctcaaatctcccaaatggagaatgataagaatacgtacctcaattaaagaagctataacaagtagaatgtttggaaaagtgccgggtacaccataagcccactatgagtattggattgtattacctctgaaagctgcagaatggaattctcaaagttatatgtccctaaaatcctcttaagtgacagaaatggagaaattagcagtctgtctaagagagcttttctagagtctgggcatatgtttttaggacaagacagttcagcttcagcttaaaatgagagagcacgtctgtgtccttactcctgggtgccaggtttcttgtccccatcttaagacaaataattttggtggagaagaggcagtctctttgatttcgctctaaaaaccttttctggaggaggtagacactctccacccccgttttgagactcatgcagctgaggatgactggctgagtacaagcaattgttccttctaagcagtttcaattcttataacttgtggagatattcttaagtccaggggattttgtgtatggtggatttttattacaaagtcctgtacttcataggaacaaaataattcaaagtcaggaaccagatcaaagccacaactcagatatggcaccttgagaagttcatttgtatttcacttgcataaaaaccctcaccactgctatctgattttcacaaatcattcaacagctatccatgaagcacccactgtgtgtctggtctctgtgtcagtccctggcttcatgtgtctttccttctgtaccctgactccccaactcatgaacacatgaagtaaaaaaatgaaaatctttttctgacctctcttcaaaatcacttttttcaaaacaaacacctctcacctgctcatcctccagccagtaaatcacaggggcctagagatgtcacttacaaatattttctgattctgtccctcccttcaagcttgccaacattatcacagtttagggcctgctcatctttcccccaatctccaattagatctctccacaatgcaattctgcacattccctgttacaacccttcaattatttcccagcccatccaaaataaaatctaagcctcttactaacacattcaggaactctgtggcctacggttttctacagactaattttccagcagttgacttccagtgcaagtgaaaacctagtgtcatgcctgcatgatagataaatttgaagctgaagagcccaaatgtatagaccatgccatgaaaggtttatagtcatgacacagtggccctatagtacagtgcttgaagctggctctctactgtcagacagaccacttgccagccatgagacctggggcaaaatgccttaatttttatgtgcctcaagttctcatgtgagatgagaataaaaattacccctatttcataagatttgataaagtgtttagcataatacctcataacaattgcaattcagtggtggttattattataaagaaaagatgattaactttatcttaatgtttaacttgttctgatagttattgatctatagctttgatatggaggtttgagaatgacctggaaagaattggccacaatgattgaagatagtgatacaagaataaaagatgactgcaaaatgtaaacctgcaataacagaaagaatgaagtcactggtctcatgggaactgatatgggagaaaaaaacagatcaaaaggctattcatgttttgggcctctttgtcaaaatggaaatgagaaactggggaataaaaattaaagcaattctagcatctggttttaacataattcttatccctaaaaagaatctataagaaactcccaaaatgacaggcagccgtgggtagcattgcatttcaagtaatcttttaattgttaaaatttaagtttccaacatgaacataaaattttcaacctaaaagaaatgagttccaaatctgagacaagtgaaaaaggataaagcctactagggggtaaattccatctctttagagatctagtacccaatttagcaatgtccaatcaagcctttaactactacatttgaacacctcatcatttcaaaatgttacttaatgatgccaattaactgtacaatgtctctgcatagcacatagccctaaaatgatttgtgcaatgttactgtcagtaaaactgaactacagggaatgctcatattctatgtcattatatacagaaatgcaatatcaataaagtgatatctgttggtattagaaaaaagtgaaaattttcatatctttctattttcttttttcctcaatgggatgctcttgttaaagatagctctgcatagtaaggtttgtataaacattatttagctaaagttaaaaggggtaacatactggttctagcacagatattaaaacaaattagtttgtaggtagggcagcaatcaattatattactaaccatagctttggtccttttatcctttcccatttgattttacacagtgggatgttaaaggttgaatgtctttggtatctataaacttaattgaaagctgttatttgtttgtttaagtctgttgatttttataatcataattttactcctatagatttcttgtaggagtactatatgaatttatgttgcactgaattttgttatgttatacaaattaataggcttttatttatggaaagctactattgatctgtcatttcttaaaaaattactaaaaagtgttaaaactttaaatgttggagagtttatattttaaaagttacatgctagaaaaacatgatgtctgagtatattagaagttatagataattcatctgtcaactataaaactctccaacactgcctttctttaatgaataatatgaaatttagcagtgaaaatgtgacaatgtacaatcctaaataaatcaacaaatttagagatgtacctctaaaaccattgtaaattcaacagtgtaattttccattggactttcacttattcattcattaaacaaatgtttgtgagtgcctgcaatgtatgagacattgtactgaagctaggcagtgtgagttatcatatgggattatcctttaaatacttctgagggcaaaaaaaaaaaaaaaaagaagagaaaaggtgtgaggaaagataaagggttaattcattaaaaaataacacttgaggactgttttctttgcaaggcataaagttatcaccctttcaaacagtagatatttcacatttaggatgcgagactccagttccaacaaagctcattgcacagctgctaccctgattaaactgctacatgaactctgagcaatgtagcatggtagccgcatgcttctgcttgcatgatggttaattccttccattctcattagtgattttctgagctttgaaattctgatggtacctaggatataaagcatatttatctaactgaaaaacagataattagatgtaacataaaatatgaatggctttgtcactttattgtagcagagaatgaatgtgggataaattaaagctgatgctagaacatatgcctattttttagctggaaaatttcaagatttatgtactttgggcttgagaaagaaatggagtttattttttatgcactgacatctctttttttttttttttggaagagctctcttaggaatgaatggtatgtaaatacagtaggaatgtaattatagattttcctgacccagttcctaaataatagatatcatttcagaagtgccccaatacctgaccttttgctccaagccatatcaaagcacacatctagtctacttttcactctcattcctagccactatgacaatactattcagataaaacttctagtcctctacttatgtgactcataccaacttgaccttacgatagtgactgggggtgcatatctaggttcatgctgtttgtccattattatggttttgtgagaaaaggcaaaatttctaggtaaagtgttatgaggacgaataatccaccaggcaaccaactgaccctttcatttgccatcttgtcacttcaaacagctctccagaacctgcagccagcacagaccaaagtcaggtttgtctcctcttctgttgatgaacaaaggttgattccatatcgtggctattgtgaatagtggcagtaaacatggcagtattgtatgaaaatatcacagatagcccttaaatatgtgcaactatgatgatctatcaaaattaaaaattaaaatttatttttaaaagttcagttagaaagcttgtagttcctggcaaactactacctttctcggcaaaagaatttgatatctcttaaatattttctgcctaatgctgatagattgtatttacatattccattaatgcaataaataaaattacaccaaaacatcagcattatttatttccaggggcatctctcaaaataaattcctccaaaattcacaaaaccaaaaccaatgtgaaattgtactcagggatgcaaatgtagcccagtgaagcatttgcccacttgtttggtattattgaagcacaattagaaaaatgtgcaatgtatgcccaaaaattctataataagggccaggcgcggtggctcacacctgtaatctcagcattttgggaggccaaggtgggcaaatcatgaggtcaggagatcgagaccatcctagctaacaccatgaaacccagtctttactaaaaatacaaaaaattggcccagacgtggtggcgggatcctgtagtcccagctactcgggaggctgaggcaggagaatggcatgaacccaggaggcagagtttgcactgagcctactctccagcctgaacgacagagcgagaccccatctcaaaaaaaaaaaccataataagaactttttaatatactatattataatgtaaaaagactagatgtcaaacaaattaggtgatgggaaggaattgagggagaattttagactaagcaattgagcagcacctgtttttcaccacaaatctgttacatgtattgctcaattgtgctgaatccatattgggtcctggtggctatgtaatagtctctttcttggataaatgtttgtcctctcttatggtttactaatggtgtacagaacagcattgaatagtggttatttcctatgacttcctagatatctctctcataatcctgaatgttttaaagatcattcttagatagagtacagctagacacgaaccatagtggaaatcaggtagacaaaatttaaaaggagtcttaattgaaggtcattttattgtcctcagtattaatcttatttaaaacaaacctgtcactgagcagaactcaaaacaccagagccctttgccaaatgtgattttttacaacaggagcgctggcagttgagaggagtattctgtcacacttgagagaattcgagtccctgaagatttatatgaatgcttagctattatcgaaccatctcttcacagatgacttagtaaatgtctgcctttgcatcagataatggcttacaagttaatctcctcttgctccctgttacacacatatacatcttcttcctaaacagctcataaggtgaaagaaagactcagatttctgactatgtaattgataatatcacacggactgcctgctcatcatctgctagtcacattggcagagttgacagttttggagacactgaagacagtgcatatattaggaaataagcagtttcctgatataaattttcttgtagtttataaattacatagcatttattattccctcatattttataacatttaataatagaactgacacatatattcattttaaactcaattgtgtataataactatcatagcaacccttcagtgcctaaatatcaaatcttccattcctcccatgaacatcttgaatatataggtactgtggttagctccaacaagcttttggttagaattcattgcactgatacatagacattgttttaaaggcaatttcaaatcaaagctgtcagctgtgaatcaagcacaccttaaaaagtgacacatttgtcactagattccagcctctcaaattactgacacgcatcctttttatgtaaagatgacattgttctttcctgatatattgcattcctcatgaatttcttatagtcatagaatttttataaaccatttcagaatcgctgaaataaacatcaatatttttaactttttcattctgtcaaaaatattgtatgcagagatattgctgtaagtgtgtatacctgtgcttaagagactagggctgaagagaagtaatcaaccgaaccactggtgtaaatgtgcgtcacatttttagtgactagaaattgaaataattccaacaaatttatgtgctttgggcttgagaattcagactgccttaggctaagataaaaatcttttcctggtactatataccttcttttattgaatgactacctggctctttctattatatatgcagattttgtacctctggtcatctttgtaaatggtgcctaaaagatatttgaagaataagtgaccagcaataagaacaaatgtctatacaaaagcaccctttagttggatgtaattcactactttgagttgttaataacctctaaggatgacagtagctattagttgaataaaccattatgtctattattagaacactagatagtttataagtccaaacaatgcataaaatacctatctcatgttaccattgtttaggttaccagataattgttctgtccaattattccacttaattttttgcttgcccattagctaaatggcaagataaaatttgtcaaacgggggggaatgtattgaaaatgctagacaactacacttaaaatgaaaacaggccaggcgcggtggctcaggcctgtaatcccagcactttgggaggccaaggcgggtggatcacctgaggtcgggagttcaagaccagcttgaccaacatggagaaactccatctctactaaaaatacaaaattagccgggcatggtggcacatacctgtaatcccaactactggggaggctgaggcagaagaatcgtttgaacccaggaggcggtggttgcagtgagccgagattgtgccactgtattctagcctaggcaacatgagcgaaactccatctcaaaaaaaaaaaaaaaaagaaagaaaagaaaacaaatgcataatttgcaaatattatttttatattgtatgttatctagggcttctaaatgcattcttcttataagcctaggtttgcaataacattcatttagaattgagtaattttaaatataatattttataaaataaaatataataatttctcttaattctttgaaaatattaaattaaaagggggttgcaaactctgcattccacatttccatcccaacatttaattttagcaattttgtagtctgcctaaaatgcaatccatcatttactgtttagaaaatagggaatgtacacaaaggcctttcagctttccctgaactccataaaaatctttttgcttctttactgcccccctttgtcaggagttctgaggaactgttttttatcttaagtctcacaaagcatttaggagaatatttaaacttaaattcttttaaaacttatgttcaggacaaagtaacattgtatgcattggtgtcatatgtatttaaattttgaaatttttaatactggcaaaatgaggtttcaattttaatataaattatttaacaatcttaaatcattaaatatattacttaatatatttaatatatctaaacagtcacaattttcccatactaataatcataaaaaatcttacccaatggtcatatagatatacttaatggagttttgggggggtatttttgtatattaaaaaattcatatatttgccttacttagaagaactgattaaatgaaagtataatattaacaaacatattgttattttatatttgcatttgtgataattatatttgaaacgttcaagattttccaatgaatttcttttgcatttgcgtatttgtgcctttttattataaaaataggtggctttttagttccactgcataagtttcaacataggtctacaaatagtgcatctttttgaagttaatcattataatcacaaattgaagttgcctgagctccaattggagtctaaatggatgactgaatcttattattcgaaacccactgttgctacacaatatggccacacaagagagtacacaagacccgtctgattcagcctcagtgccataaatattttaatggtttcgttggaatctggaaatggagctcaccacaggagatgcttcttcctttgactctcattattatttcctttacaaattaattaataaaaacttagatgctaaattagcacttgatgaaaacttatatagccttgacattttgattctgtgagtgaataaaaatacttggagaaataaaaatcctaatcatgttcaggaatacccacaaggtaacaagtacatttttaaactttaaaaacatttattattcatgataaaacatgttgtgtgatttaaatataaatttttattatttgctttaacttatttccggattaaaaagtaaatgtttacctagctgttctaaatggtaatcctcatgattaaaacagcaatttgtcatatttcagttacaaatgatcttttattattagttatagaacataagtttcttcattgactgaggcgatgtttcaagtagataaatctgttaaaaaaattgtggtcatattctgttaaattctcataccaggcaatttgtttgatattcaggaaaaacctagccactgaccaaaaactctacctgccttctcagttgtatcctcttggacttaaaggggactgggaaagttataagatggttcatgatagtccatcaacatcccaagaacaaaaacagatgttgtactgacagcatcatatgatcatatgcatgtaagagcacattcatattgccaaatcagttggaatttttcacggttgaaagttaaatgaaatgcttagatgtatgagtcatcggagttaaagacaattacagccagatttatggctgtgctaaaataaagctagttagaaaacagaccaaattccatgacgataccaagtctgactaatgattcaccttaaatttcggagcaacatttatcctcacttgtttgtttatttgacaatgtgcccttatccattaagtaactaggaggaagggaaaagcactacgtgggtgagtgacaagacactgacactgatttgtgactttggataattcctggatgctgttatctgttttggcatagagatggatctgtaactgctaataattgccgactgtgaccatcccagaggccatttacttaacccaggtatttcagacctgacagcccgaggataaacacgatttccctccatcactaacttcatctgcagggcctaagcctccttcacagtctctccagtgatttattggcatctccaagggtatctcacatgtgctgaagaacaaatctgctcactttcatctgcttggttttcccttttgaaatctgctgctttaaaattactaagggaggaatcatgcctgctgctacccttgccagtgaccttgcagtttgtgccctgattgttctaattaccacaatcaaaacagaagcgtttgcagttactgcagtgctctctctgtggatgtcaggtctgactcagagagccaggctggggaacagccatttccactcttgtacctctgcaaaaggacttccatgttccgtaaacagactcccacctctcattttccccccaagcaaagcatcataaattagagagcatgtaacgggaaagaaaatccattagccatttgggttcagtcagacaagccagctcatggaaagtttatacaggaaggtcacatttcaattgagatcaggagggtgaaagggtccagctgtgtgatgagagagagaatgttcgggaatgtggaacagaggtatccaaggcagaacaaactcgtatatgaaggctttaagggtgtgcaaatctagcatattttatgacataaaagagtcctgattagctagaatatgatgaatgtgagaagaggtgaaggctggagataggaaaaattattccagatcttataagctatagtaagaaatttgcatattatatatagacttgtgggaagccattggattttgtaagaaggagattaacattatcttatttatgttatttgtgatttataaccccaaatgtgccagatacaaacaaaccaaaaataataataataataacaagaagaagaacaacaacagcaatggaactgtggtgatggttttggtcacaaaatgcatatatatctatttttcacaatgcaaaaatatttcattatttcaaattttaacataaatgtgggtatgcatgagcttacaaatcttgaagtttattggggaatattggtgagcatggtttttattgcatggtcacaacttactaatgggaaacatctgaatacctattgagttaatgcatgcacatttttattttcctggaatactgagaaaaaggttgctacataatgtcttgatagcttctaagtcatggctcaaaagtgaatgtggaatctgctaatcggaatggactcagattcagccaagttctcaaaaacatttgctttcatagatgtcttcaagaaacaaggagtcttgaatttaaattgtgaagtgtctatcttagaatagagagatttaaaatctgactgtattttgtttaaaaaagcctatataactgtattatataaaattatttatactacagttaaaaaaagaatcccatcctatttgtgcctaaataagtgcctgcttgtagcatgaaaactatttgttgagggtccttagatcctcagagcatgctgtgaaagtaggtacaattgttctttctatataagcctcttaagataacagataattgccagaaatacagcacacagtacaaaattaccttgttttacttttgccacaaaaaacaatttcttttggctttgagcaataaagtccaatgatttttttcctttcaaaatatcttcctccctctccataagttttatatttattcacgaaggaatattccaatatcggatgtttttgtctgtgtctcttcctggaacaaatgttaattaatctctttgggtttgtatgtcaagtggaggggtggggattggggacaggtgatagttgtctagggagttaacttcatctctataggagagtggatagacgctgtatacgaaaagctcttgaaaagggaaatacagcagccacttcctcagggcttccatggtggtcagactccttgattgctttagattaactctggcttttgtccttcggaggccaccagattgggtggatagacattgtccttgctgttcttttgacctacctacttgtactttaggggaaaaaaatgcctgtaataggttaaatgctttctcaaagatcaccaaagtatataacacatggcaaatagacagagaaatgagacagtataatcagtataatttataaaagtaccttacagcaggatcccatgggatatgggttttttttaaaaaaaatctacctaatcttttcattgaactcctattcaggattcattatattgaatatggctcagagacctggaaaattgtttccacctttttaatttattcaccatcatttatggaagttttcaaggacgtttacttacctacctcagttaacagattgtactacttgggaagtctataaatatgagcttaaagcattttctgagttttaaaataatttagattgtgtagaatgttaaaactaaaagaggaaaaaattattcagttcctcagttgaacctagcaatttatcttttcacagtgtgctcaagtatagtttttgaaaagtaaagaagatggtttttatacaaacataaacacatttcaaagattttattcaactaattaattagtagtggagccaataagctggtaagactggtttaaaggaatatctgaggaataaagatttatagaaacagtcaaagaaattctaaagagaattgactaatagatataaatctagtaaatatttgattaataatagcagtaacctatggaattatgttttctactgagcataaatgagcatgaatctctttgggtttgtatgtcaagtggaagggtggggattggggacaagtgatagttgtcaagggagttaacttcatctctataggagagtggatagatgctgtataagaaaagctcttgaaaagggaaataaagcagccactgcacatctgcacatataacctgtagatctgggggctctaataaaaaagttaatggcaatgtcaaaatcaggtgttttatcttagataacttcatagtcattgattgagccccttaaaaataacatttaaaggacatgtagtcattctgtttctttattgccaagttttcagcaatttttctcatgagaatgagtgctaagaaacttttggtggagcgtggtggctcaagcctgcagtcttgcactttgggacgccaaggctggccaattacttgagatcagtagtttgagaccaccctggccaacatggtgaaaccttgtctctactaaaaatacaaaaaaaaaaaaaagtgggatgtggtggcatgcgcctgtaatcctggctactctggaggctgaggcacgagagtcacttgaacccgggaggcagaggttgcagtgagccgagatcctgccactgcactccagcctgggctacagagggagactccatctcaaacaaacaaacaaacaaaaaagaaacttttaaaatataacaatagagacattacataggcccacaaaaccacctccaaaaaagcattctatcacctgcaagaaagcatatatatatatctgcttttgtgtatatatatatatatatatatatctgcttttgtgtatatatatatacacacacacacacacatatgtgtgatatcagcatgtgtatttacacatatattttgtgcatgtatatttttaactaaaaatgtgctaggagttagatatgaactgattttggaggaggtgatatgctgtagagagagagaatgggagaatagcagtattataatctctctccattgtattcagtttttttctttgtctgaatttttaatagaagtcagccagaagatgttagtttctgggaaatgtgttgagatttacagtcaaatccagagagaactagaggcttatgagtaaataagtaaaggttatgcagagaaagtattctttttcctgtgtaaacttgaatattggccaggcgcggtggacacctgtaatccagcactttgggaggccaaggcgggtggatcgactgaggtcaggagttcatgaccagcctgtccaacatggtgaaacccattctctaccaaaaatacaaaaattagtgggtgtggtggcaggatcctgtaatcccagctactacggaggctgaggcaggagaattgctttaacctaggaggcggaggttgcagtgagctgagacagcgccattgcactatagctacggcgataagagtgagacttcatctaaaaaaaaaaaagaaaagaaaaccttgaatatttcttgtacttgtgttcaaatcatacagttatgaaagtttacccctagctgttacacttaaaatgtacttctgaaatatacagagagatgatacagactattaatgagttccactaaacttttaatggtttagaaaatacaaatattttcttatttttctggaattccagccattaatgtaaaacattggtttcaacataaataacacactggcatgcacatatgcctaagcatgggcccccacacatacagacattctgaaagaccactttttaaaaatattcagtaccgtatattgtgcattccttctttatccacatacttaagctgctgcaagcatcccattgataacaccagtaataaaagatgggaccatcagtaatgagatttgaaagccccttttgcaagaaagtaaggactagaaggtggaaatcactctgtcttagagtcatatggattggggctttgctagaagtgtgtgctctcagggaaagctgcctttttattttctccagagaaaagcctttttgtcagtaaaagaagatgtatcatccaatgcatatgtaaaattctaaacagcagataaaacaacattcactattaatctctgcaaaagaagatatattgaaaaaatcctcaagtgtccctctttgggtttctttgttatatattaaagcagttatctttagatgcatgagaatcacctgaagaccttatttttaaaattcagattcctgtcagttcactcccaaagattccgattcagtagttaagagacaaagcctaggaatgtgaatttacaatcaacacctcaggtgatagccatgcatgttcttaatgctctactactatctatgcataaaaggaagataaagttttaaaaacttgaaatgtggtataacagtttagtattgaataatatacatttttacttattgtaacaaattatgatatctacttggggcaacagtatcttttattttggatctgaatcctaattttggctaggtatcactgagggattcttagtctaaaacaattaaatggagttagtggttttttttagtaactcttgattttctgtttttttccattggcatcttacaaaatttattcattcatttttccctttttcacttggcattatttgttagacagtggacaaaagaactatagaaagtagagaagcatgtgatgttgtcctgctcttagattctcgcaactcaggagaggacattcgcttacaccaatcatctcaaaacatggcagtttatgctgaactcagtccaatgggagagcatttgactgagcacatagggagagaagttagctctgttgaaggataatcaacgaagaattcttaggaaaggtacagtcattcattgaatatttgctcggcacttactaggtgcatatgtgcactaagatctaaggatgggctgatgaagaacccaggtcccttttcttctagtggacatgcagactggcctaaaaaaaaaaaggtaactggaaaatggataaggaaactgagtcactcggtttatttattatcactcggtttatttgcttttgtttgtattttcattttgacacagcacagtgtcatcttaacgcatcctccaaagtgaaggatggggtggataacactttagttggcatttctgtagccaggagccaggatctttctcccataattgcattaacctgggaaggcaccctctaggtagatttgtatagcaccctggttaatcaattatcagtttacttcttgtctcactaagctttaacaccttacatttatgaagcagtgtaaatataactttagcatcttgatcacagcaagcacctgatttgtatttttttattagctcaagtgaaatcagatcagagaagtacattacaggtcataaaatatgtgcaaatttcataatgacctccttttaaaatgtgcaaaaataagattgttaaggcacattccagagccttggggggtgtgtgtgtgtgtgtgtgtgtgtgtgtgtgcgtgtgtgtgtgtgcttgtcttttgagaatatctgtatatcagaaaatttggctgagaagcaatcttcttcttagtggttctttttctcttttgaaaataaagtactaaaaatacttaaagatgcagaacagcaacctgttcccagtgagactctcgtttaattaatgtggtgatctatatagagaaaagggacaattgcaaaagtccctcaataattatctaaccacagtctttaggtaattacagcagaaagattttcaagacacaaaacaccctggaaaatttgacctcttattttgattcaggcctttcatttcttaaatattttctttaatgttgatgtttatgcttgacaaggtcagcctaatgccagatgaatccctggaactcaaaacattgctgaattcacagttgaaggattttaatataatataccagcttttaaaaatcctacagtgagaataacaggactgaataaaaaaattaagaaatgctcaggtagaaataaatagagaaatttagaaaaaaaataaaacgtattcaaaataagtattaagcattggcaaagaaaaaatagtagcagacaattacatgttccatttgtaaagatgattattaattagtggtcttgcaaaacattggagaaaatttgctgaaccatcacattcataaatattaaaaccacccattagtgaaaatctttttactaaacttcacaactgatagtcaaataatgttcagtttttctccattgcaataaaaaataaaggcttttgccttcagatcagtctctgggccttattaattcagtcagccagaagccacatggaaatattttgttttgttaaaagccagcttgccctcatgatcttttaaaatcttttaaaaatcttccatcagccctctccctgacttgaattatggcagtgctttctaaactggtaaactcaatctccttggtgtgcctcaagatagagtacataaaccctccttagaaattgagctctcaattctaaattgcactctccatgagagcaagcaagaatgctttgctttgtattaagtggtcacaatattaaatataaccatagacagcactgtattttctaaacaccttattttcttttaatgactgacataaattagatcataagtatacaaatgcatatctgttgtatttttcagcaccatgtgtttttttttcttttttctgagttattttcctgctttcggcagccttttctctcaggtgccttgtgatccacagtggtgtgtgttcacactaaccaaagcaatagtcttacctgccagaaatagctgtgacatttaaagagaggtccaggggaaggcacagtgcttaacatccaagtctgaagagctaatagtgaaattggggcatcagctacagagagatttaggggaagtaacaggcaggttaaatattttatggaaatgatttctgttctgtatatgattgcaattaacacatgtcaatctgtttcattaatttgttaactcatctattatgctatgccatgaagaaaataaaattggagttctttatttttttgagatggagtctcactctcttgcccaggctggagtgcagtggcaggatctcagctcactgcaatctccaccacccaggttcaagcgattcttctgcctcagccacctgagtaactgggactacaggtgcgtgcaaccatgcctggctaatttttgtatttttagtagagatggggtttcaccatgtgggccaggctggtcccaaactcctgacctcaagtgatccgcctgtcttggcctcccaaggtgctgggattacaggcgtgagccaccgcgccccgccacaaaactgaagttctaagcttcagtttagatgctcactaaatgcttgttttgcaatacctgactgtaactggcaggaatatgttttgaaagtcctcattttccaggtatgcagatgaaatataggggcattatctactatgtcaaattataatgatttatcagtggcacatgaaagtcgcctcacatttcttaatcagtgatataccattatgtcatgccaccttttaatgtaatatgtttatatctttctttagatgtaagcattcatttagttcatcacggtggctttcacacttactccaagaacgctatgagttcctttgatgtgctcaagtctcctgccccagggagaaagggagtggtgagcaggaatcgctttaatctatttacacagatattttcttttccatttattttaaaggaattttttttaacttaatgagtatgcagtgacggtggtgatgatgatgatactaaggtttaaatgattagatagtcaaatctgggctggaattgtaatactgttttgacttttaatcttagagaagctccagtctgcttattttctgggcataaacacatgagaacaataacacagttctgttatctgaatgttgttatattttgtttgaaacattcagtgactttcaaatattgtatttgcctaagaaaattcaacagagtcagacattctcttccaggttaaatttggtgagtctgctaggaaaataaattttgtgcactggtcattctgatctagtggacgttctaataaaagcacctttgtgctgcctacgtcttcactttaaagataagatacctgggtactcgacaccaaattatagtttgagatctcaaaaatgggatagggaaaccacagctcaaaaacaaaaatactagcactggaaaagatagaactagtgaagatgaatcattctctagactttaaattcagagatatcaaaattaagaaaaagtaggaggaataaaaaaagagggtaagcaaaacaatataagtttgtatagcaagagggtataaagcaaatacaatatttttcagaaaaattaaataaaaatagatttacataacattgtttttaatctcaaagatcaaatttcaattttcatctcattttaaaacccatatgcacagtctcctttatatacatcagttgggtgtcaaagtgacttttttcttgtttccaaatacagttatttttaaaatttaattgtatgatttaggaatttgaaagcaagccagtttgcacacacatatgttattatatgtgtgctttagacttggtttttagttaatgtaacatgacagggccacctgagttatttgtttacaaactagctggaaagccaccctggaggagaaacctggcaacaaaatggtctgcagctttgttattgttatctataggattggatgccattattgctgtaaaatagttcacaagaactcagtctatgggaaagactcaaaaattctttgcctgttaaagaaaaatcaggatattggactggttagtttaactaaaaagtgatgatactcagattctgcttggattcactgcttctcagcagttgttttgtttctttctaattgatattttatttttcagagaacccattataaaactcttcttcttcccttaaaatcacaaccacacaacagcaattaaaacatgctttgacgtaagactgatatggttttaaacccagcttgactatcgaattttttactttaggcaaaacacctctgacatttatgtcttatcgtcagtaaaaaggggtgattaacagttttacaagattattcaataaataaatataaattcctccttttccttcctttcctttcttcatcttcagcatctgcatgccataagctcattttagttctctggactcatgttaacatgtcccacctttcccaaattaaacatcatctctgttattggctccattcttttcctctcatttgagacaattctttatcaaccaacaccctctctgctctgtattgtgaaactctgctcctactacattaacagtctcttggtttctttaaaaagaagacaaaacaattaaagaacagaagcaaaaaatctactcaaatccccaattgttaccctcaaaattaattgtcccacccctagctttctcattgcacaactctttgtcaaaatgttttctaccatcacagccttcaatgatctttctggttcctttatctcctgaagtctgacttctacctccatctttttctggactattcaacacactttgagaaaaaacatacttttgttaaacaggtatgcatccctgaagcataaaatacatagtactgaaagtgcacatgtgtggttcttcccattttttttacagcacttgaaactgacaagtagtagtaccaattacttagtaaaagacctttttcatttcatttctgaaatattgttattttcctttttcatcttccatctctgactacacctccaattttacctctttgctgccttccttcctaagaaagttcttcatgcaatgccatcttgtttttcttcacttgcctctttttctcactttaattttatgaactctgatgacttacctctgtagtgtaactactcaaaatatgtatttctgaagtctcaactccaatctcatattttcaacttatatttatggaggcatctcagactcaacctacctaaaaaatggcttatctgccctaaaatctactttgttctttttttctctactgctaataattatcttcctagttggtcaagctcaaaacctaatcatttttactccttgtccctgtgtcagctgtccacattcaagcagcgtatcatttctgcacatttttcaagcaagtcagtaactgccttttgtttgggactgtcttttcatatagtgaacagccttggaagatagaaatcatttctccttctaaaacaaaaggcaggtgtgcttgcagccttggatagaggtagtgcctctttctaaagcaaagggacatctttactggccattataaaatatccatgtttcctgagctctgcgttcctcttttctaatgcaacccactgagcatgtaggtgtcacctgagcttttctgtgggaattgcggcttgaggaatcagtgcaagaaaatcatgatactcttgctaatgctattaatgtgagtagtaaagttaattgtctctgacccagcactattgtgtctttgcccagcactcaaaagactggcaggcttgcaagtaggacaaaatgttagatttttcacagttcttctgcttataagtacttgttaaaaccaattaaaacacaacttgtagtttgcacctataattttgtagcatttgcttcttatctatgtcactaggatgtgcttagtgacagacccatctatcatctattactcaagtttttggctgtattcctaggcaacagagagaaggggaacaaacaagaggacctgtgcacagtttgagaaaggcaaaacaccgagcttaattgcagacttgaatgtagctagcaaacgaagtaaggcaaaaggttcctttttttttttttagatggagtctcactctgtcgccagtctggagtgcagtggtgctgtctcggctcactgcaacctccgcctcctgggttccagcgattcttctgcctcagcctcccgagtagctgggactacaggcatgtgccaccatgcccagctaacttttgtatttttagtagagacggagtttcaccacgttggccaggatggtctcaatctcttgaccttgtgatccgcccattcggcctcccaaagtgctgagattataggtgtgagcctccgttcccggccaaaagtttccattttttaaatagttgggtttttagtttcgattctttccaaaaaaaggttttcttaaaaaaataaaattagcaataagatgaaatataacaacaatataatcttattaagacaatatatgatatacatttatcaaaatacttatattttcaaaagtgcttaaaataatctagcacatagtagatgctcagtaaatatttgatattatgactgtgcatgggtcattataggctactttatgtatatcatttcatttagtacaacatcactctgaaaaatgttttattgttaccgtttttcagttgaaacatttacgttgctcaagatctcactggtaccatctactattaggtcagtctgccaccaaatctcatgctcttaaatgccctttttctcctgagcttccaacaaatagtgtactgtatataattgttgaagggaggggactgtgagacaaaatatttagagtgaatgtgtagccacaatttcagttcctcaacaaagtgataaaattaggaatcatcctcaatatatattcttccaacacacacacacacatacacacacacacacacacaaataccacaagcccacttgaatgcaccccacctacacattgcaaccatagagacaattgcagcattaaatacagaatattctgtgtgttgtttgtttgttctccctttgctacaaaaatcagaatttctactcaataaacagcaaagggagatacaaatgaaccaaattaaagaaggaaaaaatgttgaaaaaattatatacagaactatgtattgatttattgagagttcagtaatgtaatccagaaataatggatgccttaaaagtaattaaaagaatgcaaataaacatttagtgccaattaaagaaaaagaaatacaacattagacaaaataaaagatattcatttgatgcaatgaggaaataatcttttattcctctttaaattctctgtggaataaggcatggttataaataaataaacatctgccccatggacttaatggatcgttatattttattgcgataatcataatgaaattgttgggagggattagtatctctagtgtaatgctaagaaagataaagcctgtgcccaggcaaaagctttcttggttggtcaaaaggtttgaagacatttcaaactattctaaaacaaacaaacaagcaaacaaacaaaaaacatacaatgtctttgccacatatttaggaaacaaaatgaacaatttatttctgacaacctcatagtctttgttctgtcagaacaataatggaaaggtctaaaccagaaaatgctatgcattgaatttataataaactattttttcctgtaacaaaaaattgataaacttgatatttgcagatttaatgattatgtgtttaaaaaaaatctggtttttgcccttgcaaaaaatcatatatatacacatagatatgtatgtgtgtgtgtgcatagtatatatatatgtatatacatatatatacacacatttatatatataaacatttcctttaacctcctattttattccaataaaaatattggtattagagatagttctgatatttcatcatgaatagttaacattgcatttggaaaggattaatttttttgaaacgtaattttaccttaataagtagcccagcgtaatattttagtaattacacagatttttttttcaagacatttgacaactaatattgcataatagttaagagtgtgggctttggagccagacttcctatctctgttcattcactgataaaatggagacagtagtaacttcctcaaagagttgttttttaagatcaaataatgcatataaaactcttgaaatggtaccaaatacagagtaagcaccaaataaacattaactgttattgttattccatgtccgaataacacagaaaagtaagaattttaatatttcatttgaatgaccttttaaggatacacctagcccattatctttcttgataatcttgtaagatgattccttttttatctccgatctgttgaggcatggatagaggttttcagagaaaacattttctaggtaactgaaagaaagtagcaacaacaaactgtgacaaaacttaacaatgagagaatttacaagatagaataattgcaactccttttgaaatcaaccactatggtcctctggctgggatagctaagcaaagatattccagcctgaaggttgagatctacttgaagagttttctatccagattgtgagggcccctcaaacttcacttagtatctgtttctattagtatggaaacttctggaaccttgtggtatcacattcacttgactactttattcctgctctagctatcttaaagcctttcttaatcttttatcttttagagaagatacttctaggttttaaatccaccgatcttgaagctattgccttcactctctgcttcagagcccatccttttgtatatgagtagtttgttttgcctaaagtactttctcccagtcagattttaagtccagtttctcatctgtttttgagagcaaactcctgggccttggctcactaacatcttgacagcatatttcttctttcctatgggcttttcagcattccctgggtttttctaaaatatgaaagcagactctttatctcttactttgtcaaagcctaccctccccactgatttctcacccagttgctagttttaagacctgcctctggccgggcgcagtggctcacgcctgtaatcccagcactttgggaggccaaggtaggtggatcacgaggtcaggagatcgagaccatcctggctaacacagtgaaaccctgtctctactaaaattacaaaaaaattagccaggcgtggtggtgagcgcctgtagtcccagctactcgggaggctgaagcaggagaatggcgtgatcccgtgaggcagagcttgcagtgagctgagatcgcgccactgcactccagcctgggcgacagagcgagactctgtctcaaaaaaaaaaaaaaaaaaaaaaaaaaaaagacctgcctccaaatatcattgtatttgcaaacatgaaatgacttattgattctgagctcagcacaagagcaaacctttctcagcttgacccatcttcacatcgttaatgtcttattcagtcactacccaaggggctgaccttcaagattctaatccatgaaagcttaaaatagtaaacaaatttgaatatagtttaacatacataataaattttatttctagaagaggaggatcagcccttagacatgaaaagtaaaaatagtttattcccagatttccctttgtgcattagtatattcaaccgagtctatccaagtaacaggacaaaaaaagctggcagttgttgctgcgctgtgaagtcttattaggtgagtcagctaattatatggcactaccataaatacagcaggcactgccctgcttgttaggcttgccaaggaaaataaggatttaaagcagcatactacctctttgctatataatgacattttcttcttaaaaatgattttgcaccaattcctgatttatccaccaattattttttaatttatggttgaatgtatttaaacctgaattcagagataaaactagtaaatagctccccaaaataaccccaaatatatttaatatattagctttactctctcctccactgccaaacctttaaaaactgaaataaattgtttttatttcatcttttctctttttctctctctctaaggtgattgccaagactaaagaaacagctagaagggcaaaagacaagaaaatcagtaagatagtaacagattatccaaagtagagcacggctcaggtgcagtggctcatgcctgtaatcccagcactttcggaggctgacgcaggaggatcacttgagtccaggagtttgagaccagcctgggcaacataatgaaacttcatctctataaaaaaaaaaaatttaaatagccgagcatggtggtgtaagcctatagtcccagctatttgggaggctgaggctggaggatcacttgggcccaggagttggagactacagtgagctatgattgtatcactgcattacagcctgggcaatagggcaagaccctgcctctaaacaaaagataaacaaagtagagcataaatggcttctaaatatatgttatttatgtgtaagactgggttctctaaaggtatcatttaattaaaatagatttgcattctcaatctgtaggtatggattatgtataatgtatttaagatatgacttacagcgttcaccaatgtgactattcccaagtgatccagatggctgatgacatagtaatttgtacatttgctgagacctgatctgagtaggtatgtaacataactgagggagagcaagtccatttgccgaaagaaagcctagcatatgacccaggagccacatcttcactcagccttgttgctaggtttggcttagcatatataatagcatagcatgtataatttatgacaaaaaattatactttgcactttttaattagaacattcaaaatgatctcaggaagtggcaccagagatcatcagtggtctactgtacttcgtgtgtatgtgtctgtgagtatgtatgtgtttgtgtgtgttcccacattctaaggcatgtcttttacaggttagtagaaaatgttgatagaaaattatagatttcaacatctaaaacacagtaggtcactacattgttaaaacttggaattttttatcttgttgtaaagtcaggccaaccaaacctaaaatactgctacattgaaatagtgcaaaatattcaaaatactatagttatagatttggtagtaggactgtaccagacctgtcactctatacaagacttatgccttgccctttcacttacctgttcccttttacatctatcttactagatgtaatgctataaattatatttctaatatattataatttatcatgtattataatgtatcaaatattacaaattatgttgcaactccccttacctttcgtctgcatattgcctcagaaagaacagatggatccaacagacttcaaccacaggcccttagtgacaaatagctcttaatgctgggcttgccactttgatgcatttctaaagttatagaatgttaaatgcaccaagtcctttggtcattttatttctaccttagatctaagccataactatactttcccaaaaattaaagtttgaattttaacttaaccatatataattggaaaaggaggttgggttcgttaagtgtaattttatcatgctttattatcctttgggcattggatacagcagaacatgccaatttctatggcttctcatgtgacagaatatacttactaggatgcaattaaatactcctcagagtatgtaaacaataaatgtaatcattacattatttttatattgttctttcttatgcataatagtaagactgaaaatatagtgttatttctgaaatatgcatattgttttgcttttgatgattaaataacattgtccaaagttttaggttttttgaaatcttatattttttaacaaaatatctagcctttccaaaacaagacctcaataattcgtttaagacccagagttgttcctctccacatagatctcttaaaaaggcagaggatttatgacctcaagagaaatcagagtatccaaagtttgctttaattcaatgttttaaaaataaaattccttagattttatcaaaaattgagattagtttgattttgaatcagatgccctttgctccccaccccaaaatggcattatgagcagactaggaattgataatagaaaattgaacatatgaaatatatctttaccttgctttttaacaaggtattcatgtctatcgccttcatttttaagtgcatcaataaaatacatggtaattctcttagtgaaatatactatctacactatgtacacactcccctgtctgaggtagagaagtagagaatattcacatttttgaaacgtctatgctatttttatttaaatacgagttctgggcttgatttcattttggaacacgggtgtgtgcttaagttgaacctttttttcctcttaagtcaaagttcttttttagtttcttcttttatctttttggctactatctctctccttcatcctcctggtgtgagttgttgagtgaaggtattaattccattatttgaggctaagtgacattgttcaataatgcagcaaaacaatggttctacccaaaatatcttcaagtgtaaaagcagtgggcaaaagagaaagtgcgcttctgctgctttgaatgtttaaggctgtgaaagttgatcacacaaattgggtcattcttgttatacccaactaaaacaatcaagaagcctgggaggaaaagcattcaagaaacatcacattgctccaaaagtgtaattttctacaagtccgcatgctgaggctgcctgttgtaacctgggaccaattttttctgtaactgctgaaaaaacttgctgcagctctaggactaattttgcccaccactgtcactcaccaattgaagcttactagctccccagaacctttctagtgccaatgaactttctcaaagagcagcgtgtatcatttctctttttcagaacacctccaacctcctctttgttctttgggtataccaaagaccaaccagccttgaatttcaatttttcttcccacataaaagttttaatttagaaatgtatctctacatttctaactttgacaaagcatagataccagataattgatgaaaccttgctattttaacgatcaccatggattacttcccagtgtcttcagataaccctcaacatttgccaacatttgatggacttcaaaatgagcatatcttttttaaaaaaaattattcacactgacagcaagtacattggtatactctatattaaattataccacagggtttacaaacaattggtgatgtcgggcagtggtttccaaggaacatacttaacaagacactcacaaggccctacaaacctgcatttttaacaagggccctagatgattctagaagagtgtggtttggaaagcaatttttgcctttattatgtgtcattttaaatatatttaaaattaaagttataagtcatagaattgaataaagataatttccttacagaaagtattactaggtatctaaatacaatatggttcaaaacaggaaatttaaaaagattatgtaaattctgtagttgtattcctaaagacagtagctgaaattttttcctacttctccttgtatcacttcccttttccttcactttcacttccctggaattgtacttcccaataagctattagcagtgaaggaagcttcgtctcatgatctgttttatagagcacttcagctgggacgagtacgaaatgataatcagttatatcagctattcaaccctacaggtttatttaaaaagaacttgaataagctttttagggagaaagaggtcagtctcagccatttctgtttcctaatatagcttttaagtctttccttattagcaatgagggtcattccattgtaattttttgataaccatttttctttctgtgtgtcaaatgcagatataagatactgaactgagtctatttcactgttcgtaaaacaatcccatttgaaaaaaaaaagtctacagctattccagggatagggcctagtagagagagaataaaaggtattttcttactatgtctctatatcctaccctgtaggttctcttattaagcatacaggcatataccaaaatccagacgtttttctcatttattttattgccctaacatattctgggttaatataatatcataatgaaaatttgagaaaaaattgattttttcaaaagtgtttaacatttgttatattggtagttttttttcttgtttgtggtaaaaataaatagaaggtgcacttcacaccttcaagtatgattatattttgaaaacaagtcatgaatactcataaaatgcaaattttaatgttctttttttgttacagccaaactatattaggcacagttgtaaattggagttgaaatttaatatttctttatagataacaatgtttttagaaataggtttatgaaacagtaaatatacaggtatagggataaaattgtgtctgatggtcatatgaagtgtttgttgttatattctccttggaatagctgccaaatattttagtatgcttaaaatctacgaatgtgatagagtcaacaaatttagatcacatattcagaaaaacatagttagagaactaactattgaaatgagcatacagcagtcttcctttatctacagggatacattctgaaacccccactaggacacctgaaattgcggatagtagcaaaccctacatatactgttttttccaatgcttatgtacctatgaaaaagtttaatttataaactaggcacagtaagagattaacaacaataactaataacaaaagagaacaattataataatatactgtaataaaagttatgtgggtatggtctcgctttctctttccctctctctctgtctctaaatatcttagtattttggggttgcaattggtggtgggcaactgaaaccatggaaaacaaaaccacggataaaaggagactactgtatatactttttaaaactgatgaaatattaaactcatgtttcttctatatcccacccatttcccccacccaaacctagatagatatcttatttgatctgtaaacatttaattaatttgtaaaagttaagaactttttgaagtaaaactgcaatatatcatcacacctaaagaaataaacaataattcttaaatatcaagtcagtgttcaaatttccccaactacctcatatgtgttttccatttgcttatgtagggttcccaatgagaatgaaataaagttcttaggttgcaattggctaatgctctctcacttctactttaagcggcaggttcccactaacttctttttagttgcaatttacttattgaaattagacgtattctttgtcttgtgtagtttctcacagtgcaaaatttgctgattgtagccactgttgtaagcaatgaacatgtttttcaccaccttatatttgctgtaagttgtcagtgatagttaaatgttaatcaaattcaaattcggatcacgtagggcttttctttttttgttttctttttctatttatatatttatttatttattttgagacggagtctcactccgtcaccaggctggagtgcaatggtgtgatctgggctcactgcaatctccacctcccgggttcaagtgattcccctggctcagtctcccgagtagctgggactataggagaaccaccacgcccggctaactttttgtattttagtagagatggggtttcaccatgttggccaggatgctatagatctcctgacctcaccgatcatgtaggacttcaattgtcgaacaaacgaacctttaatagcagttacaccattaggatgacctgatccaacatcgaggtcgtaaaccctattgtcgatttggactctagaataggattgtgctgtcatccctagtgtagcttgttcccacttgatgaagttattggatcagtgaacaatagcccacttaaactagtacagtcttagtttaagatggtgatgtgtatgtacttccatcagagggcacataatacagtaaatcctcacttaacttcatcaatagtttctggaaactgtgacttgaagcaaaacaacatataacaaaaccagttttaccattggctaattgatataagcaagaattaagtcctatggcaaatttctggacacaaaaacaccatcaaactcctaaataaagataaatcacttctgacattaaacattgaaattaatgtgagctatatatacgtttaagaaagattaatacaaacaagtcaaataacttacctaattatttcggtggaggccgcaggtggttggagcctatcctggcagctcagggagcaatatgggaacccaccccggacaggacgctgttccattactgcagggtgctcttgtacacacccactcacccaggctggaaccatgcagacacacacactcacctaacctacacatctgtgtacatccttcaaagttcagccaaataacatataaacaaatccagtaatatccatcagtcttagttccgtcataacaactcctttttgatcatcaaacaacaaacagggtaggtctgccatatttacttgtctggtccatatcaaaattttctaacaaattatattagaaaatcaaatctctgtcagtttcaaaatcatggaaaaaaatttgccttatttcccttatacttggatatcctaacagtaatctaaatattaatgagaaagttaatgatgtcgtttccttctccctgttgtaaagaaggttttgctgtcccgtttgatcactaagactaattgacactcagaaaaagcataggaaacttctcagcatcacaaaagctctgtcatctagagaagctaggacttgagctcaagtcctgtgacatggaaggccttgtgcctagccatcctgcagcagaggcgtatctaccaagaagtgaaacactacgaaaacagtatgtttactccacattttaaagtgaggtagtttggggtggttcatattttatttaatttatatattatttggattttttttagtttataaaaagggcattggcaagggcagaatgatctgtaagcttctctgcccacctaccataagcatgatctttagtgtgaccttttcttactgttagccattttcttatacttctgcgtccctgtcagtcacttccatgtgaagacatggggaagcttttttacatcagacatgttgttgaaaatcagccgcgttggctgagggattatttgatctctttctccaagtccctttaggctcacattgcctctctgttctttgaattttcacttacctttatcttcttataattactttgctgaaataaatgcaaagcaacaaaaggtatttagtgaagaataccaacaaagccatgaccatttcaggctgagttttgtagtattctttgtctaggaagagatacctagaaaaattttctgaccatgtatttgattattttccttcaatatgtatagtctcagtcttcaaatttcagaaaagaatttgtttcttcattgtcatttaaaattaatgtgttaaatatgtatgcttttacattataagtggttataaaagttaaacacttagaaaaaaagtcaaaataacatacatactatccaacaaaataactttcatattttattgtgttttcttccaaactttttacctttgcgtctgaattctgtgtaggttgtatctataatatagacaacactttatagcctgctaaatattataccataaataggtagttgttacataattctcaggtaatagtaatacaggtctttatcataatctactgagtagttgaatgataattttttttaagacaaggtctccctctgtcacccaggctagaatgcagtggcatgcacatggctcactgtagcctctacctcccaggctcaagtgatcctcctgcctcagcctcccaagtggctgggactgtaggcatgtgccaccatgcccagctatttatttgtatttttagtagagatggggtttcattgtaacagcccaggctggtcttgaactcctggactcaaatgatccacctgcctcagcctcccaaagtgctgaaatcacaggagtgaaccactgcacccagcaataattttttaactcttcattattcattgaacatttagttaacaattctaaaaattttgtttcctgctgtcattgatcttgtgaaaaatatctttggactatagctgtggattatttcctaaatagtaaattacttgagcaaaaagtttacatactttgagggttgataacccatgttgccgcaatgtttccccggaggcattgtggagtttagaatgccagtagtaatattaaggtgtgccattttcaagatccgtggccaacatccctatatgtaagatttttccaaaacatggttctgatttttaaaagtgaaaaatgctacttcatcatgttctttttgtgcttcttactttaaatattagaatgaagaaggagccccacaggaaggaattctggaagatatgcctgtggatcctgacaatgaggcttatgaaatgccttctgaggtaggagtccaagctgaatctttctaacaagacagtaccaaaaacctgtcattgtcacatttctctttcattagtgcttagtgagaatcatttgctctctacatgctcattacgtggacaacttgcaagttaagaatagtttttacatttttaaagggtccttaaaaaaaaagaggaggaggaagatgaagaagaggaagaaaggatgtaaaagaaatcatatgtagtccacatagcttaatatacttactacttgaccctttacaggaaaagtttactaacccctgcattagagaatatatttttagaaactttacattctaaaataaatttctaaatggaaagttagggaaatcaatggaatgccaaaggaaggttattattttttgccatacatgtccaatgggatgacgcatagtaaaataaaagttacccacacaagttatagaataaaaagataaatgcatgatttgcgacaattgatatattccagtataatgttttaaacaacacaatatgattgttaattttattttgattgaaaatgaaagtatctttaatagaaaatgtatcaaaagggaaattagaaaatactgttagatgaataaaactggcccaagaagaaacagtaaatctgaatagatttgtaacacagcgaatagattaaattagtaataaaaaaaaaaacctacctgcaaagaaaatcccaggccgagatggcatcactggtaaattctaccaaacatttaaagaggaattaatactaattagttaacaccaattaatatctcttacaaaacagaagaggagacatttcccaactaattttgtgagaccaatattaccctgataatcaaaaccaaatgaagatatcacaagaaaagaaactatataatggctccattaaaaattgagttcaagtatgttgtagtttggttatgtattattcctcacggcattattaaaaggcatgtcgaggatgggcacagcagttcacacctgtaatcccgcactttgtgagccaaagtggccaggttacttgaggccaggagttcgagaccagtctggccaacatggtgaaaccccatctctactaaaaatacaaaaattagccgggcatggtggtacacgcctatggttccagctacttgggaggctgaggcatgagagtcacttgaacccaggaggcagaggttgcagtgagctgagatggcacccctgcactccaatcttggtaacagagcaagactgtctcacacagacacacgaaaggcatattgataataattcaacttatagaaattgagattaaattgtttgtttgcctaataagaatttccaatattttggggtcttttatgcaagacacagtactaaacacaatggaaaactatagagtaattgacattaccaggacataaggagtttacagtctggtaggtttgatgaaaaaaaatagaaattcattcattcatttcttcattatgattcctttaacaaacataattgattgtcttcgatgtaccaggcatcacaggagcaaaaatatataagacatactaaaaagtaaaacattttaaagatctgtttcaatcaatcaggagaagttttattgaggaggtaatgttgatctgggtgggaaaaggtaagagatatagtaggtcaaaacaaacagaggacattctggcacaagggaatatcagaagcaaaggcatgtatgtctgagcatgcaaatggatatgtctgagaacagtgaataattatgactcaagcttaggaacaaggaaaatggtgatagattgaatttgcagctatgggtcaaagacaagttatagagtattaggataatcttgtcatttcagcttgtattctattcagaaaacaacttgagttattgaagttatgcttatttgtttgtttttaagcagaatcctgatattattagagttgctctttaggaggaataatctgatccctttaattaaatccattaatatttgtgttgtggatgctatccagatactgtatggagagcttgaggtttgaaatacaagtaataattgaagccatagatgaagacgaaattttcaactgggagagtgaaagtagggaaaatgtatcttgccttcaaacatcttaatttccttctgagaattagagcatcttagtctggaaaaggctttatagacagcttgattttgttctcacattttacaggtgaagaaactgagaaccagacagtccaacttatttgtcctaccaaactaggtatatgatcattaaatggtgcatccggatcagaacctagatattttaactctgactactactgtaattcacttttatatcagacaagaaagacacaactattaaaaataagataatatttgctgcagaatatttgcaaaaacattgattgtaaattttagtgtaagtggggagccatttcctatctcattggctgtcagtgctgatgcgtaattgaaacttatactaacagtgtgtgctgtctttttgatttttctaatattaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctttttctctcgctctcttttttttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaatatgtatttggtttctgcctccagttcttacaaagagctcctaaaacccttgtaatttcctgagtagtaggggtgctagggtcatcttttgttctaatatttggtctttgactctgctttctgacagagctccttagtccctgggtgagagtagcatcttctcttctaatgaagtgactcttgctgggttcctggatgggggctggtcaccagaaaggtcaagccatgataagaagcttgaagcttttggccccattcacatcttctggggacgggagagaagaggagctggagattgagttaataagcaacaatgcttccatgatgaagactccataaaaatccctaaaagacaggattcagagtgctttgaaataggtgaacatgcagaggtgctgggaattgtggtgtgtccagagaaggcatgcaagctccccacgcctcccccatacctttccctgtgcatctcttccatctggctgttcctgagttgtatccttttataacaaactggtaatctagtaagcaaactgttttcctgaag

SEQ ID NO: 11801 - DNA, 9400 bp, Human
tcatagccctcttcactgactttattccagcaaacatggtaattacaatatcatacaactaagtacagacgacctggctaaaatgtctgcccgatggtctccgagtctcctgaatcaggtgtctgagaattacacagttatactgtacacacaatgcccttctacccgggacacagaaataggtccacactacacggacttttttctcctaggaaaggacgatgctgttcttacactttctgaaagtaatcacagagccctggatacgaagctattgtatgcaaatctcttaaatttgtaaacgagctatagggcaccagaaacatcccatttgaagaagttacattcgttaaaaaaaaaatgctgttgaacaaggctgtaacttactaccttatgaagagttccatttcctataagaaatgtcgggcttcttccgaagacaacgagagaaaacaagattttaagaaattctcccggaaggacattgatttggatcttgtgatagtgtcctcacttcgcaaattagaaagggaaaaaaaaactagtttttattatgatgtgggccgattcaccacaacaataatttaattgaggcgaatttttgcaagagcccaaaagggtggggggggggggggagtttaaaattaagagtttcccaatgctgtgcgtttatttgggattctgaaagcacagaacccgcaagcgaccaagacttttcttctatcccagagcagatagctccgcacttacccaacctggctctaagcatttcgtgtaaacacaaaggttgtgctcaaatcacacttgaaatacatgagagacaccaccaatgcctcccccagaactcccaactacatgcaggtctgaaccgaccggactagagtcagaagcaccggcgcttcaccccttcaggtgtttcgtaaatgccagcaaaagcaggcaagcagcatgactccgccagagtggagcgttttgtctgcggtggtgcccatttgtttggtcttttacaaaccaagtgaccggcctgggcctcgcggcccgggacagccgcattggcaaacttctatctctcaaagccagagcagttagcaaactctcccccagacagggcgactcggctgacgtttttgacccggccaggaggcaaagaccaaaacgtcagagcagtagccctgttactgaggagcgtcggcagggtcgcgggtagagggggctggagaatgacttgtcagagctcaaggtcgatgtggcgcggggcggcctcgagagcgccgggctcctgcgtggccacggccgccgctgccaaccttcgcggggacttagctttgctttccattgactccctttgcaaaagcgcagcagaatcctgaccagccgcaccagccccggcgaacccgagcatgttaatctatttatatggattattacggaggaacagcgggcgttgagtcaccaaaacatttgcttcaaaagactatttctaagcacttttgcaggcaggcaggctcgctccaggcgcgtaaactcggctacgcattaagaagcggctgcttttcgaatactgcaaactccagctaagtccccggtgccgcggagagagcagtgaaaagaaatgtcggaggtgggggtagatcctagtctagacacacacacttgcgcgcgcacacacacacacacacacacacaagattcgcgcggagaaggcactaaaattctggcattccgagagtacgacaaacttacacacttggaagtcccgggtcccccgccttccccgcagcaccccccgcccccccaccctaccgtccgccctttggctgcgatcccctcccctctcctcccctcccgcctcgtcacccagcccagtgccacaatcctcctccctccccaaaatcgggtccaatcagctgcctgccaaccctgggactgctgtgctgtgattggcgggtggctctaaggtgaggcggagtatttattaaagagaccctgggctgggagttggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggaggtaggacccggcgggggcggcgcggcagggtgggcatcgcggcggctgggggcgctggtcagggctgatttgccccgccccgcctcccatcgcccgggagttgccgttccgggagccggcgggatggggttgggagtgggaatggggtgtaactgtggctcagagtttgacaaagttcttgggctgctcgcggggacgcggaggaggggggtggtaagtggaagaggtgagggaggtagctggaggatggacgaagactggtgggagacggaaggagggggctgccagcctgctctccagtcgcctggaagctcaatcggggcggggaagtgaaacttgcctccctcctacccggcctcttaaaactgcactctctcgtgcagccccactgtccacggagatggggcaagggagaaaccgaggttggaggagacccttggcaggaactgggaggcgggaggagggaggctactggaaataggtgggagtgtatggtggggggtgagaattggggaccttcttgcagcttaagtaatttgggggaaagttttcaaagggggttggggttgggggcggtaagtcgagcagcaaaggcgtttagggggcagcaccgggagtcgttttcatctccagcgtttccaaaatagaaatagaaggggaggggagggagggggcggggagtgaccgctcaggtcagactgcaataacttatttatttatttatttttaagaaaagttatgagctgtggttgcaggcaggagggaagatggagttgtgtgcagaggaagccgagtggtctgggtcgccgcctcctccccgccgacctgacagtttggcggatttcactgacccctctccctctttttctctgtgccccccgccccgccccgagcagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcgggtgagtcgcccctcgaccccaccggacaagctatctccgtcccgcctggcacaccccctgccctccgcctgggagattcttcgtggggactttatgcttcccgggagggacacactgccctttgcgcccgtgccgctcccctctctacccagagcctaagaggcatccaaacaacacacacacaaacacacacaccccaactcaatcccagcatccgaagagattaacttttttattgggaggtaaaatgcccttaacagccttacaagacctctcccttcttctctgctcccccaccccaaaagcacacacagggctcttacacaagtagcaattaggtcttccggaccctccgggccccagaccctcccctgataaaagggggctgtccagtgtgtaccggcgggttaatcattgggcgacttatctccggtgcagcgcgcctcttgcgcgggtgcgggcccttattacactttagcagcgagggagggtccccggagggtgcctaagactagggcgtctgcacagcccttgttgattttctcgtgcttgttcttttattgtccacagggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgacgatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttttttttttgtatattattgtttacaataaatatacattgcattaaaaagaaagtggccctgtggatttattcacccagttctcctgttggatgatttggcaaatttgagcacaaaagacattgtggagtgctgattgctgtgatgtttttgttttttatcagcacctttggcaatcctagaaaacaagctgaggaaaagactgtatctccaaaaatctaggcagaaaaatcttgaaaagtgccactccaatagatcacacagaaaattacatgtcagtagttgctcactctggcaaaaatgtttgttgtggttttcatgacctcatgcttcagggcaaaagctgtcccttgtggaggtcacagggaatattagacctgaaatcaggagcttgtcagtagacagaatgccagaggggtgacttgcttatctggttttaatatggcaaactttccgttcctatgaacacatacccaagaaatggagtatccacttaaaaagcaaaggaagccagagaaaatcagtgtctacagggaaccagagagaagcctgtcgtattaacccattaaatgattcagagccttccagatttctctgtagagacaatgaaaggggatgatttttctgctccctccagtttaactcattctaagcagacgcaaagccattgtagaagaaacaagacctaatcctgttttccttggccccagttagatggggagtttccaggttcagagaaacgttcaggtcatttttcattaaatagatgaaatcactccttccctcacatgggcacacctccccatccccactcccacaccccagatgattggagaagtgtctctaaagagtcagtcaccttcaccctctcaggctagttttactactgggcctgtgtctctggcagtcttaaccagagtccaacctctctggcattacctcacattgtctgtttctgcttattggattcctggctgacatcccacaccaggaacatggcaaccaggaaaatggtagttatcaaatcgaggcaacattagtactcggcctcctttgcaaattccttcgacaaacattgattgagggcctgtgatctgcgggggactgtgcaaatccttccctaccccttcagacatcaaattctgttccttgtttgtgacatagccttccatgcgctgaggccctcccttcttacaaaatctctatttttttttttctcttgccaacactcacaaagtcctttttaaaagtctctgtggtgttcactaattcttgcctaccttattcgttctaatccctttgtctattaaaatcaacacacaccattccactgcgactacccccttccctagcaaatctgtatgtttgctagactgttctcccttccagaaatatgctctttttcccagtatgtggcctttgccaggacttcttgaagccaaaatattctgttcggacataaacttgtgaagggaactgaagcaagttgttttgctttcccgtgcctcactttccccttttgctgagtatgtttataattcctcctacatagagcagggttgttaatagaggagattttagccagagcaatctgggagttgactgcattggagtctcctggtctgtacagcagtccccctgcattagaattcctgggagtaatagccaggaaaaagagtttcataagctccccaagtggctctgatacacagtaaaatgcaagagacacaggagtgctgggagagaattcctcagaatcccgctcacccccatatctatcagatctagtcaaagcccaatatcaccagattataaaatattttggaggaatttttagtctaacaccagaagcacagagcttatcaccctggcaacagcaacacattgactggaaacctaggagagtcctccacaccggaaagagtttgtatgtagatccagggttatttgtttgtttgcacttaaaataaaaccttttcttttctaaccattttaacaaaactgaaatttttagcaaaagggaataaaaataaactcatttaagaatcggtctt

SEQ ID NO: 11802 - DNA, 38808 bp, Human
ctttatgctctcagtaggccctcctccagtgcccacactctctcccttctccttcccaccttctttctaccagagttctaacctctccaagccccgcttgtctttttctttccctggctgccatcctaactcgccccttcccttctcagacaagcttctacatgctactcatctctccatcaaaccaccatattcgggctttggccatctgctctccacagccaagtccccagtggcctctctgcttctgacacagtgaaagccattcagatctgtcttgttggcagcattcctcactttgagcagcgccctcctactaggatacccctccttgactacaaccccacattctctacttcctgggctcttctgtcactggaggatgactcccaggtgtgaatcttcatcccgcgtccctcactcaagcccccgatcctcatatccagctttatcctcatgggatgcttcaccaggatgagtcataagcacctcagactcagggtgtcccaaaccactcatctacctggcaagcctgcactctgcatgtgcctcattctgaacatggcaccatcacctgctgcaatgtccagaccacaaacaccctacaatatccttgactctcctttctccccttctccctgtatacagactccaaattctattgagactattacctcctacacccctcacatttgcccagccttccccatctctgcctctaccaccatagttcaagctctcccatggtcccttcctggttacctgttcttcttgcctccttaagcctctcatgacactggccatgtcacttgcctccacccatcacccgctaggctcttagctggagtctgggccctgctaccttcctccccttcttccctacccttgactccacctccctgtgcttcagccaaccagataacttgagtttcgtgaatgcatgcctcagtttacctgattaactcattttcatctttcaggcctcagagcaggtatcaccctgtcagggccaggtgcctcttcttagctcccaaagccccagctactcttcatggaacatcattggcttgggctacggatcttcccaaattggagctttttcacaaagggcttaggtctcactcattctattaatccatctgtgtctccccagggctagcagtgccaagtaactgacgggtgattaatagatgcttgggtaagtatcacctctttaccatgtgacaatttgtttacctgccttgagctcctccagggcaggactcttgcctttgcagaatctatctggcaggtactgttgcagagatgtttactgaagaagggaatgaattagtaccaaggtgaggaccccacccttccccacgggctccaaaagcagcttagagcccaacaaaacctgccccacatttttggcgtttctgtggatcacacgatttactcatctgtctttcaatgagcatgacaggtggggtgggggtggagggattagagattgaggagctggggagggtggtcagctcctggggtgcagaaacaagtctgatgggccatggtgttctgggaatcagcactgcctcccctcacccctccctgcagtgttttgtagcctcaagatcagtgagggaatcttcgggcccccagcatgcaggaccgaagcccccgagacagctgtccctcagtcccaaggtccccatttggaagcagccacaggaggcctaagggacctatacccttggtttgaggaagactgtggcgagggagagagggagggagggctggcagtgagggcaagggctgggaaaactgagcacgggcacagtgcgggagcgggtgggtgcccagggcagccaggggcgcacgggttgggaggcgccaggcggcccgccctccttgcacgggccggcccagcttccccgcccctggcgtccgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacgggtaagccgagccgcctggccaggggctgcggaaggtcaggtagtcggggctcggagcgcaagccgctgggggcattgaactgggctgggggcgcaggggacaaagcccgaactaaaaaccttgcagcgtggagcgctcggacaccagccctgcacgcggtggaaggagagagggagggaggtggaggaccatggagggaaagcgggaggccgccgctttgtagaagggagtggggaagtggaccagagaccttcgactcaggccaagagcctgagacggacagcgctttcagcttctcctcccagccactgcagaaagggggaaatggcaactctttggccataatcaccgtgggagggtgccaagggcaaagcccacccagcagtacacctattccaacccagccaggcccccggccagcgactccagacaagaacctgggccacacacggtggcagcatctaaggtgccccaggctcctgtgctcctggccaggccctgcactcagacactgctggcacccgacactgctctctgggtacagcaagggcaatgtggcacttcttgtcctgcccgatgaagagcaggagaatgcactgggccctcacacacactgttcaaatggggaaactgagtcctgagtggttccactttcccacagtcctgaagtgtgcactggagccaggattggagtctgtcttaaagtaatagctgggtttgtaaatgtaggacactatcattgcaggaattcctttgagaccctgaagatgtgttggctttaggagacaaactcaagcagaaggtctggtctgatagtggccctaatactgacccaggcagaggcaggcaacatttctacctcaaaaaccaggccatacctgcgtcacaaatacccaggctttgctgcagcttccagcctacctggttgcaccaacttctttttcataactaggtaaaactatatatgagtagaatcttgtagtgactcctcagaggaagcctaaataccatcggggtctggcgttcacacccacaagcaatgcccaaacctccaagagactgggcagatctgtgctcaaatcaaaactcattgttgggggtgatagagttgacttcacaggccctgaaagtcttggctccttgcactaggagtgctctgggtacgggtacaggctgccccttgtagggcatagttgctcttgtttcctctacttgtggctttatggtctaggcctttcaggagtttggggctctggcagagagggcctgctgggagcacatctggccaccctgcagagtgaaatcaaaccaggcctggctgcaacctcaacaccctcctggaaagaggagaatactggggatatcctggggtctttctggaagtgggagaatcagctttgacttgggcagtgtgcagaatagagtgaggggggatgtcagaaagatgagagggatatgaggcctcaacatcaaaatgcaagcacctggcatttttattatctctgcccacctctccgttggtctctctgcctttcctgccaatgaattgtgttatgtttgggtgcctcaatttgcctaggagggttctatttcttctgtatcttcgccactaagtcaggagaagatccttatagcatgccctgcaacagtgtcacctgtaagggcatctctctgcacagccacagtgaaggatcctcaaaggtattgagggctttccatcaagagccatctttacagcaaacctctttcccttcagagcccagaagagtgctgaccagctggaaaacagggtttttttcttaaatgcagatgctcttgattatgagttccagatattagatcaacttccccaccatacccctgcaggcaaagcctcttaattagcttcctgcagcacagctggaaaggcctattgtaatctgtgatgggcagagtaatctaagaagtcacaggagcacccctgtcccagtagaatctggatgcgcaggcacatgaaccatggcaaaatggttgcaggcacagttgtatttactctgatctaactgtccctgttaatgccacagggctgcctggcctggcacacagggctgtggcgccttgtgcaaatggataacgttgttctagctccagcctttcattcaaagtgaaaactgttagaaagggaaggaaaactttgctattttaaggaattgtagcgtgctgcctgatatgaaggaagaaataacagctgtgccttgcttgtgcgcagcactcgattgccgcttttgctttcgacctcaccacaacacagtgagatctactgttcatgttcccattttacaggaggtgaaactgcagcttagtgaggtagagagtgacttagttcagacacagaatgctgttgggagagtaataactatgatatggtctcttgactcccagctatatctgtgttgctatagggaaggggaaaaataatactgaaagagaagtaaaaatacaatcacacttccaaacatcaaccaccaaaaactgaactgaatttcctgaagcacttggttttcaaatctaagctgaacatcaatgctgttattcttgaggcccagaagcaacttgctcatttcaattaagcttcagcatgaacttcctatgtacacagcccacccacactccccgatgtgagaaggagagggtcacagccgcccccagcctctgctgctgccacaaggacagcagcagtggaaacattcagcaaaggaatgttggagccacatccacaagagactcactgaagattcgccaaacgcctacggaaagtggcagggaattcattgacagtaattgtttcctgcttgatcagattgaagagcttctgggattctgtaacaataaataggaccgggggctggagtatggccagcaaggactcttcaggggttattcagggactgtctaacctgtgaatcctaggcagcaaacagaaaccaggtattcagaaatctggaggatttggtcaggcccagctaggactagggaggcatgggcctctgctggctgtggtcccttctccagccttcacttctcttgtccctagatccttacatggattcattaatgctcattgtccctcctgggcccactcactttcacctgttgaacaaaaaactggccaagaggtgacagtcatatcaccgcagaagagacagggcagagaaatgaaggggcagaatggactcccacccaaaagcctgactctgaatatttgagaattgttcaagttcctgcagaggaatcatgatggggacagtaggtgtagtttttactgcaatattggtgtcttcttaacaaatacgctgcacatcaagtgatgtctgtggatggcattcttaaagtaacagggaaattgatgttaaagaaatacttcatcctttgggtgatacctgaagttctctgagcttggaggtcttgtgaaagccctcagtattgtttgttttatttgctttcctctgacttgtgattcagtcagatgcatgcctgcctctggctcaggaagatcaaccctctcctgactgaccacgcctctcctgactgaccacgtagcacagcagcttcctttccctaggggctcctaatgaagctttcacaatcacctggcctgagcacagtttgggtcaggacttggtatacttgaaaaaaacatgcaaaaccaaaatcctgtggttctggaaaaggcttcttagcagaacccccagacatttacactctgctttttcacagggtccctgaggattctttggatctgggtagtttggggagcagtattttcaacaagttcatttcgtgctccttctacaccctgcctggatgctaggccccatctagaatgtgaacaacagaacaaggcagaacacttgtcctcaaggttctgttgagtgttagatgcagagaagagacaccccccacctccccgcatcacttacaggaattctgtttggaacccaacatcaaataaggaccgtatccactgtcagaggatgggaagcagcatgtcatctgggacattggagaaaggctcctgggggaagtgggacttgagctgtgatctaagtaatgaacaactgagagttaaatgggagagcatcccctatcagggtcctgagagcaaccagccatggtttaaaccagctataaagcctcgggtttataggatagacagtaacaatggcttgtctttgggagccaagcagctggtccaggcatgcagagcatgtctgtatggagagctgcctgagagatgcttttgtttacacttatcaattgcccatgtcaaagaaggatatgtacatgaagttacatcagtatgtaagagagattttaacaatttttgcaggggaagctttcatgggggctgatgggaatctaggtaaacagaaccaaagtctaaacccaagatatccccagtaccaagactgaaatgactctctcctctatctctagaaagttccagtgacccaaggaggcaaacacgatgggagtcattaaagtggggtggacgtgctgatcatcttcctaattctgctgcttttgttttcagccccaacgtgtgtgctgtgcagaaggttattggcactaataggaagtacttcaccaactgcaagcagtggtaccaaaggaaaatctgtggcaaatcaacgtgagtatctgtaaccagccaggagaccaagctgtatgcacgctggctgcagttccccagggcctgggccagccttctagaaggtcaggttgcctaaaaagccatgaagatgcatgtgcgaacatgtctgggacctgcgtgctagggagtggcatttttaggaagctggccaattttgttttgcatttttaaggctgctgacaagacttggagacatttttcagggctggtttgggtttgcaagaaacatgaaacactgcgtgtgtgtgtgtgtgtgtgtgtttctcaatcctcataaaataatacagatatgcagtggagaagccaccagcatgtgactctggaaaagaaagcccattggtgaatctgtactaaagaatgccatccctatcttacagtcctaaggtaaacaccccaaaaagacttagagcactaaacatatgcagattatgagacagcatagcatataatatttgcacagacttcctcattcaaaccctagctctacctgggccagtcgattcatctttagaaccctccattgctttacctgaaaagttcgtataacaaaaggacccaccttatggggttgttacaaggattgaatgaaataatgtacataagagactgaatatggtgcccagcacatatcagtgctcaataaatgctagctactattattattatcaccctagatttgcaaatctagaccacacaagcagaagtaagagtgccaacggggtgtggaccagtgtggttacaatagggcttgttgatgtctgtttcagcaaggagggaggcagcttttaccccactgcccagctccctggtggaatcaggtgcatgttctaacaattctggggaaacctaatctgttttggcactgtcaacagatctcaaagctggctgtctcctatagctaggaagatgtgtatgacaaatctcctgagccacttgtgaaggcctgaccttcctcctgtctccatacataatgggatgattaagaaactctaagccactctcttaagcacttttcaatgttagggatttttaagtttattgttgtgacattgcttttgagcagacatctcctccaatttaatagccaactgaaagaagagaaaatgctctttccttaaactgtatgtggaaataaatattccaatgtgtgaccctgattatgttaggcaattagcaatcctaatatgaattgagggaagttgggattcatggcacagctggggagataccagcagtccctgggagcctgtccagggcaggtccatggcagcttgctccatgcctgattgacagcccagcctgcaagctaaaagttgagtgagctaggaggacacactgccaagattcagctaacagacacccagcgatattcttgctgctatgaacaaaaggagactatgcaaattatacaccacccattcttccaggatgcctgacttaaaaaataagaaaaaagatgggccgggcacagtggctcacgcctgtaatcccaacactttgggaggccgaggtgggcggatcacaaggtcaggagacagagaccatcctggctaacatggtgaaaccccgtctctactaaaaaaatacaaaaatattagcgggcgtggtggcgggcacctgtagtcccagctactcgggaggctgaggcaggagaatggcgtgaacctgggaggcggagcttgcagtgagccaagatcgtgccactgcagtccagcctgggtgacagagtgagacaccgtctcaaaaaaaaaaaaaaaaaaagaaaagaaaacctttagtactgattgattttttcccatgtgtgtatattatctactcaaattaacaattaattacttaattaaacacaaagccaggcctcacctaattgcttcttggaaggtgaccagagtgctagtgccaagcaaacaactcttctatatctcaagagccctgggcttcagagggccatcttttttgttaattcaagtttctctgaaaatggagacccgtttatgatgacaagctggctacagggtagcatctgccacactgtttcgggggtgccgctgggctgaagcatttgcccagctagttaacaatagctcgataacattccctatcagtgtccaggctgagaatactgtcagtgatgagtcgccttggctcttgtacctgtatctttgtgtgccaggacaaggcacaagcaacagagctgtgtgttgccaaaatgttcctgatgagcaggtcaacccctcgggggcaggtttggatatgataatgtggtgatgtggtggcgcagctcccttacccagtgagcacaaggggagtcctctaggaaaaggaagaaatgtctggatgaggtggggagatggggttcagagtggactcaggcaaagcccgatgcccagtcccagctgttggcctagtctcacaaagccagaaggatatgacatttacattcaactcttgaatttgtggccactgctttgggcaacttcaaagagagaaaatgaagatagaaaaatattatttgatataaaacttctaggacaagagaggcccttcctggaacattacatgtagtattaggaaggtggagctgccctggaaaagatccagagaactcagagagaggaagaggtggaacccatctctgttcttgtagagagctcagtaagagtggcttggcagggctcctgtgtacctgagaccaagaccagtgaggaggctactgtctgaccaccatacggtcagaattcagtgccatgggtggtcaggtgggaaggggagaggactgtgctggctggagttgatgttatcctggggaaagtaggtccctagatgcctttagttgagtgaggagcagactgggaaatgggagcacagtagtggttggggcaaaaaggactgtctctgcatgaggtccataggcagttggaattttctcagcaagactccagagaaggaggctggagcagaggtgtatgttgggatgaaaaggagtaaagtatcatgggggaggaggcagctcaggttgtcaagggtcaagaaaccagaaggagaatttcaccttggaagcagacaacgggtaccaagcatacaggggaatactttgtggtgagaggtcacacagagatacaggagccgacctggtgagacaggagcctggagccacctgcctgcttttgtgaggccccagactccactgctatcatcaggtgaagctctgttgcctgcacacaaaagcttttctgcatttacaaagagagaagggcctgagtttctggtgcaatgcgtcaagctgacatatggactttattacaggaagtggttaccagtgggtccctatttagtggctgttattgtgaattttattgttcggaaattcactttagcatttatttcagatcctaaatagcaccggagtgatacaatggctaatcaaacaaagagggctgtggggagcagacagtcagcatccccctctgtgatttcaggccctggtttgattagtagccataaaattttttacgtgtggcactttgagcaaaggtgcaggaaattgtggtcaggaagcctggctgcctctcgacaggcttcctttgtgctagccccagggagaggaggcctatttaacagccaagtccaagttgacatcatgggactggaatagtcatagcaggagctcagacatcataaacgtggcatagggagggctggtggaggagctagcgggtatgggtggcagctattcattccaaaagtcttgaaattgtttcacgagcaacacatttcacaagtgcgaagcccttctctggagccaagatgagctggcagagcactcctgtttctctagtagcaagtgttcctttgcccaggggcaaaaatattaatactccttcagcactgcattaatgcttaaagatttaacttttaaagagatcagctggtgcatggtcgagcttttccatcagctggcagggctttttcagtaggtgtccttctgggcagggcactggggacagctgacgtgaaggtgaagaagagctgtcgttttcctcccttatatcccacaaccttggtcccaagaggaaaaaaaagaagatggtgagaagtcatccaagcagaccccagacccatactagtgcctcctttcctgtttcatatccctgtgcagccagctgggatctcttgaataatctgctctgggggcactgagattggacatacaccaaacagcggagatcgaccaaacgcctctgttgggcagtgtttcctgagggttctgtcccattctgtaaactaggaggctgactagctgacaaggaattttattctgttgggtatttacatgaacctatgtgccacctggggtaagaccctgtggtaggtagaaacatgacttcccaaaaatgtccacatcctaatctctaattctgtaaatatattcccttactggaaaaagagactttgcaggtgtgattaaattaaggatcataagagggagagattatccaggattatttgatgagtctaatataatcatcagggtacttaaaagagggaggcaggctgtgcctggtggttcacgcctttaatcccagcactttgggagactgaggcgagcgggtcacgaggacaggagttcgagaccagcctgaccaacatggtgaaactccccctctagtaaaaaaaaaaatacaaaaattagccaggcatggtggtacacacctgtaatcccagctactcaggaggctgaggcgggagaattgcttgaacccaggaggcagaggttgtggtgagctgagatcgcaccactgccctccagcctgggcaacagagcaagactccatctcaaaaaaaaaaaaagagggaggcagtgggatcagagtcagagaaggcaacgtgatgatgaaagctgacatttgagtgatgcaaccacaagccaaggaatgcaggcagcttctcaaagctggaaaggacgagcaatggattcttccctacagcctctgtgaggaatgcagcctttgattttaaccccataaggccgatttctgactctagcctctggaattgtaagataatttgcatgatctcaagccactaaatttgtggtaatttgtcacagaaagcaatgggaagccaacacaggccttatttgttgacttatagatgcatttttctttatttcaatgtacttttatcaatggtctcatgtagggtattgctttcaatgaagatattaacatagtttcaactttaaggtttatatctggagtttctttagaagcttcacaactgaccacttagtaaacagtaagcatctgttaagtgcttctcatatgtaagttcattcaattctcacaatcacactataagataaatatgattattagcccatttacagatgaggagacaggctcaaaagacttttatgcaacctggtcaaagtcattcactggtaagctgaggaggtctgtccacttccttttgctgcccccagggggtatcaagcctggcagttagtgtcagcgacttaggaggtgaacaagtgagcaggcctgtaggacctggctaaactgccccaggtctctgtctacagcctcaaacctgtggctgtgggtcccagagacaaggcctcctcagcatcagagaaggatgcctttgtctcagggtcatcaaccttctccaggttgctcaccccctgctgtaaaggggatccccaagaccgctcatcagacaaggagcttgggaactgaggagacacagtcagcctccaggagtgcccaaaatgccctcacatgctgcatacagattgccacaaataaagtacatccacattctgaagactctgtcctcatcaccaaccaggctggcccctggtgagggctgtagtggttgaggcctttgttggtagacggtaggttaaagcaagccatgattttctattgggaggcttcagaatcagctcagctgtgtttccaagaccaggagggcagaaagcaaaccatcccaggcaagcagtccatgggccatgtcagatatctagacgttatgggtctgtgtttgctctgccattcctctcggaaactatgatgccctgtatggtttaccttcagtcacaggtgactggcctacagggccattccttgttccaacgacttctcgagtataattaatccccaggcatttacggccagagcagccggccaaatccgtgaagtgcagtggttgttttaaattatattaacttcttggaaacttattttagggagagaaaactcagtacttctctctatccaatcttgagtaaaaatgttagaagggactggtggagagcctcccagacatccctacacatagactttgggttgacattatctctttgcaccttccttgaaactttcttctaaattaggtgccttccctaatttaggcaccttcccagtactagtctgtgacctgttaggaaccaggccacacagcaggagttgagtggcagggagtgagcattattgcctgagctccgcctcctgtcagatcagcagtggcattagattctcatagcagtccgaatactattgtgaactgtgcgtgtaagggatctagcttgtgcattccttatgagaatctaatgcccgatggtctgagatggaagagtttcataccaaaaccaccccttccccctgccaccatctggggaaatattgtctaccacgaaactgatccctggtgccaaaaaggttggggaccgctgtcctaagggatctgctttttctgacctgaggtttttctttattagactgtatctggctgaggagaagcctgaagcctttaatcggaacagctttggctgatgagattagattcagaaaccaacagattggtcttttctatgcagggaagcctaggaactggggggctatggctgggaagccccctattgtttccatcctttcctatgttcatcctggaggaatggcatcagacccatgcctctgtgattgctcccagcccatccaaccacagcatctatgttctgcctgggaccagggccagggagcatggcacactgagctgagtataaggagagtggagcaggccactgccagcccagaaaattttggtcaaagttgcctgaaatcttctcagccttcgattcacagctgctctctgctgctctggggccatgcagaccagttcagaaaagagttaatttgttggggcagttggaggcaggtggactgccagctttgacaccttcccagcccacaggctgctgcactggggctgaaggcgtggctaacccctgcacacctagagagtgacagagatgccagactgggcagcaggaaggcaagaggattaagagagagcttcctggctgaaagccacactcggttaaccaggaaaaagcccttggcacgagaagactcagtggcctgagggactgagccttggttgttgggcatgtgctgcataagccatccatgtgtgacagtagagtgtagtccagccactgtgggacatgggtgctgaaagaccacatggagaggaacagtgagtgctgacaagggctagccttgatcactttggagacaccccctgtgtcttctagatgtcagactttccaaatctgtctgctatcctccaaacgtgcattttcaagagcaatggaaaaaggattggacttgatggaatgcagcaagagtcctaggtctgttactacctacctatgaccttaagaaactccttcacccctcagaacccttacagctttctttctgattctatcatgagttactctactccaagctgagacttttctgcttagatctatcccttcctcctaaacccccaacctccatttctcctggtgtctttctttacacacccctcagcatacacacacacctagccacaggaaccaatgagttaatatttgaggagttggttttcttttgtcctcaatgagatcctggtgaggccacttgagctgttcagctcccttgtggtattttggggatggaactcagaagccaacaatatagaaaaagagtctttggccagctttcccaggggctccatgccatagagagtactgcacccgtgtgcacagggggccctgacatgaggactttgaggataacactattcctccaactctgcttcagcagctccatggattttcacacagacactttaggaaagaaactaagtttggggggacttgacctaatcccacatcacagccccagtaatacagccctggaatttatcacagaaagcctagaatcccatgcatatcccatgcatatgcatccctagtcctatgggttcaaggcttggagctctccctggatttagctgggaaaagttggcagacagttcttctctgtcttctagaaatatggactagaatcgtgagtgtgagattgcaagtaacttttaaaatcatctagtttaacttcaccccatttcatagaccaagaaactgagaccagagagagaaatggactttcaagttcaccctgctagttactgatggatcacaagtcaaatctcctgattctagcactgtttctcttacaccacaccacctttgaaagtgtgtcaatcaaatcttactttagttgcagaggatgactttagtttctgaagataaaattgtgagtcaatcaagatcagtcccaagacaatagcctgtttagcccttataagttcagggatgaaaggttagaaagaaacaggatggaaggaggactggagaaaaaaacaaaagaggaaggaaggaggaggaagcaaacaggaaaaaaaaagaatgtgcatagcttgtcactcctcagtcatttcctgggagcccatttctagcaaagtgacagctgcaactccctggccacctgagcatcttagctgatctgtctctgaaacaccccctggagaacagatgaatcaggcttcatcttcgcttaactaagtcttccctgagacgactccatttaaatgaacaagagcaggatttcctgggcacactgagagcaccttccagaggcccctccagagccctaaagcctgtatttcttccagtcggcctgtttctttcctggtgatgtcattaaacgccctttgagagtcccacagtgagcagttctgcggtaaaacccgctgcaattaaagtctgagtcctttcctgtctcaaagggcatattcatatagaagaaaggaaaaggaaggactggctgtttgcatttggttccaggcctgttgagtagaggtcgtgctcactccaccgaaggtacagggtagccttcagcagaacctggggatttggttttaagcaagtctttcttaggtgtgggctttcagaacacttccttccttgcaatattatttgaaattctcagtgttttagccgtccccagaatattggttcgttaaagctgtgtatttcagatctccagacagtggtcactgtttgtatattttcaatttcaaaccagaaaacaaaagttcttattgattactttttttatttaaaaaataaaaagtaagtatcttcgtaagaggagctttgttttaattttaaagtttaaaatttgattgtgaagacagagaaaaacttgatgattgtagatatattcccctctttggctattcaatcagagaactagaaaatcatgagagatttaatgaccactgcctgatacacatatgtgttttacagatgaggaaactgagacccagagagatgatgaaattggctgaggatggcccagctggtcagtgacagactcagagccagagctggtgcagggctctttctattccttcctgttccctttcaggaacactcaccatcggctttcctgtgaataatgttgagataaaatccttggtgcattatgttttctagtcacaacattgactaggctgccagagtcctctgttctcccagttggttggctgtaggtgttggcagccgccaggagcattctacagaacagaggaggagtgagactctccttgctcaggaaaggcagacctatgacttagcaaatgactcctaagaggagagtgtttcacccaccattcctcttccttggctgtggaggcaacttagtggagaggggccagatgacctgtgaggaacagtgaagccctgcctaacacaatgtatggttgtcttgttacagagtcatcagctacgagtgctgtcctggatatgaaaaggtccctggggagaagggctgtccagcaggtgaatgaatcctccgggccttgcctgttggtgtgggtggaagggaatggtgggagagaggagtacccacataaaaggcagcagagtgtgaatgggggcagtggcacaaggacatggcattctccccacgtgcccactggccccaggctctatgcgaggggctgaggaatggaagctggaaacagcgcatttcctgagctgctcctcctggcctccttaccacactggtggagtagactccaactgtggcctgtccatgcccttcccagcaggcacaggctcaggctcaggctcttggcctctgcctctggctgggagtgattctaaacacatccagcagggtcagcctgatagcccatcagtttccgatcagctctgctagagagccgatgggatgtgggaggagggggtcactggtgggctggcaaccccaagccatccccatctccctctgtgtctaaacttggccctttggagttcggtagggagaagagccataggccaggtgggctcacccagagtcagcagagagtcccacaaatggttgcactgggcgaaagacagcatggcacctgtgaattttattagagcttttcttttagtgctacacacaagtgactgtacaggggagttagtattttgttttaattttgaaatagagtcatcttttggtatctgcgggggattgattctaggacccattctaggatgccatatcctcagatgttcaagtccctgatataaagtggtatagtatttgcatgtaatctatgcatattcttccatgtactttaaatcatctcaagattacttataataccaaatataatgtaaatcctatgtaagtagttgttataccctcttttaaatttttgtattatcttttattgtatttcaaaaaatatttttggtccatgtttagttgaatctgtgggtgaagaacccacagatacgaagggccaactgtattggctatttttttagttaagaatgtgagactgaggccaggcgcagtggctcatgcctttgattccagcactttgggaggccaagaggggacgatcacctgagccaagaattcgagaccagcagcccgtgcaacatagtgagaccttgtctcttaaagattgtgagactgggctgggcacggtggctcacgcctgtaatcctagcactttgggaggccaaggcaggtggatcaactgaggtcaggagtttgagatcagcctggctaacatagtgaaactctgtctctactaaaaatacaaaaaaattagctgggtgtggtggtgggcgcctataatcccagctactcaggaggctgaggcaggagaatcgcttgtatccaggaggcggaggttgcagtgagctgagatagggccgttgcactccagcctgggcaagaagagcaaaactccatctcaaaaataaataaataaataaataaataaatcatgagactgagacataacaggaaggagggcaatttggttggttccaaggttcctagagtatgtgatgggagaggttggtgcgggtggggccatggaggtactgactcaagtggagggacaggtggggaaatgggatgggaaaagaagattgaccttagaaggggagctcaacctctgaaccctaatttcagacccttcaaaatgaatattaagctcattttggtctaagaaacaaaaaacaaatgaacatgaaactcattttggtcttataaggtctgagaaaccccttctaaacttcaagctgctttaagaaataacattttattacctgcaaatacacacagtactttggagatttataatagtctcttattctaatagaagccattagggaaccagtttcaataaacaggtaaatctgtaagactagtttgtaattaggatatctgtttccagtgtccattcctgcctctgttatctaaatgtctgggaacaagagctgtgctctgctgtgtttaaaatgattaaaaatcaccaattagttgagttcacgtagacaggcatttgacttattgagttgttttaagaagactataacaagccttaagccccccagaaacagcctgtctttgggctttcccacatgcctcctcgtcctctccacctgtagatgtaccgtgctctctgtcagagaagggagggtgtggttgggctggacccccagaggccatccctccttctgtcttctgctcctgcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgtgagatgacctccgtctgcccgggggactcttatggggaactgccttacttccccgaggggtgggcatgatgaatgggagtctgcagtcatttcctactgtttcaggaagctttctccttaaccccttagaaaaggctgtggaacttgagctaaaatatgtcttaccaggttgcgtctaatgccccccgttccctactgggcagaaagacttgggtgcttcctgaggagggatccttggcagaagagaggcctgggctcacgagggctgagaacatgtttcccagagttgcaaggacccatctcttaaacacagagtctgcagcccctaactgacaccctgtccttcctcctaggaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatggggtaggggatccccagccatactgcatggcccttggtgcataatgaacccatttctgttccatgtgtgggctggtttctggggtttaagctgtagacaacccaccctctttgtgcctgcttctccttgggccctctattccacagcttgtggaacccacattttgctactgtgtttgaaaacactgttttctcctcccggggctttgggactatgcctctgttgtgttgactgctcatccttgctgcttctctgggcagattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggtaagggactgccctgggtggaggcccaggcttgggacacattgcctcccaagaggggcctagcaggaactcttctgcaggagaggtagaggatggctcctgtaggggaacatagagcaggttcccctgaatgcccttgaacatggagaattcattgaccagacattcagcttgacctaacctgtgaaattctccatcttctttataaagtgttcccttccttgcctcccctggaaaggtcagtggtgtgtggctgcagcagcacagtgtcctctgagccctggacctgcactgtggcttccagaggtggcagttcccacatggggtactagaataaatggcctatcaggctgtgtgtgctttgggatcacatgtccccaccctaggaccctggttccaaccatacgcatgttctcttggagcccagaacagcagagaagccaccagtgtggacacagaagtcaagggtctgatttccagcctggcttctgactgctctggggccgcaggaatacggttccttcccccatgcccagcaggcatttgtcttacaactggaggggaaggcatgttcctcttggcaaggactgctcaggaggaagtggaggcaggctgccctgtcagggtttttgccttgattcaaggagaacttcctaaccacaaaggatacaagtgggagtgaggcggaccctccctagagatctccaacacagagagacaaacacgctggggctggctggcactgacaggcctcgcaggtgtggatggctgttagctgggagcttcgctgtctaagctcctctcccatgcttttcttctgggttgctcgaaggacgggggtctgcaagaaaatgatgttcccacatagttggcagcacgtgaacagcaattgatccctttgcatcacctcctcttactgtttagatttggtaaatatttcttccttccctcttctgaccctccattttgccgatctttccttcttataacacatacttactaggtacctgctacttcccgggtgggcctatgtgccaggagtatagaggtgaacaaggaaggcaaagttctattctcagtagagctaatactctatctggagagagacaacaaacaaatcaacaaggtagccaggggctgtgataatttatgtcaagtgggcaggtaaatcgggagtgacagtagtgcagggaggattggaaagtcagggagttctctctggaggaggtggcttttgatctgcagcctaaaggatgagaatgggtccattatacaaaatgctggggcaagagcacacccagtagaggggagagtaatagcaaaggctcagggcaggaagggcaagggagaggccagtgggtgaggtcacatgtgaagggcatacaatgggcaaagacaaggccagagtggccaggcccaatcctccaggacttgcagacctgggaaagagtgcatctccatcctgggagcagcaggaaaccactcaggcctttagaagatccttctggcagctgtgtagagaatgggtggtgtgatccttccatgcatgggctcatgtacgtgattaccaataactgtcgagtgacagtgtgaggagggctgcaagccatgagtgtaggcacagcagacagactcacctttgtctggcggtgagatggggtgggaagtgtgccaagttgacctcccaaagaaatgatattttagtggaagaatgaatagaatcagagaagcaaagtaagagggaagagcagagaggacagcagggacaaggacttgggggcaggaagaggaaaggcaggttaaggacatgaaagatggccaggctggctggagctcaggcccagcaaggccccctgggggccatggtcatgggtgagcttgggtttggcttctgttttcgtcttgggcttctgtgaaagcctcgagcccttgcggggaaccagtgaagctgtgtgtgcatcttctgtggggagtgccagagtcttcagggagcactccatcttctctcctccccacaggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagaggtgagcatcctttggctcctgctgctgcctcatttgtgcagctagattgagcccaagacctgctctggtccaagatgaacataccacctgccatgaggtgaccctcaggatatccactgcagccatgggctggggtcatcctgtcctgttgcttcagctaaccgtgtctctagcagccacactactctgagggctgactacagaatccagcagcttttgtctgggagagctggactgaagagaggcatagctggagacccatagctggccctggccagaaacagggagagtgaaaggctggaatagccaaggccagagcaaggctaataggtagagcaacagcttacaggtgtgggggtggcagatactggcacccttgaaatggattcctcatgcccacgcttcactattcttctctgtggctaggggatttatggataaaccaaaattacagttaaaaaccagccataggccaggcacagtgactcacgcctttaatatcagcactttgggaggacaaggtgggcggatcacctgagatctggaatttgagaccagcctggccaacatggcgaaaccccatctctactaaaaatacaaaaattagctgggcatggtggtgggcacctgtaatcccagttactcaggggctgaggcaggagaaccacttgaacccaggaggtggaggttgcagtgagccaagcttgcaccactgcactccagcctgggtgacacagcgacactccgtctcaagaaaaaaaaaaaaaaaacagttatagtagtcaacttttgactctccatttcagatttcgtcatgccctcctcaatgagctgctaagttaggcagtgcattgattattgctgcaggagagggaaggaaggagctaacgtgttttcacatgttttccttttggagatgagaaaggaggactctgccttccccctaccctgcccctttctactccaggacctctgaaaggccatgagcacaaagctgctgcctgagtcccctgaaatgcagggtacgccccaggtctctgatgtaccccaccacacttttcctctcaaacatattccaggatcacttgatttcttttgaatctatttaaacccaccgtgtcaatgtgctatataaaatgtctaatgcatttcagacaccctatacatctatacatttaaagtgttctccttctatctgtgcagggatgggaaagggcatatttctgaaagcacagatgggaagacgggatttgttccgtgtccaggtgattatggtacctctatgcgcctggccggcactggggacagaggccatgaaaatgaatacagcacagcctttgcctccaagaaacttaagacctagtagaaatggcaggctttaaaacaggttgttgggatctgatttggtgagtgcaatgacagagatactcacagcacaaaatggggaatgagggcgggcattgggacacacatagccttaaggggcccaaaggcttttagaactgtattccctattaaaacatgatttgcacagagcacattctttgctttggagacctcagaactccttactataggccgggcatggttataatcccagcactttgggaagccaaggcgggcagatcacttgaggctgagagttcaagaccagcctggccaacatggtaaaaccccgtctctactaaaaatacaaaaattagctgggtgtggtggtggccacctgtaatcccagctactcaggaggctgaggtaggagaatcacttgaacctgggaggcagaagttgcaataagcccagatcatgccactgcactccagcctgggcaacaaagctagactctctcaaaagaaaaaaacaaaacaaaacaaaacaaaacaaaaaaaactccttattataaactgtaagaaaaaaaaggcccctacttcgtcccttttgcaaatctgccttttcctactcactaaccagctggttcagagcaaggacactctgtttggtgccatcgctgcagactggaaggaagaggtccttgccccacacccaacagtctcctgctgttaccggcaggttggcaggcaggcaggcgagaagcagccagggctggtggtgtgtccagtttgaagactagtttccagccctggccctgctcaccctccaagtggccctggcaggttcctctaccacatcgtggacttcaccttccttctctaagaagctcaatccccaaggcctcattcccataggccttctcaccctttttctttccctctggctgaatgtggccagcacgggcttccaaggccatcaactcgtctgcagcagccccatgccttgcagggcctcagagcttcctcctgcctatgacagtgtggttttggttcccacacttgggatcagattgaaactcgcctccgtggtgagaatatgggacatagagcctcggtgaccttggtgagcagcagtccaggccacctgctcagcctggggttggggggggctcctcctccttgactggtccttgcatttgcctccatccagcctgtctgggctctccgaggcaatggagaccagcaggagtcacgatgggtcaggagccccctttgggcctcagccctgccctgccccctaaagtagcacttggataagcaaataaattattatacttactatttatgggtgtggtgaatgggatggcaaaggccaagtcttactgatcaccaaaccttaagatatatcctggcagctagtagacccttgggctaaatgaacagaaaactggacaaataaagtgtacacaaataactcaaagctgtcatttgtacacttttcgtcttttcctactacagtttacatttttataaaggtgagtagatttctaaaatcccgtggtaggctctcttgagtttttcttgtatccctgaagttcagctacaaataagctaatcactaacatttgttgagcatttactctgttgtcaggccccgtgccgagtgctttaggttcagaatttcatgtcatccccacagcagccctaggagatgaatgcaattcttatgtccacttgactgataaggaagttgaggttcaaagaggctaaatgactctcccagggtcccacagctggaaagtggccacagggccccagctggttttctagggcagcaggcagaaggcgaggaggatctgggccctgtggtgccccagcctcatctgagggtcctcatctgagagaacaggatcctcacagcatgggcaggctgcaagtggtccctgaggttatcgtggagtggaccctgacttgacctgagtctgtttggaccccagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcaggtaggccaggcctccgggggccttggccctgcctggcccaccatctcttctgccatcctttgtggcgggggaggggaaattcagagatctttgggcgacttccctgcctggacccagctcacagcttctcggccactgcaaatgtgtgggttgtgaccagactgatgtgtcttgagcttcaggcttgcaagtgcagtggagaggcagtggggagctattgaaggggtctggggacagactcaatcacagaggcctttcagaagatctgcctgctgtgcatgggcaaagagggccacttgctgacctcagagcatgtgctttctcagtagtgcccaagctgtcccatggtcactgacccagttagaatgactgaatggactttggcttgtgtctcattaggaatcctagccccattctagtcttccagtgagatctgtccatgagtgaaggaatctcacaggaaaaaacaaaatgcttctatgggtgtggttgctggccttatctacaccacagaagccatcacacagactgtctttcttcccattgttagaatgtgccctgaccaagcagcccacagggcctgggacagaggctgatctctgcctaactgagctcacctctccttcctctcctcctgactggttagattttctaggtgactgttcccctgatgacacaagcccgctgggccccagcagtgtttagaggggttgttgactcacgagatgacattcctgctgatgtgtgtcatgccctggggtggatgaatgataaatgaaaacagcgcttttaacttttgaacccactttctccttccttgtagccaagacactatttgaattggctgcagagtctgatgtgtccacagccattgaccttttcagacaagccggcctcggcaatcatctctctggaagtgagcggttgaccctcctggctcccctgaattctgtattcaaaggtaacatggggaaggcatccctgttagattgtccctggaggcagcttccccacccctgtcacctccacaacactctccgatttacagcaccccatgggacattagaacttccactcagctcaaccaaaagcagatgtgacttcagcagaaacttcagaggctctgttgtttcattaggcagtgcagagaatgcctttggggagccgttcctcagaactcaagacttgacatctgggaggcagccgttcctcagaactcaagacttgacatctgggagagcagagcattcccttgcctttctatttgcagggtcacttgccaatgtatagtcaagaggtcagagtgagggtacagctgagctgcagccccaggaaggcagagaagggggccaagttgtgtgcgtgcctgcccttccctcttagggcaaaactccaaacacccttgattatctggatcttctttaattctccatagaagataccagatgttaaggaatattggcagcttcacttggtttctcaatccctgtttccaaactcaaggagggatgggctttttcactgtatttatctctcatcactctcttcattgcaggagcacatctctctggacctaaccatcaccctttcttgtagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatgtaagttctgggtcctaaatcatgctcctgggaagctccttactgtgggacttgtattagtgtaaaaaaaaatgtcctcaataagcaggagtttgcatgagaactggttgctgacaaggaaggaaataatttctggaaaatatagataacaaaatgagatcctgcagaaggattggaatctctttttctggaggcctttgagaataaaccacacaattatccaacctgtattgtgaaggaataagtccttcttgaattcaggaattaacacctgggaggagggatggagttcagactctttctgagcttatgagaagagaagccccctaaactaaaatacagccctccttggtccaaaaggtgccttctctcttctgctgtatcttctttgttttcaaacccaacagttaccctggaaatcaaaaaggaagtacaactcaacatagctcttgcctgggaccaaccagcaccatttggctaaagatggttatcatctgttaaacaaagaaataaataaatgggttcaacgtatttatttcaacattgtcaatggacctcatgtgtaactgatattctcattatgggacctctgtgtgactttattggggcctctctaaccgttctttccttaaggaagaccatttattgttttatttcctggagaaaatacatcattttatcccagccttaataacccatcccagtgtatactccttcatcttcatggataatgaccctgctacatgctctgaacaaatcaggaggcccctcgtggaagtataaccagtcctttctttctctgtccctcttctgtgcagagcctctgcattgagaacagctgcatcgcggcccacgacaagagggggaggtacgggaccctgttcacgatggaccgggtgctgacccccccaatggggactgtcatggatgtcctgaagggagacaatcgctttaggtaattagttccatccccgggtggagcttctgcccagtggtcatgctggagtgggatgtggggccccagctatttgtcaagctttcttctaccttggggattcaattaacactagcagtgcactgctgcgaccttccagacttgggatggggaaaaggcaagggtcgccttgaaagcttacattgggaagaagggttacttctaagagtgtaatcttcacatgcatgggaagcagggaggggggactacatttttatgactgaagtgcaaggaaaacatcaccctctcattgtaaagctccaagtgagccaagagcacatagtttacagtgcacgatgagcctctcactctctgcgcagtatctgtttattgcaactgaagcacccttgtgagtttgttttcttgcccggctatctccatttctgacttgctcattcaccttggggtgctgtcatattgaatgtttccctgtcactgacttcagccacctgcacaagggcttggagaccacacccctctgccctcccagaatcatatccctggaggctcagctagtctctgggtcagccatacctctgccctttcttttccctcctttctcctgtggcctctgacgtctggccatttaacagagcttagcatttttgctgggtggagagagctggagcctggaatcactccctctttgtgcatacggagggcatgaaaaccaaggtgtgtgcattccagtggcctggactctactatcctcagtggtgaggtatttaaggaaaatacctctcagcgtggtgaggtatttaaggaaaatacctgttgacaggtgacattttctgtgtgtgtatctacagcatgctggtagctgccatccagtctgcaggactgacggagaccctcaaccgggaaggagtctacacagtctttgctcccacaaatgaagccttccgagccctgccaccaagagaacggagcagactcttgggtaaagaccaacttaagtacacgtctccatttttctaaagtagtgatccctcagggccccagcagcaaacagttggcacatcaaggattgacttgaagggattttatgacaagactattagtgaaagagtgggcgggactaaaggaactagcaaaggatgaggccaaccagggactagcaaccctgggaagcctttactacccctaggcctgggggaatgggaggatgagagcaggaaccagggaggtcatgagccttggacaagggcacagaacagcagccagagccatgtgcagccagccactgtcagaaccatgcaagggggaccactcagcgccccagcctccctctcagacagttgccatctgggtctcttgttggctgatgcgagagcaggagggagcccactgatgcagttcatagagctcagcctcctgggcaggaaaccgggcagagaggagtagaaaagaattaagggtggctgcgaccagcccagtcactgaggcacgtttcccactggagacctatgagcacagtgataataaagccagttacctgcactgactatccctccagacaaaagctttcccaagaagttagtcatggctctgagagatctagttgaggatgtttggcaggggatctagtggttacgggtggctaagaaaaatgaggaaggtaagagtatcttgcagcctgtgttgggaggattaaataggatgccacacacagggccaggcagacagcctggtcagtaatagccatgacgatgggggcggggggagcaggaatgggagttgcagtgtttagctcagatgcatgcctgtgagagatgcttccactctcacagaaagatgagaccaaggaaaaggaggaggaagaggaaggaccttgacaaaccttggggcccacattgtctacacctcccttcctgctctagagcagaatagaaagttcaggttgcaggcagctctaagttgaattcgtgtcctgtttaattttctttattgctaaatgaatgcctgtgtctgtgatgctgacgtatgttcctaaggagaggggagaagttcattctgaacataaacttttcatcctctctctgtccagcaagaatggaatattccccaagtggcctgagccagcttggctttctttttgttttcaattatgtgggagttgaggagggggatgggaaaagcttcccaaacacaccctcccccaggcctgaggcacccctgggggacagagagtgttagaggttggtacaggcgttagagatattgaaaggacatcccatgcaccccaggggctggtgtggctctgtacttccaggcaatattttgtggaaggggaaccttgtcagctccaggttgtggatgtttgaaaatcagttggtacccagtggctccatcctctggcaggcatgtggatttgtcaataaccaagtgaactctccaaaataagttaaaacttcctcccttctcagtttcaagatgctggaaatagctgttcataagccctggggaaatttagccctttggctggtaatgggagtatccgagatgagagggcagctggaaactttcggaatgacctcccacacttaatttgggaaatgcctctgcacctttatgggcaaccagatgcctgccccagttgctggagacactgatgtgggctgaaaggaatgctgagacgtgacgaggagagatgctgcggagggaatatccccctcagccctgacctcatcggctccatggctcctccacagtacagctgtctactcttttaagttctcccttcaggaaatagccatctcaaacagaatgtgcatttgagggcagaatgtgtaaatattgcactactgtgttataaccgtcaggagccatgctgatgatgaaacgtcccagatgccggtgctggaaaggtccctggctttccaagcaaatatttatctcatggaaacatgagtcatactcacagaggagtatggattaactccttctcagcagccagggagcccagcatcccagacagcatatttaacccagaggccaactgactgctggggcagatttgtggtcatgaacatgtgctttgtgtcctctgaccattagacagattgtgggtcacaacgttgagtatacagtgggagcttaataagtgcttattccctgggcagggagttcttcatttcaggggtgaccacttacatcttctcctctgggccctccttgaccaggctaattaccattcttgggattaactctatctccttttcccgcaacctgcaggagatgccaaggaacttgccaacatcctgaaataccacattggtgatgaaatcctggttagcggaggcatcggggccctggtgcggctaaagtctctccaaggtgacaagctggaagtcagcttggtaagtgtcctgcaaatcaaaggctggctaaatttccccagggcagggctccaggacatatctcacccccaggatggaattatacacacacaaccttcaagttgcagcccgaatctctgagtgtaattcgtccaaagaaaaagagaaaagagaagagggtcttcagggaaatcaagtgagatcatagttagacatgagtaagaacttccagatttacaagggaatagagcatctgatttggcatctgagagaggctattagatcttccttctcttaaggaggttgtaggcaactagttatgtgactgaagagatcagtctctactcacaccatcccaccccccaaacccagggcttcactgagttgtaccatgaaccagaccatcccaagaggctttttgagttctgacacttgctctgtgagccttcccttgctctgcacattgatgatataactttgtaactgcactaagagtgttcctaaagcagatagccagccgagctccagaaatctccctggctgcacctgcggaggccactgacccctctgtggagggaccgctcttcagtgtgtggctggcttctactctctgctcctctctcttggtcttcagccatccattgctcaccagtttctcaccaggagcataggaagatatgcatgtagggaggtaggcacggggatgacttgtttgactttagcaggtcattcaagaatctccttgcacctggtttcagatgctggggtcctgtctgtcacaggcttctgtgcctcctacccccttgagtttgtcacatggcccttcaggaaggcctgagatagatttgccctgggtgggcctcctatgagaaaatcttaagtgaggcacccaggcaaaatggaaagagccttttgcccagagcaggaagcctgtcttccatttgagctgttccacctacttagcttaaaagaggcacttcgcctgtcttcagtctcagtctcagtctcctcttctgtggaatgggacaataatatctactctccttatcatacactgctgtgaggactgagtggatcacacaaaaaagcattatgtaaattgcaaagtgctaaatccacacaggagatttgaattaatccaccacactgaaggtctgtcaagggcagggactgtttcattcaccagagtatccccagtcttacacaggacttggcatatgaaaagtgttcagtaggccgggtgcagtggctcatgcctgtaatcccagcactttgggaggccaaagtgggcggatcatctgaggtcaggagttcaagtccagcctggccaacgtggtgaaacctcatctctactaaaaatacaaaattagctgggcgtggtggcacatgcctgtaatcacagctactctggaggctgaggcaggagaatcacttgaacccaggaggcggaggttgcagtgagtcgagatcatgccactgcactccagcctgggcgacaagattgaaactccatctcaaaaacaaagaacaaggaaaaaaacgaaaactgttcagtaaacacttgctgaatgaataaaataaataaataaatgtataaataaatgctctactttcaaccactactctgtttttcttttagaaaaacaatgtggtgagtgtcaacaaggagcctgttgccgagcctgacatcatggccacaaatggcgtggtccatgtcatcaccaatgttctgcagcctccaggtaagtgtcgcatccccactgactctgcagccagtccttttctccatgtggcagttggtggagagaagaaaaactgttctaaacaatgatgagaataacatgtaattgtgatagttaaactgtgcctatgtgactgattgcagagtgaattgggagctgttggttttgaatgcaccacactaaggaatgtgaggacacattgctctttgcggagttgcccagctatattagctcccctcggacacagcccagttttctgtattcgcgtggatgctgtccgcgcgattcccagcactcctcttacagcatctcacctcagtgtatgttccttgcctccagtgcagttgaacctcagtcctgcctctcctcatgtgtgcattcacctttcttggcgctctctccccatgggccaagttctaccatgagttatgaaacattatggagaaaacatgtctttggaaatgtgagccagaaagcccaccagtgcccctcagtcacggttgttatgaatgacatgctaatggtttcactctggtcaaacctgccttttctttcctcttcagccaacagacctcaggaaagaggggatgaacttgcagactctgcgcttgagatcttcaaacaagcatcagcgttttccagggtaagatgcctgctaggtttgcgcctagcctgagcagcctcaggtcctctgtttgggccatagaggagcctctccagcccctgtcttccttggctgctccccagggctctcttaaaacttctccccactcccactgaggcatcctcagccccagcctgtgtcaaattcagagtaaagaaccaaggcaactccctggctttcatgggccaaagcgcaggctttcacaccgaggcctctgagcctcagatcatggggaagtcactgctggagagaacagacatagctctggaagccatctgcccaagagggcagcccatcccaagttcatcttacagtggccaggcctgccctgagccggggcctctgggtcactcttctgctgtccatggcattgcccatcctgggtgaggctggggctctcctgggcactgtatgtattctggatacagggatactgggctcgctatgtgtgtggagccatcccttccttgccccagccccacctccctctcaaaccctctctggctctttctgagcttcctttcctgctccccagcttgcccagtgctcagtgccccacttggctcttttgctacttcgggtcaggtggagcctcttgggaatgtgaagtgccttacagaaagattgcacttcaagaggagaggctgcagggagccatcctaaacccagaggcctggagcttaccgtgtcactttacttttgtacacaggggtctccttagtgccctcgagaaggattcttggccctgagcttctactcctgaggccacctctgtgcagccccagctccctcaactctaggctgtagtctcagtgggaaagcctggcttgggggtctcctaggaatgtccacctgaaggcacacttgataggggcttgcacaacttatgtctgccaaggccacctgaggaactccctggtgcctataagttccaccttccccttcctcttcctcgccccagcattttttctgagtaggggtggcaatgggcaaagccattgtcataagcagttgcaggtataactttcactagaaaacctgacaccttgtgttttctttcaggcttcccagaggtctgtgcgactaggtgagtctggtctgggtttgaagtcattgcagacctgtttaggccttacccccaagcaagcccaagcctgccatctgctgtatatagataagaacatcatggtgcagtaaaagaagcctggcctttggagtcagaacagcagggtgacttggggtcagacccagagcaccccatttccttctctgtaagatgaggataataagagtaacaaccttttagggttaaggtgagttttcagcttaggaagtctgggaatattgcaaagggcttggcaggaacccatggtgaggatctagttccaagttgataggtacagaaaaccagaacatcgggccttgagtaaagagtgaagtttcacaaaccacaaagcacctgctatgtgcaggagagcatggcagaaggaggctgcttggccctggtccttgagattctgacagtgtcctagacagacatggggagatctgcacctatttgacgttaccaacttctctttttcagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacatacgtcctgtgtgcatggtacagtgtgctgacctgaggccgtcatgctcctccacacctcaattctgctctggagaagctcagaaaggagccccgagggatggttttggggagattccagcagccagccctcagacagccagacagctcatgggggtttgagcctgtctttgccaaacaggtttttatttcaccctcctccggtcctggggtttcaagttttcagtgttgccttcaccccgcactttattcctcttattacttggaagtaccttccctccagcatggtgatcccctgcctgtgtgctggacttttgagtcctcagcaccaacctgtgaagtggttgccagcataatcccattatgcagatgaggagaccaaggcccagggaagggagaaccaccagcagcacgtaaaatagctgagctgggactggaactcacacctcctgactctcagtgaccaccactgacaacagcataagtccaggttttccaggcccatcccctctgtgccaacccacattcaggttccttccccggctcccgtaatctctggcatctagaatatcctcaggactctgagaggtggtatcatgtggttgtggtgccattgccccctacctgtgtggcctggggccagtcatgtgacctcccagggtctcctcttctgtaatagggagatgaccgtcacatctacttcatgggtccatcgtgaggatgaaatgagatgatctatataaaatgcttggtacaacattaggtggccttatttttatcctgccgtctgggactgctcaggatcaatgcgccagagagcctttatttgtgtctttcccacaggtgggctggcccactttcctagagaatgggacagacctccttcccacccacacccatctctgccaaggctgattcactccagcaggcggagctcatttcacttcatggaaccaatgacccaaagatatatccccagcactactgctggtcagtccactgctgctgggaatacagcaatggtagtggcagacagaggccctctcttaaatagcttccagtctgaggaaagagagatatgacatcaatccattaaaatcattcatccattggttccacaaatatttgttgagggctacctatgtgcacccccatgttagaccctggggaatagacatgtcattctcatgaggcttctctactgatgggggggaagagaattgtcaaccagataatggcactacagcctgtgtgttcttagtgactctgaggatagcactgtggttctgtgacagataatgaaggatttggaagcaggaatgcccaggagctcccagaagtgggaagagatgagaggaatggaaggaacttacctgaaggtgaaggcatcaggctaggggaccaagggagaaggtgtcctgagaggtaaggcttaaccttgggtgtgaattcagttcccgtcactctcccatagctctgtcctgctgttcccacctcccctgcagccatgcgggcttgggcggctagtgagggccttgctcatgctgggtatcctatgctatgcttcactttgagcacctaaaatacacacactgcactttaccaagatgacctcggaaaccaaagaggtgatcagcataagttttaaagacccttaaatttaaagtaaaaatcactacaggatccattataaatgccaaacactaagatgtgtgtttccagttctccccttcatttgtccctgccactccctgccctgactttgccccaccccctagtaatgtgggctccactctatgctccaaactctccctggagagaaatcctccctgtggttgaggacaaggcgcagccttcccctcccaccaaagaaggtcagattcccttttttggttcctaaccatccataccccttcttttctcatgaagactcgggctaagcattcattagggctgccatctggaggatggacccttagagctgaggggccagcactgtgtgt

SEQ ID NO: 11803 - DNA, 66213 bp, Human
cccaagtaactgggactacaggcgcccaccaccacacctggctaattttttgtgttgttagtacagacggggtttcaccatgttagccaggatggtctcgatctcctgacctcgtgatccgcccaccttggcctctcaaagtgctgggattacaggcgtgagccaccgcacccagcctgcatcttcattcttactgttagcctcaggttcaccccacctagcttattaagtgatgttgaataaccaattcttacatattattaggctcatggacaccatgacatccagactgatgggtgcctgctgaagggggtgaccctagcaggaggactcccctacgcaaggattcatggagtttgctgtttcttttccttagggtgagaaccaaactgccttcacacggtgggcagaggggaactgactcaggtttggaataagagagaacatcccaactgaaaagctcttggaattcgctgaacttcaagacactgtgtggaccagcttaggatagggagtgagaagaaattaaccaaaaggtaatttcgttacttttcagctggaaaaaagatcagattatacttgtgctttcataattaagtagctgctggaaaaaaacgcttcagatgctttctatgagaaaactgctgcttgaagttcagcagaagttatctacttgatacttatattccaggcaaggccttccgttggagaaaatatcggcactttggacaaaactgaaatgtgaaaagaaagggaagagagggcctctatcatgtaagatgcttatccaaagtggatttggtctggaaagtcttctaaaaccttccacatgactgtggaataagtcatgtggggcgcggggataagcgaatctctcaaattccaccacgtatgccctcattcaacctggatccttagagtggcctccagggcactctgctcaggactcagtcagctgttggccacacccatgctctccagtctcctgagaccctatttggttctgagagggctaaaaagcagtgtggctaaatatcccaggcctcaaagtattcctactgtggttggggaagcaatagaatcataccccataaaacaatgaaaacagtgctagaaaaacatcgagagacagaaacatctctacgagttaggccacagttagagtgaaggcagggaaggtttttaaagctgggtggaggggacaagtcaaaaagatgtggaaactggtttccctttcctatggctaaagtgctcaaaggggaaaaaggagtttcaaaaatgttcttggaaataccatctctcacgaattcttcggcctctgctgtcccaatgtcacttgtctgagatgtaaacagaggagttctgagaaagaagctgaacttgcatttctccctgtttctatttgttccaaacttgtggcatttctaacaggatgaagcggaagagaaagggaaagagacaaaagtgtagaaagatggaagatcccagctgcaaatggccatttgcagttagatggaacagctgctgacgttcagggaaatgcatgtctctcttcagatgggaaggagcagtggaaaggggtgacgagttcctggctggccaccaatcatcccatctttctgtgccggttcctcatctggaaagtgggagtgatacttgtgcttgcttttcctacccacaaagattattgtgagagctataatacggtgagatacagaatcctgcttttaaaaatacaaagcagaatcaagatgtcaataataaggatagtaattgtgttagttatctgcaatcatctattatagctagtcgtctaggatcctggatcgttctcctggttttactacagttttggatcagctcacccccaaatcccttgctgaagggtggagctctgtcagccatgggcagggaaccacttcctcttgcctttctactttctgtctttcaaacatgcccagggtctttgcacttgctgttccccctgcctggtacctctctcctgtggcttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctgcaaacagcagatggcttcccatatcccagagagtaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctgagaggggaagatgccctgcagaggaaactcacagtggctgagggagcccctggccgcctttgctttcctaacttaggtcgtgaggttcctaccggtccttttgacatctggaaaatgtccccattcactactaacggaggaagggctagaagagaagggtggggaaagggttcccaaaacttggaatgctaactaaagtgctgggaaattgaatagttaaaaaaaaaaaaaaaagttgcccgccatgtgcacggaaagttgcaggagaaacttggagtactccgagtctgcatcatctcctgcgcctatgaaattcattcttttcactgagacccaacccagctgcaggcttcccaggcaagcgctaaccgagcttctgggactgccaagtttgggtggatttaagggggaaaatgaggagaaagctgtggcattgacccacgccctggaggcactgtgtttgagagtgttgatagccagcagaaggtgcgaggggtcactcaccacatagctgtgaaaattcacaggaaggctatttttttcccccttgaatgtgtgtggggagggggagaatgggtagtggaaaacagatttgtcaccaaaagaacaaacctgccaagggtcacatcacggtgacagttccagactggacttagtgtcttgagtagagagaccctgtaaagagacctcctactccttagtgtgtatggagggccccgagagcatcctgggaggcttgtctgggagtgtttgggacacttgtgtttggatggctaaaggtggagtggcatctgggaaacatctctctcctcctttccagcccataaagcgtgcaagtccagtggctctgctgggagagtgtgtgtgtgtgcactgggctgggctgggcggtggggtgggacagccttgccgccctctgcctgtgtcgattcagaggtgaagaatggagcgtgtgtgttttaagtacagtcataaaggagaaggaaattttccactgagtcttgggtgagggactctaccagcgtgttgtggtgaggagggggaggaggtaggagcttggcaggggaggcagtgagggccgggaggggcactgctggtgggctgggctgagcctagaggtcagagtgggggtgtggtgaccagaatgtcagtgcagttggcagctgagggtgtttgtgtgacctgaggtcacccttgtaagaggctccctggggcctgcatggtacatcctcccctctcctgggggaacccagctggcccaggatttgtggattgcttagaaagatccttttgggcagcctgaagactggggagggttttcctccctcctccacctccacccacattccacttaccctttccctcctcatcccagttggtaacattcccacctgattagtgtggggagttgctgctgcagctgagttctggttttgcccagcaggatcacacacgtgcggccaggaggctggcaggtggaatcagggtgtgcaggggtgcagcccaagtccttttctgctggaaaatgggctgggtgacttcacttgcgtttttttggtatgtagtgggagtaggtccccattcttcccccttgccctttgctttggggtttctaccctaaaaattgaccacggaaaagtgaaaacaagcatgagtagatcctgcttccaatgggggccttcccgtctgcttactgcttaggtttcctgcggtgggtctgagcaatgcagaaagtttcttacaatttctctggattgaaacaagaaatagctccctcgctcctcttcataaatttctcagagaaaatctaagttaccaggaagtagccaaagaccaggagattgtggaatcaaaaagaaaaaaagaaacaaaaaatcttcgatgctctggcacggatcccaaattgttctgcctgggtttggtgagctgcactagtggcagggatgagctaatgcttttaaaatgggaggtgtgggtgtgagctgcttgcctgccgacctccctcgccttgcacagcaccctgctggcgtccagtacttggctcccaagtttcattgctcagagcctttctggtttccagtctgggttgaaactgtctattctcgccctcaaacaaatatgaaggagctccccattccttgggacccacacaaccccaccagtcaactttgtagccccctaaaggtgttcacatcagcccatcaacttcctgttttaaaaccatcatggtggttttctcttcatggcttggtgccatgttggcctagcaaaaggcacaggaggcctggcctggtcctctccggggggctgcccgatggcctttcctcctgtctctgctcatccacaggtgtctctttttgtcttttttccccaaagtcctagggcctggcatggcattctgggggaggaggagttaaaaggtgtttctatggcaactccaggccctgcaccctatggaagtgtttaggagaagaataaactacatgccggcttataagacacactgtgggggaaagaaagggacttggcagcaggcaggatgtctgtggtccccctccctggccagtcattgcccctgaaactcctgacaaaaccttgactctagaagaggaatgggagggggctggagatgaagaaggcggcctcggcccgggcaaatctgccctggcagctctgtccagctcaggaaggggtgggctgtgccaagggctttctgaaaatgtgcgtgtgtgcgtgtgtgtgtgtgcgcgtgtgtggcttctgcaaaggtggctggcagggctgaggggggttgcagcagagaaagagaattttgcttcagaatgccaagcccttctctccttctctcttgccgcctttgcatgggaggaatggggctgtaggatgaagtgtgttcggggcctgcctctgagcctgttgggaatttgagcatgaggctcagctggggggccggctgccagccccagaggatggcccctggatagctccaaattgttctgacaggggccagtgccagcagattctttcagtatcagatctgaggttgtcgttttagcaaagaagccattttcaaagaaaccagatccatcccctctccctcttacacacaattacacctcaacactgggctttgcaacttaaggaaaatagaaagaatcagactttggagaggcgccagcacttggtagggcaagtctgggggacccaggctgtggatgtcttggaaccatggaaggaggagagctgctatccagctggaggagggaagagacatgtcttaggcccctcctggttgcacgcacttcccaaatgccatctctttcaccccctcccccgaccccccacagcaaccttaagagtaggtattgcacccatttttcagatggaaaacactgaggctgaagagactgtgcttgtccaaggccacccagttgctaaatgataaagctaaaacgtattatcagttataccatgcttcaaaaacctttcaactttcattgacacatgacattctaaggtgaccaggagatggaatggatggttaacatttgaagaatgcttttcttctacatctgggttttctttaaaaatatgaagatagccaaaatggccagaggttttaattaaacatcatctttagggagggagagcttattattattctagtgtatcatagaggaaaattctaatgttctttggctattagatctggaaaagacccttgaaaccatcaagccacagtaataaaaggacttggtttgtctcactgtggcccaaggagaagtaaggttaatagagacaagacatttcagggcttcaagactcttcccttaaaggtgggatcagttagggctccccagtgggaggtacccggtctgccagtgtggtaggaggaaagccagggggagtcaggagactgggtcccagctggagaaggtgcccctctgacagttctgtgtccctttcacagtccctggatagataaggctagaaaagtggccacagaagtagcttgggtggagggatttttgtttgttttgcatgaacagcaggaaccattcagctccactgctgaatggcacattccaacaggttcattaattaaaaacaaaaacaacaacacgattctccatcgcacttggcttttaccattccagccagtatggacaaggaggccccttcttctaccttttgtcatagtctactcctgggtggccttgagaggcagggtggagtggtggaaaggcaatggggagggcagatctgagctccactccttcctctggggcttgttggctgtgtgtgcctaggcacatatgggctacctttgagctttagttttcttatttatacaaggggaataacaatttgtaccatcttggcctgttttatctatattttaaaagctacaagtatatgaatacattctatgtccatgtatgtatctctctgtatatctatgatatatccatttctatttatcatttatcatctatctatctatctctctatctaaaatcggagaagagtaaaatcctttctgattactttttctaactctagtcccttctccaaatccttttcttcctatacatttacatacataggtatccatagcaaatttatagtagtttttcccttagaaacatgaatagtagaacattaaacatcatggaataccacataataccacatatagtattctgcttgtttcccattcaacaatgcgtactagagatctttctacttaatatatatataaaactgtcagaggagcaccttctccagctgggacccagtctcctgactgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatataaatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggttatactgctagcaaggaatacagcctgtatttaagccccttcaccctggctctaaaatatatttaacaactatactataggtcacattataccatatcatattatatatactactacatactcttatattattataattatataatatgcattttcaattttaatagttcctgccaatttggcctccacagtggctgtgttaacacagttcttttcatatatgcaacatgaggggatggaggaatgttagagccctgtgcttaagagactcccatgcttctctcaaatagaaaaacaatttataatttttattgacttactgagtgttttttttccttctttttgtctctttgaaagggagcaaaattagggccacgaagatcaagttaatgggagtattttcatagggagaggaaggctgcaatgccaggaaagctgtgacccttgacttgttgcatgctggagtaattcggttgaagatagctttatgtatttattttgctttcagaataagcagtggaccatttattacaccaagttgtttgactttgaggacttacatggactcaggttcaaaggtatatgtggctgtgttttgaacacacatacacagggttttgctttctgactcaaagctgtccgctggccaggctcatggtggcagcaagggcactcactcatctgtctcccttcttgttgcctatggatggcacttgggtgagagcagtgggatggtcacaaggaggaggatggactgccgagagggaggctgggtggaccccagccaagaaggacgctggggtctcattattatgggagctagaaggcctggtttaggaaagaattcctgttctgatgaaagctcttcagtggactcttaggataaagtatcatcaaatggcttttacaagggccagtgtggaccctgcctacctcatcctcatagtctcatcactggtctgtcctgctccagctgttcatactctgtctctctggctcttggcccatgacaccccctcggttttgaacagtcctcattaacttctcattctctaggtctcctttggttcctttccctgatcactccttggcattggtacagacgaacagtcataaaccttgcccatattttaagcatgctgaaaaacaccatctctagtaaaacccaaattctccaaagctgcatgggaaactcccagaggggatcattcctgcgctgggagaaagaacttagggctgcgtgccacccagagggataaacctaacccactttagagggtaagcacccactatgctctctgcattacttgataagtctagtcctgtcttctggtggacatgataccctagcaccctcccagagaagaaagtggagatttctaaatgccaaccctgcaggagatcacaaacataatactgtaattttcatagtaagtttggtgcccttactatgtgccaggcactgtaccaagctccttacttgcctatcagtcatcccagctgcctgatgagctgtctcaggctagggaagccaaatggcttgcccaagctcacaccacttgcaacctatacttgcttagcctatctccaaaacctgtgtttccaatcagtctctcatatagaccaagggctacaactttttagacttgggaagattctacccattttgcgacctctccacatgagtctttggctccccactgttggggtccccgtcagtctgcttatctttggttttcttcctctccagacatgccttccctgctgcccccaaattttattactgtatagtcagttctgggatcctaacataaccaagccttacctcctaacccagtgccctttcaactctctcagtggttcccagacttttcaacactatggaattttttaaaattaatttttccctccaataagttctgtgtttggaacagttatccgacacaatttcatgtgttgagtgttgattaactttccattaaaaaacaaattaaaatataactagaactgctgatactagccagtcattattctgacacaatcagctaatatactaattaattatagccgaaagcaaggacggttggtgttttcataagcctgggaagttttctcatgggttcctgggtgattgcattgtcggatttgggttggcttactgatatgcctaaaatagctcctggcttctttggtatatcgctgtcctttgcccctcctgagaatctttagtttcatgccagcttagcatctcttctccctgtgggcaggtcccatgcatttactgccattgtcacttctccctgttacccacagtgctgccaccatgcctgggatagacagcaggtaactgatgtgtcctagttgaggtccctatcctttcagaggaggtgacatgggttcagatattttcctatgttcatgtctggcatccaggggtacacaaagtattgattctagctaaagggacttactaaatactgtttgacaggaggcccacaggtgtctatgtgggctgcagtggaactaagaggtctttttgttcagctgttaaaaaattagtgtttgtagcttcagaggggccccagagaacctttcctgacccatttagaggccatctgtgtggctaggatggctttgctgtcacagaagggacagtccacactacccaacactcaagtctgatttatgttcatgtaaatccgatcacctaatggtggcattcacggcttggagacaagaaactataagtgtttccaagcctgcagccacctggctttttgtgggggtggggaagggaaggaaagctgtacgatctggcctcagagagcccaaggtaaagttcagttagtggaaaaacagagccctagatgattgggcggggggtgggtactggggagtggagaggggaagtcctgagctgaccaagcctccaagagccattccggaactagagatcttaaatactacatggtaattatcccctctgcctctgcccatgagggtgtcaggcacagggccgcctggctgcctgcagagaagagctgtttcattcagaaacttcagagctcctgcaatgcctggattaggatgtggggatggtgagtttcgcaaccagggtcagatttcatgaagacttggtttcgtgacttgaggtgtttgactaaggtgtttgcatctcatgtatttaggaagggctcccttttgacttagactttatcatcatgaataagctccctgccttttcgatttggaaacatgatagctctagtgagctctgctactcccaagcttgggcaggttctttgcctcagtttcctcatctctaaaatggggggaaatatattatgtaccacgtggtaacttcattggcaattaagtgaaatacttcatggaatgtttagcactaaatattccttagtgttgaaaaggctgggaaccactgagacagttgaaagggcactgggttaggaggtaaggcttggttatgttaggatcccagaactgactatacggtaataaaatttgggggcagcagggaaggcatgtctggagaggaagaaaatcaaagataagcagactgaggggggccccaaaagtggggagccaaagactcaggtggagaggtcgcaaaatgggtagaatcttcccaagtctaaaaagttgtagcccttagtttatacaagagactgattcttggcacagaatagctcaataagaataagcatgagcttttagtagtagtgttgttatagagcagagctgatattctcacttcactttcggtgaggaaaatggcgctctgtggtgtgatgtgatgttttccagggtcatatagagagagctgagtttcaattcaaaatcgtggtttgatccccccgcctccaaatctaatgtgttccattttgtcacagtgcttcccacagggcagagaaagaaacaacaaagttcctactctattttcacaactcttcacattttagagtcttaagtccatttgatctcatttgatgacaacttcgcaacgaggaaagcaggatggtgattggggggtcggtcatagttcgtagttagtggatgtcagtattgagaatggcggggttctgtggcttagccatatagccaatacatggaatgggattggaacccatgtcttctgagggcaagcccaacacttgtcaaggatctggtgctgcccttccctctttagacagctcccattgataagcagaggtagaagtcactagggtagccaaagagagggccctagaaatggaatggtgacaatgaacttggctgaagagtcagcaaccgctcccctatccactgccagggctaggaggtgcagtgtggcatggaggaggagcactggctggagttaggaggcctaaggtctagtcctagttcatcatctgactctggagtccccttggtgatactgacctccctgggtttggtctcttatctgtaaaacagcaggatattggctctatgtggtgtgtatttcactgaatgcctactatggtcaagtttttctggctctaagttcccttggaaagggctctctactttagctgaataactcagcacctaaatctgtcaaccacacccttcagtaggtaactttgttagaaatatggtctattaaggtaagagccaggatttctgtggttgcaaaagtggatgcgggctctgaacaaaacctctagtgagctgagatactttatcagatgacatatttgaccaccaaacttctgttggagcagggctgatttgccaaacagacagcaaccttgcagacttagtcgatggctagaattaagactcaaggtcacttcagggcctgtcactgattgtgggagggcttggtaaaaattgaacctcattaacaccactgaagaagctgatagacaagaaatgggattaagactcaatactcatcaaaataaggctttccttatccacagcctacctgagcagtgcctcactctggaaaatgtggttcatggctcggctcaaacattttctgttgctgagaggacttctctcatggaagtctggctcagatgaacacatgtgtgatctgatggaacctttgtttaagtgaatgaggagggtatttggaagacttagatcaaacgtgtgccccattgggcagtcactatctgctcccctgacagggagaaaccccagtgacaggatagaaagctccaaagatcctgaggaagtttggaaggtcaaacttcaccactgcaaggactgagagatccaagaatctcagaatccaggttggtctccagggtgcagttctgaacaaatgagtgcagtggataaaaagcttatacttaaggtgggaaggtgggtgtgggttccagttccttctttggctgattctcttttggcctggatttcctcacttgtcatccatgccatgtcacaaacccagtgcctacagggaccaggcacagaagctggatatttgagtatcagacatattggaatattactcactcctaccaaatatgtttatggttccccattctcttggtttccattttggagagctaaacaggtactaaaaatgatttctttattataagacaagcaataaaacagtgggcaagtgtgatgataaacagcatctgagctttggctttggagttggggagacaatagagagtggcagtaactgtggtgaaccgtacagtccaggtcccttctggaggggacagctgctgtccagctccagcctatcaggatgtgagtctagtgatgccagatttccagtctcttaggacaagcaagaaatccaaatttttaatgtaacatcttctgaaaagatacacacacacacacacacacacacacacacacacacacacacacacacacgtggaccaaacaaaacatgtccatgggccagattcagccttgtgggtcaccagttttgtgatctggaatccattttatttctagaatctcctttcaattctcggatctctgagtgagtaacacccaatttttttttttttggcaaaatgtgtcctgcatttcccacactttctgagctggagcacaggttctggagttagaccacttggctcaaaccttggcctcgttcatggctagttgcctgtccctggacaagttaattccctggtctcatttttcctatctgtaaaatggagtatgcaataatagtactcttaacctcataggttgtggaagaattcacagacacaatggaaataaaaggcctggctcattgcctggcatgtagtaaggacctgataaatgtcagccatcatattattactacatggtattactgcctccccttagatgggagccaagtcttgctcaccagctcattgcctgatgttagtaggcattcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgctaaaatagaatgctccacctggatagttaacatctggattttattttgtttcaaaaagttaattacaaatagttcgaattccttctggtatccctctgagaagagtttcttactgggtggctcacaagcggggagacagaaagggaaaaaaactagattgatattgctcaggagaaacaggattgtggctacacgtgagccatgtatgcaattttgaattttcccatagtcatgtttaaaaaaacgaggaaaaagtgaaattaattttaatactaaacccaatatgtataaaatatgaccatttcaatatgtaatcaattttacacttattaataagatcttaatatttttaaaattaagtttttgacatccattatgtattttacactcatagcatatctcagtttggactagttgcgtttcagctacctgtggttagtggccgccatgttaatactacagcacaggtcaagataacatttgcaaaggcaaggcatcttcccctccccatttctagtttcatgaactgtgcacagggatatggggctgttcgaggtacttttgggctgaccaaggctcagaggctactgacagctttgctgcaagtaacttctaggccttgtgggtcccagtgcagggaacccatgtgcggtgacactggagaagccatctgatccaggtctctcacttgacagatggggaaactgaggtccaaagaggtacagcagcttggtttaagagatagagatggaactggaacaaaaataataaccatttgataatattttaacatttattgatttgtttttatatgccaagaccttttaaagcattatctcctttaaactctcataaccactcattgaggtaggcactcctatttctactttgcagatgaaaaaaattgggacttaagaggaattaaatatgaaagcagctactatttgttgacagctattttaagatctttatatacatatatacatgtaataaattctattctttactataaacatacatgtcagaaattattagtgttatcatccttgtcctcctcattccactttgcagatgaaaatactgaagctgagagagactaggtaacttacctagtatgtacctacatagtgaagccagatttgagccggacctcctgactccagagtccgagcaatctcaccaattctgcccacggtcaccccactgcatgatggcagagctagtatttgagcaggtgtgtctgttctgtggtctgtggtcttcaccgccccactagacagcctggatttttctgctcttgagtctcaacactttctgccttactgtgccactagtaaggaacagaacagggaggtttttgaccccagcactgattgaagggcccaggcaaagcaggctcgtctcctctggcttggctggttcccaggctgccctaacccatgaagccagattcttggccaagttaagcagggtgggaagaacacttgtccattccgccttcccagttgggcgaggtcagtgtaccaggttggaaagtggtatgtgtctaattgcaggggcgggggtaggggggaggccagaggattaacactctttaaatagacatcagaaaactaagaatagccttgctgcctggtaattgatgggcattcctgactacgggccacacactcagtaggtgctcgataaacatgggtgaaatacaggaataaacaaatactgaaaatgggtcattgggtgagcacttagccagtaaaaatctgtgctttgtataaaaagaactttggactgaggttatatgagtcttcctgcaggctggagacctctgttacctttacttctctacttttgttgtcttgagaccagcttttttatttttggtgaggagaacagcaggcagttcaaatgtcagggaaagacaagttcagcttgctttttccttatttctgtcttgttacctgctatcctgccaggttagaaagatggaatcactcccttttgccctatcatcaagacttcagtgttccctggagcactctaaatttgccatcagacttggatcatcctctaataccaagctcctgggtccttcctgaaggctgcctccttgtcttgctgagaagaattaaggttgcttccctgggaggaattcagcagcacctcttgtaagtcatcaggtgtgctgtaaggatggggcaggcaacatttctttgtactgtgggaaggcctaaatcagtgtttctcaaggtgtgatccttgcaccaccaatcttaagaaatgttctttggagccgggcacagcggctcacgcatataaccccaccttgggaggctgaggcgagaggatcgcttgagcccaggaattgaagaccagtctgggtcacatagtaagattccctgtctctactaatttaaaaaaaaaaaaaaagaaaaggtggttgggcctgtagtcccagttactcttgaggcttaggtgggagaatcgcttgagtccacgaggttgaggctgcagtgagccatgattgtaccactgcactccagccagggtgacagagcaagactctatctcaaaaaaaaaaaaatgttatttgggagagctgtttattgtattcccctcttggagagacatgtggctattagcatagtaaaagctctgagaagtcctgctgcatggtgacctgtttggctctgtttaatccagtgttctctgaacatatctagccaaggaactaattttcccaagaagcacctacaaatgcagttggtgagacactgcccagatgaggattctgaaaaccccttttgcccacttgcctgccattgtgattgctgagtagggaagaagaaattaggaagtatcatctgcattacacagggaagctgctctcctagggttgccaaacagaaatggctgtagtggtgccagtgggtgctttgtagggaccagaagaaaaaggaggaagggaaggctgaccttcaaggtcacacatttgccagatttaaagttccttcctgtggtcatgacttgttttataatcttgcttggctcagttctgggcacacatcagatttttaaatcctaggatcttgtttataccgttaaggacatgattgaaggacattgtggtgagtgtgaaggtgagatgtttctgattgaaggtccatggggcaggcaccctgcgagcaggtaatgaacagtaggggacataccggtgcaaccccaccctggtcccctggtcgtctgggccagatctctcccctctctgttctatacttctcttacatcaccgtcctacctaatcattttaccgataggagcacctttgggattctgattaaagctatgcatacaaatttcaagagcttcagaaattctcctaaaagctatcttggatcattagaacacttgccctagagtatcactgagtcaataatggtgttgaaactaaacagcaacaaaatccccccaaaaaggtaacctaacttagtctgaaattgtctgaaaattaatggcactgccagttcagtggctgctcagagcgttttggtgaagaaattggctgatggatattttgcagtagtctacaggatttgacgtgggatgccatctttatggacatggctctgctgggcaaagcaaggacgggcacatccagcctatgcggtccatcaggggcactcacatttagaatgggggagtcttagttagcccaggggctgggggcagcatggtagtgtagaaaaaggggccagtgcctccagaaaatgggaccccaggcctggctctgctccttctgctgtgtgattctggttgagtggccttccctttgagtcctctggatgaagttaaggagaagtcttgggttctcaagtagtcactattcagactctcgctttcagagtatttaaaggaggaaaggaaacagaaggatagggctggtggacttaaaaggccgtgtgtttgccgccaccccatttgctcccagggctgggtgtttgtctcccctccggcgctgggcctcctgcttggcctccagctcttgcaccattaactgcagtcagaaaagctgatgtcactgtggccggcctagggggaaagtctcaggataaaactgcttccacctggatctggagaaggggaagtgactggcaagagattcgcaggtagggctcagagaccaggaggaatccagtctgggtaagaattccctgtcatggggctctgaagccacgggccaggcaggtagtggatttcaagccagccagcggggtcacttggcccctgcagctactcctcgccccctcctgcataatttcctatttcctgcctcctcctcctctgacacagttataaataacctcgaggctggcctctgcgcttaagtataggtgagccagaggaaagtggaggggatcaaggtggagctggatctgccacttggccagggggtcacagggtttcagattgctcaggggaattttgttttcttgttttttccactagggagtgaggtagtgaaagaggaaataagctgtgttggcatggggaggcttggccttgcaggccggtgctgggtttcacccgcaaggagctgcctctctgctcactgcagatccccaggaccaaaggtctggaaagaggcttagtgagaaggcatctcaggacacaaagaggacacgatgccttgctggtgaggtcctgcggtctccttctcgaggcccagcccggccccatattggaggccaaacatgtagaagggtgtatctcattttttacctttttttctcaaccaccagccaacgatgggtatgtgatttctaaggatgtccattgactataaaggtcccattaatacatatgctatggacagattctctccttgaacacaggtttatggagcacctactatattccaggtgctgggcagagtgctaaggtcacaaaaatgaatcagctgtggcctctacagcctgttcccctcttggcatagatctgcccttccccctccacagtctggacaatcaaggacctggagtaagcacactctaggggccgcgtctcccagcatatcttttgttttcgaaagttcaaaaaacagaagaggaggattctgaaacagcaaacttgctgggtcatccatagagtatattaactggctatcttgctatctgtccataacttgctacctgtccatagtgtatattaacttcctgggagcccactcactgcctgacttcctgttctgcgcatgggcccaagggaagttctcgcaaccatagttttctgtgatatccatcctaccacatggcttcctgggaaacccattagcttttttgtttgttttagagcccaagggaatcagggccttgaggggattttttggtgtggggggtggtgcaagcttctaacactgagagtgggtgcttttctgattcctatgaaggtggagtgtaggtgtcgttcctggctcagcagagtcagccctctcatcctattcaggccgtctctgaggctggctcctgtgcccaagcccttcctcactccctcagggcatgatcacagggcatttccttagcattcctcctttctcccctgtgtgtgtgtgtgtgtgtgcgtgcgcgtgtgtgtgtgtgtgtgtggtgtgtgtggtgtgtgttctactccgtgtgtgtgtcatcctctgctcatccacccattccactgcgtgtgtgtgtgtgtgtgtgtgtgtgtggtgtgttctactccgtgtgtgtgtcatcctcctctgctcatccacccattccactgcagcacctagcatcacctaggggcctggaaaacctgcacctgaaagccgtaactccccggcacctggctggttgacttcttcccccttaaccccatttactttgaggatggaggtagtctttagggtcaggctgagatttgtcctgacccatgcttagttggcacatcttgcttctgcaacatgcttgcttagggttgggcaggggcccggagaaaacaagtcgtggcatcaccaggacctgattacccccaggcaccaaggagcacctgggaccaaggggaggtttggggcttgggatatgttttagggtgaaggatcacagaagcttactcatacctatttgaaagccaagtcaacagatgtgggttcttggaaggagaaaaggaggttaactgcttacttattagattagaagtgatgtatgaatgataaagagcagagtttgccagatattgctaattaattctctcactgcttattttatggatgataaagggtagggagagacatgttaattggcttcaaggtctctgagccaagcatgaccaatccgagaaacccaggtggcttcatgctctttcaatatgatctcatccctgcactagagaatttatatttttgagcataaagaatacccaccggtgcaatctcccaggctcttctgaagggtttggagagacagtggaggatgtcaaaagagatgaacttagagtcaaaaaaagcagagatggaatcccgtctctgccttttaccactggagttagttgactaaaatgtaaactctgagccttggttttcccaattgcaaaatgggaaagaccccatttataatgcaggtgggtgagagatgccagcagtgacagggactttcagtaaaggctgagctgaagctgaatttgaaaagcacattctttacgttccattgaagatctgcacttgctcttctgctaaccgctaaggtgtcatcagtgctgtgctattaaaatcagaagtcaaagaaggtgggtgtggccctcatagccagagttgatagaaatggatttattaatataatggatggtccatagaaaggtgaatgacctggttaacagacagggatggagtggagacctgtctgccctggtcttcaggctggttctgaaatcacagaattaagatgatctcagctgaggggcaaggcaaatcggatggaagagcggaggcccagagaagcgaagccctttcccaatatctcacagcaggtggggagtgggggaaagcagcttccagggggtggattcctgaaccaggtatttgtcactgtcccacgtagctcctcttgtcaccatatgtcccactcagtggagggatacttcctgcaagacaaagagggcctcatggttcccccgtcactcactgccttccactccctgcttctgattattctgtaagaagttgaggccgagcgcagtggctcacgcctgtaatctcagcactttgggaggccgaggcaggcggatcacctgaggtcgggagttcgagaccagcctgaccaacatggagaaaccccatctctactaaaaatacaaaattagccgggcgtggtggcgcatgcctgtaatcccagctactcgggaggctgaggcaggagaattgcttgaacctgggaggcagaggttgcaatgagccgagatcgcaccattgcactccagcctgggcaacaagagcaaaactccatctcaaaaaaaaaaaaaaaaaaaagaagttggagctctgtctgtctgtcctttccccaactccccatctccgaggctggctcctgtgcccaaagtcttcctcgctgtctctgggtatgttcacagggtatgatcacatttcccctgcatgccctgcgtgggatgtgctccatgtgctgatgcctctggggatttccagatgatgtccctggacttggcagagcagtgtggggaatctgggacttgcacttcctatcctcatggagtctggtctctcaccttcacaggccactaagaggaaaggcaactggtgtgacgtctggggagggaagtatgttcctgtgcatcgaaagcctcaaacatgtgcatacactttaactagcaatcttacttctagaaatttagtcctaagaaataactaggtaatggagtccattgctacattgtttatccccaaattaatctaaatgtctattgcaaatagactgcttagattatggtgcgttcatacagtgaagatctgcacttcctcttctgctaaccgctaaggtgtcatcagtgctgtgctattaaaatcagaagtcaaaggaggtgggtgtggccctcatagccagagttgatagaaatggatttattaatataatggatggtccaaagaaaggtgaatgaaagagtcataaaagatgttgaggtagttctctattgatgccagaatagccctatggtgcacttttgagtaacagaagccaatttgttaaaaacaacaacaacaacaacaaaaaaaaacagagagagagagatgaatgtgcatccagatgcttagagaagagtctgaatgtctgtatactaaatatcaacactagttactctgcgctgtgggattttggatgattttaatttgatccagtgttttctggaaaataaaatttcactacattgacacatcatttgataatcagataaaagaacaatggtgggaaagcaaggactcaagtgacccttgcttttgggtctagagcatcatgtaggaagccagcacagcccatccctttcctaggcgccaccttctggctcctggtgggacttgtaagtcccgtggtcagttacctgattgctcttacggacctgacgctggaaatcctctctctccaaggtccctgcaggagatgggacctgccacagagaatgccgcaagggatgtttctgttgggagctgtgagtggggtggatgtcctctgcctctcttaaatagatgagctagatttgaacctggggctggccaaagggagtctcctctcagaaaccaggatgcaatgggccgtctgtgtcccagccccaaagcagccagggtccagtggattagcacagagccgaccaggcctggagggtggtggtctgggattgggtgagcagccaccagcaggaatagcaattggagggaaggagaagcattgccaagagcaacttagggggccgtgagtgcaggtctctggacagacagcatggtaactggctgaggcaggaagaagcttggtgggctcccatggtgctaataataggccgtgtaggagcaggggaggcagctccagacttggagtgaaaagacgtggggtgcagtcagaatgaactccccagccatccatgtggtctcaggcaagtcactctgcctccagagccccatgtccactcctataagatggtacatccccacagtgccctgccacaggtgattataggtgaaggtcttctgacacctatacgtctaagggtcatggagtgacatcttatgaagtcagcatatagaaagtcaaaaaacccttacattcctgtaaaatacagtgcaggccaggcgcggtgactcacgcctgtaatcccagcattttgggaggccaagggtggcggatcatgaggtcaggagatcgagaccatcctggctaacacggtgaaaccccatctctactaaaaatacaaaaaattaaccaggtgtggtggcgcacatctgaagtcccagctacttgggaggctgaggcaggataatcacttaaacttgggaggtggaggttgcagtgagacgacacctcgccactgcactccagcctgggcgacagagcaagactccatctcaaaaaaaaaaaaaaaaatacagtgccatctctccataactccacctgagccagcagttccatcagtgttgtgacagattactatttttttttgttgtcaagtaccctcaggttgagcagctgagatgcttttagggagtgagacaatctcaggatctgtctttaaaccccgtagtcatatagggactggcaccaccagagacaacagcagatccctgtctggagctcactgaagaatcaggggtgggaggaattgcccttttaaaatggagtgtatatatgtatatattttttgcataattaaataatatatatatgtcattgaactcaggctggttagaggcatgcatgtatgatataaattctctgtatacaaataaaaggaagttacttgtattcgttgaatgggttgttatgatgactcccttcatgggaaacatttggatccatttcctctgctttcgatgttgttctttcgcttctgaaccagtgtttgaggcagatgtctttgatactgagtaaagacatggcagtttgcattcactctctgaccaaaagagatgctccctactcttgcagaatactgattgcccatgacaaccagagtacttttataagaaaaggagcacacagaaggcagaaagggaccttgtttggggaggcggctttgagcagtgactttatgacataaacgattaggctcttcctggccccgcctgtcttgggatatctactcagaccctggaactttgaaatcgcaggctgggtccaatgagcgcagaaaagggacaggactcaggcagataggatttctttcgggtttggtaaacagctggcctctaggggtagggacaagggcagtgggtgggaggacttgggggagggatgggtgagctcgtgggaactgagaaactgtgtctagggcttccttagttatactgaatgctgcatgtagaggtctgcagggtggccagctgatggctggcggaagatctgctgacttggattcagttactactaaaatggcaggtttagaaagaggagagaacttctagatccagaggaaataatcaggtaagtatgctaagatgtgtgtatgtgttagccaggcacggtggctcacgcctgtaatcccagcactttgtgaggctgaggcaggtggatcaccaggtcaggagctcaagaccagtctggccaacatggtgaaaccccgtctttactaaaaatacaaaaattagctgggtgtggtggcgggcgcctgtaatcccagctactcgggaagctgaggcagagaatcacttgaacccgcaaggcagaggttgcagtgagccgagatcatgccactgcactccagcctgggcgacagagcgagtttccatctcaaaaaaaaaaaaaaaaaaaaaaaaaaaaaaaaaaaagatgtgtgtatgtgtgtatgcttatatatataatacatatttatttgtacatatgtgcatgtacagatataaacacacaaggatgtttatcatagagttgtttataaaagcatccaactaacatttctgtatctatgcaattgaaaacaacatagccattcaaagggatgaggcagagctatatgaactgatatattgggattgaaataaaccagatcaccaagcacattttggatgattctattagcaggggacatatccacaagtttatagtagcatagggaaaagtcttgaaggtaatataaatataaagcatagttataactggacagtgggagtttaggtcatttacacaattattttataggtttttgtttgtttgttgacttctttttttcccaacctttctttagtgaagttgtattacttaagttaaaaaggaaataatgagcctggtgtggtggctcacgcctgtaattccagcactttgggaagccgaggcaggagcatcacttgaggtcaggagtttgagaccaggctggtcaacatggtgaaactccatctctactaaaaatacaaaaaattagctgggtgtggtggtgacacctataatcccagccattcaggaggctgaggcaggagaatcgcttgaacccgggaggcggaggttgcagtgagctgagattgtgtcactgcactatagcttgggagacagagcaaactccgtctcaaaaataaataaataaataaataaacaaaatttaaaaaggtaataatgtaagaaaataaagagcatggagaaagtagaaaaccagataacctcggtcctattttgttaaattttgggaaatttcagtatctgcattgtacagatgacaggcagaatcttgagaagttaacactttaaaagaaagaaagaaaaaaactagatattcactatgtgtcatcttgttgactattctcttctctgaacttcctggcatcttagttagcctatttgagctggaataaaatgtactacgtgtcttcagattctgcaaacatttaccaggcaccagggcgtccactatccagtcccaagcctgccactcaggagttcatgggggagtgagtgcatgtggcaggcattaggcagggtttttgcattctgctctcccacttgatccctgtgacaaccctaggagcctgctgccactgatcttcttattccacttgagggaacctagaggcagagacaggatttgaatccaagcctccagctccaaaccccagctgaaggaagcaagctggaacccaagatgctttcaatccctgctgctctgagcactgagatttgttcactggaatgctggagttttgctgatcattgacctcgcaggggcccactctgaagttaaaaatccccgagtgaataaatctccagcctctcctgctgtttccttcccagttctgaaagtgagggcaggagagatgagctttggccaggaattcagcgagtgactttgcgtggagtgtcagcttctccacattgctgggtgttagcttacccctgtctggcaccagcagcaaaaacagagccaggcgtggcctatagcaaagctcccagtttaaatatgtgaattcatttgggcctggacagctgcatagctcaggctgggcagaatctgccaccctaccccgtttccttgaaatctatacaggaacacagttccaaataccctggtgccagtccctgcaagctcctacttgtacaaatggattttaaaacatgtgatgatatctacctcctcccgtacctctgggcttttctaggtgtcagcatgaatctcatgtgagctttacaatgaccccagagtgggtgggcaagggagaggtggttatgactatcatgaactcccttgcttttacaagcccactcccctacaatcctttctccaacaagtagacagtgaactttaaaaaatgtcagtcacatctctgccaatgccctgctcaaagccctccagtggcttcttaattcctcaagaagctctagaagtttctacgggatctggcctctgtctcccttggccttgctgttgccacatacttctagctattcctcaaatgctccaggctccaagtttgtcactgtctcttttgaacttgctgtcctctcttccaggaacacctcatcccccagatactcactggctggccccttctcatcatggaggtctcaactcaaatgtcaccttcgtagagaggccttccttgcctcccttcccctcctaccagcctccttgtctattcccctttgcctcctagcacctgccatcatattgggtatttgtcttattgtttggcctgattcctcctccgttacttaggcaccaggagagtagagaccttgttggtcttgttcaccatctagaagatacttgaaactctaacatttgttaaatgcaggaaagaatgcccttttgacagctaggaaattgaggctgagacaagtgaagtgtcttgccctggtttcccagctagtgagtgtctgtgctggattcaaacttagctcttatgctccagccttcaagtgggggaaactcaagagggcaagttcttacggggccacttaggagcagacagcttcttaggacaacattcttttatgttgatgtgaagtagcaaatctttcagagatacaggcctctaaaaaattctgccatctgccggctgctgtgttagagccagcctcagaaaaaggtcagagatccaatccctggctgggtgctgtgcacccaggaaagaaggagcagaattgaaataagtcttttccactcttctagaagagccttctaggccacaggcagggcatacccatgcatagactttaagggcctttatttggtctgtttgcttcccagttggggaaacaggcccagggacaggaagtgacctgcctgatgctacctcatgagttagtggtccaggcagttagaaccaaggtttcccaatccagcgggagttcttacctacccactatagacttcttggccggttctgggagactgagctctttccttccctgtgtttgcctcatcagcacgctggactgagtgttcccagattcagtgctggagccagcggtggggaggggagtaggggctgaagagtatatcagccaagcttgggggagacagtcacataaggaaattcacactcttcctctctcattagggggccccacaatgaggaggggaaagacaaaaaacaaggatcttgggtacattggtccttacctccccactgccccaggagcggtcttgagggttggaggagactaccagcctcctccctatagtggacttgaacttggcacatggaaccagctgaaactggcaccatttctaccctcagagggtaccgctgaagaagacgggcagagatgaaagaggaactgcttaattcagctcggcacttcttagcagctcccccatcccattgccggctttagtcccaggccagagacccatgaggtgcgttgaacattactgataccctctttgatctaaaccctcctttcgtgatcacgcctggtggctcaaagaattgctcccccagcttactgttcctgttggtgctgaaagaatgctcgtaattgttaccaaacagtggacggagcaaggcaacatgtcccctttgcccagctggctcccagttggcacttcattatggcaaagacagagggggtggggtccccgggccttcggcatttcatttgcacccacatgtaggctcacttcttggcctgggaattgatcggtgccagatgctccatctagccagcatccccaccgcagcagggctgcccgcctcctgtttcgtgaaaaacggcccggattttcatcagaccttaattggcctgggtctggccttcattctaccccagcctcttcacagactgctggccactggctgttccctcctccagccaggacaatgccggtccccgggcactgaccctggcccaggcaggcctgccaactccatagctctcatttctcactctgcacatcagtgctggcttcccacacccacagctcctccagaaggaaggtttgtcagcgggcttcaccatgcactctgacgtaccacttttggcccaaccaaactacaccccacccttgggtagaatgggaccaagatgcgaccctgacagacttaaatgagaaatgagcattttccagtgacgcctcctcttcctgcctcttgctgggcctctctctgcactgctctggggtgttcactgcacttggactgataccagtcaatgtccctcgcttcaacctgacctgaaactgaaatgctccaaacaagagtaagtggggcagccgacatttcaggaggaggaaggttggcagccaggctgctgtgagcttgcacggcccatatgggtcccagctagtactttgcattttcttttctctcttcttggaaccccttcgtcctttttcccgctgccctctagcctcttcactgtcttgggaaagggggcctctcacaaaacagtagtcaccgctgctgttcactgagtggttactttgcaccaggcactgtgctaagtacctcaaggggagtatctcccttaatgcctgcaacatcctatgagccttgtatgattgcatctcccttttcaagctgaaaagaagttacatgctttgcccgacagtctatagctaggaggagctggagctgagattcaaccccaggttctctggtgcccaagtgctcatgtctttgccctgtgtgcccctctttcacagaaacagagcttcagccaaatcctggaacggaagctcttgggaagctgcctgtgacctttcttattgtgtcccctcagcacaggtcatgcacaggcagctgggaatagatatgcgagttaaaggaattctcgttggaaaacaccagagggatccacagggccacccccccgcccccgcaataccactgtgtgtctgtccctgcagggccctggaatcccacagttgtttcctgtacccaggcctggggagccagccagtcacatggaccgtgagtgtatccgcctcacgcttctctgtggcccctggcttctcccagtggattccgcaaggtgtttcctgcaaatcctgctgatggtcttcgctggcacgtagcaaaatccacccagaacaccgcgatctgctggcctcagcctggatggggttttgtttttgtttagcttttaaaaaaatgtgtgtttttttttccccaaccaggggcacaggggtgggggaagaggagaaaaatgaaggtaaaaatattgacagagtgaaaagtattgaatattccttctatttcaaaaatagcagcttccatggctgggatgcaggctggctaggttcaggttgggctgaggttgaagttgagatcaaggtggcagcgtgacccttatgcctcaagcatgtccttcaggagggtgtgggagcctgaggcagaagagagctccttcctgttttaaaaacacctttttctgagactctcaaagaatgtttgaaatcagccatccaaggtgctctgccatttttaagagggaggacggggctggatggtgtccctgggaattgaagggacccagagaagaggtgaattgtttaaagttaactcagagcattagagtgggctgatatcctctgaagagtctacttgtctgtgagagctgtttcagctacttcaaagccagatgatcagggcagcggggctggattttcatcttcatggctgtgcacatctccacttgatatgtgggggtcggagttggggggcagtaaagcctggtccccatggagatgctatcctggaagcatttttattaccaaggactagcatataattggaagattgaaggcagaagcccttatcttctcggcattctttagaattcttctgtatgtagatttcagaacacacagagccagagcaaaagaccttacttggcattaacaccaggatccacctgcccctcccttcctggcattaatgtccagtgctcccctaatgcactttaagctgtgaagttatcccaggtttatttacactgtaactaatttactcttggctggactgtcagcctggaaaataggatgtcactgcaccccccccaacctccaccaaaaaaagacagtggctaatgaagaaaacagattgttgaagggcactaaaattgaggcaaggagctgaataatgtgccctcctcaggggcaggcagggcaggcgtggcaggctgtcggcattgttacagatcagcaatgtcccactagttagcaaatgggcccctctcagtttgaatgtgcagctgatggaccaggtggggtgattaggggccaactctgtacttgtttctgtccccagttttgttaagtgcagatcacccagacagatcccaggctgagaaagagactgaagacaaagctagaagaggcagctgaagcatcctaatgtcttaactcaagtttgacttttcagaaatgtgattttagaacatagcaaacaggaagcacgtgacaacttggaccactacaacgaagagaaagtggaacccaggggaaatgcatgagttagaaatataaagtgatgggactcttagattctagggttaattgggacactagaatatgtccagtccaacgtgttcattttgtacaataaaaaacaagggctccaggaggaaatgatttgtcaaactcacatagaaaatgaatggaaaaaaacagaaagagtatctagcttccaattcctggcccagggctcttcttgctattcaatactttctacgtaataagcctgggttttttttttttttcaaaaaaattattatacttggccacccagatgagtacagttatttagtagagtacgtagagttattcactaaatcacatcaaagttgggagacagagtctggtttgaaaaccctcgagtattttattttattttattttattttattgtggtaatacttaacatgagatatactcgcccctctctttttctgagacagagtctcactctgtcgttcagctggagtgcagtggcatgatactggcttcctgcagcctcaacttcctaggctcaagtgatccgtttccctcagcctcccaagtagctgggactacaggtacgtactaccattcccagctaatttttttttcgtggttttcgtagagacagggttttaccttgttgcccaggctggtctcgcactcctgagctcaaggaattcacctgcctcgacctcccgaagtcctgggattacaggcgtgagccaccgcgcccagcaagatctaccttcttaacacattttttaacactagaagtacttaaatagatgatggtgaagtctcaagctgtcctaccagcagtaaaaagattccaagtggggaaggtgaactctcaaccttgtatactgatcggtggctcctgggaaatttgcatttatcccctaacaaagccattaagagagtcattggcccccagcaagactgagatggtcgaaggacatgggaccatgtcataagcagggagagaccatcctaatctatgaaaatatttatcctggagatgatttgggaaacatgacccttcttttcaaatatcttgtttttttgtaagcccaagatgtcacctaggtgggagaaagccacagggaagcagtccaaaggagaatttttttatagtcaaaaaaaatggcttgacatggaacaggctgacctaggtcagagatggttgcacactgggcagtttaaccttgggatgggactgtagaagaaattcaaaggagcttacactgagtgaccctgaaggtcccacccaacctaaagtctgtggcctgtgaaatgtgcccatgccactgtgccgtagtttaacatgtccttctggaaggcaggtaggacccagagatgagaagtaggggctcccaattcaggctgcctggactggcatgctacgtccaccacttccgcattagatgatctggggagagtcacttcttctttacaggcctcgatttctaaaagatgggctaatgacaacacttactttatagggccctagtgaggctcaaatgggaaaatccacggaaagcatttagcgctgatcatgcatggaaagtgcctgatagctgatggcacctattgtaactaataatagtattagaattagtattgtaatcattgacaataggatttttataattagggaaagtggggaactacccacatgaccatcctcctgctttctgtgtcagtgtttgaccaaatgtgttcatccctggtactctcattgcttatcctccgagagcactggcatataatggaaaatgtattccaatttgttctgttattccagccaggaacatctaggaacaggggttggaggtgtgcttcagggactacctgagcccagcttttttttttttgagatggagtctcattcttcttgcccaggctggagtgcagtggcacgatctcggctcactgcagcctccgcctccaaggttcaagccattctcctgcctcagcctcccaagtagttgggattacaggtgccctccaccacatctggctaatttattttttttttttgtatttttagtagaaacggggttccaccgtgttggccaggctggtctcaaactcctgacctcaggtgatcagcctgccttggcctcccaaagtgctgggattacaggcatgagccactgcacccggccaagcccaccttttgataggagcctcccatgggcaggcagagtaagaagtgtcacatgcagccactggtcacttaggcaaaaccctgccagctttcagatgtgcagtggaggtggcagggggaggtggctggtgctgtgtatgttttgcagatactctgtggtgtggcaattgctctagaggactctagtgtccagaagcaggcatgtgcagtttatcattacagccctccttcaaagaggacagctggccctgtgctttgcagggagaggtgcactccgggtggcccataaacccagaaaatatgattcctatctggtacagggtaccatcctggcacctggagaggggtctgcatgagacccagaaatgactggatccacaacagacctagtttgtggaacagtcctaaagaatcctccattcaagcttatatctgtcacccagggaactggacgttcccttcagtcagaatgaactagtggcctccccttctcttcagccagggtctttgcagtcctcagccatgtgacctccgacctgtcagtcttggtctgattgctgtacccttgtttgtgctgtttccattgcctggaccatccttcttttctttccatgatcaaaaccctatacattcttctgagtcagttcatgcagcggaattggcattggaatgttgcagctaattgcacatactgggtgacagagtgcacagtagagaaaggtagggtgatacactcttcttaggaagcaatcaataagggccaagatggaaaagatgtcttatttcacccactgagcacctactatgttccagacactgtgagatgttgcggttagatacaattgtgagcaaagcaagatgtaattccggcagaatttagtgagtgtatgggggcagggaagaaagaggatgagacatgattcaaatgaatctacgaacatatagttacatacacactagggcccctgagaatacaaaacaggggttctgttctagtcttatgcttgcaggaggtggttggggatggctttatgtgaggaagtgttttttgattttaaatgtgaagtatgagtggcagttgatgggtaatggggagcagaagagggtctcatgcagatagaatggtatgtgcaaaggccccaaggctttgcaactgagagatttagaccagggctgccgatcagatgtctaaaaaagtatacttgttcgccccttgccatactctttggtccaaagggctgagctccctgtcttcaaaccagggggcttcaggtcagttactggacttctctcttcctgccctttgtctgcaagccaaggtaccctcaatctggcattgagagccctggggcccacccagcttgtaagtggagatttgaatccagacttcaccattggatgagattcttagacattacaagagttatggagagttaactccacctcaaagttctcaccatctgtaacttatacaagcccttctctcataattcagtcttgggaattttccctatctccgcatttccaatgcatttgacttggtggggtgtttcagatttgttaaatatttagtagtagaaagaagatgagctttgctgctgggcatatttggattcctagctgtgtgacttctgacaagtttcttaactatcctgagacttgttttcttcctatactcagtggaaataaagctacacattttgggaattggttttaagagtaagatgtactgtttgtaaagtgtgtctgtcttgttcacttttctgtttctgccacctgacacaatgcctggcacatagtaagtgctcagtgaatatttactgaatgaataagaggtttaggcaccatgattgcacagacacgatgttcatagagtagttggtcttctccttctttatcaatgactccatctccctgtcacacttcaaggccagggcaggtggttcagaaataccagaggttggctttatagttctgccattacccactttgaccaaagagggcagcagttagcattctttacttatttattttatttaaaatgaaggtttccttaaaaggatttggatcttctctttaatcattcctccgcaccttcagtgctattgattcctgataatggtcttagggcttgaagacctatgtatgggctcgtttttctcgtacctgttcctacctgagtgcccactatgtgagtgatgtggttgtgagctggaagggaggtgctgagtgagtaggggacacccgctgcagcaggtgggccttccaaactatggccctgggtgtccacaaccttacagaatgaagcttgtggaacttaaaggtgaggaaagcctacactattttaaaagccacatgaagggtaagttatagatgtaccagggtctccttggcatctgtgctgtataaaatccatagacagagcagccattggctcttgttcaaaccacaagaaagtctcctgcccactcctggtgcattctgggaacagatttgctgtctgcaaaggctgcatctgcgggtctggcgtgcaaaggagggtggttctttggctaatggtggacttgctcctaggcctatcccagagtccctcagctctcctagcaaacaaaatcccaattaggagaaaaataaaatgctatagatggctcctgagatgttgccagctgtttgggcttcaaaaatgccccgacctgaaagctggaagttctgagaaccgtttgagggcatggtatttttctgggcactgcttcaaaggggctgtggttgaagaccatgctgctattctggtggccacttgtgtgggataaagtttcccatgggcccccgtggagaggctggagcactctcaggggatagggggtggtctcagcccccctcaccgagtgcacttgcatggcagtaagcaagtcggcgcctctgacccctgagtgggcttgagcttttgagaggtcagcatgcccccttaaacttgatgtctcctcagagcacagcacagatgcccagccaaaacacccagggcgaaaccactccaagaggtgaaagggcttgaggggagacagggtacggcgggagacagagatgcatgaaatactaacgttgaagattagaaatgggatgtgcactggaatgagatcatttgtggttctgatgcaaagacccaggcttgtttctaggggtttcttggggcttcgggggcctcctgtcaatggactgtttggacacccatttggatacatgcaatcctaaagtctatgggcagtgacagagtgataagtctttatcactagcctcagggagtagaagcccacctaagaaatggcactgtcccatgttggagcaagacccaacctaccaagctgggagttaccgcccactgcaaggcacccctgtactttgttggactctctgttttctgtctctccaatgggctggactctccagcctccgggcctctgcccaaccatgaccagaaggtcctctcctttctctttctcttaactgtctctagtgattctctgatcccagctcaggcaggatgtctccctccggcgcctccaggctggctgggtgtgtctgctgcatgctcctgtggctccctggactataactccctgtcttcttgtctcacaagagtaaaataagcttcttaaaggtaggaaccttgtctgcctgcttattactgaatccccaagacatggcacaggatctgagatgcatagttcctcaaatacttctgaataaatagcagatgagtgaatcaatgaatttcaagtcgacttgaggagaaggagggggggtggcaaaataaaacaaacaataaacactatggcagagagggacacaggacctggagatggggcctggataaacagcctgccatgctcttcatatttcctgagtgctaccacaaggaagaggggcagctggaggccagagggcctgcagaggagtcagcaggtctagcaaggagtgccttgggtggagactccctggggctaattttggtgtcaccactgacttccttgagggtgctgagccttgggatcttcatgtgttggtagcttttgggtgctgtccttccacagacacatcaacaagttcatgggggtctcctgtaatagggtcctgtgacttgcctctttttggaggtcagtcttcaatattttggaacaatgtcggtattcggcctctccagatcacatttttacttgtcccttccttttctgagtaactctatggaacaaggactcctgacccagcactccaggaagccaaacacaaaaccatccccgtcttcgttattgtattacctttggttccctcccacagcctcattcattcattcattcaacatttttgggaaccctggccacaatctaggctctatgccatgtgctggagtcccagatgcagtccctgccatccggtaattagcgatgctagtgagtgtccaaggaaccaatcattaaagaacacgtgctggaagaaagagaggaaagccaagcagaagagaggtggactagcttggcctggggtggacagaaggcttcctggaggaggtagcatttcagctgggtgggtcttgcaggaagccaaaggtgcaggcagatgcacagggaggaagtgattctcacctaggcaaggggcatcataggacaggttcatatagtgatgggggctggaagcttcagagtgatagggtttgaggtatggtcccagctctgaagagccatatatatgccaccgagctatgcagaataatcctgtagatactgcaaacccaagggaggtgtaggtgaggatgtaaatgagggttgtggatcccatttgttcctgggagaatgtgggggacttaggggagaaggactgtgtttcccactgtctatcctttggggctttgacatttcccacctgacagccatttgcagagtaaaagcctcagggattctaatcatgcttggtgaacactttgaggtagtcgcctcattggacccttagaaacccaggtcacagaaacaccatcacccttctgagattcacagtcctccctccccaggtaagttggccctgaatccaggaatcagccagccctaggacttttgccctgtcccaggccaaggtatctgtacctttcttccaaattgctggtggccccaggaagaaatcaagagtggctgactttaagcagttagattaaacatcaaatgcattcatcccaagtccaggcatatacctagaaggagcgactcttaaattttgtcatttcattgtgtaaaactgaggttgccccttaacacatgaaggccagcatgggatgctaattttgtgttgtgttcttttgggtaatctcaaagttccaggaagcctgaccttcctaagcctgtgtttccttgcctccccttcccggccccttcatttcatctacaacagacgtcagcaggggccctgagtttttcccagaccgctcaagcagaaacccatcctgctcacaaggtgaggagagccaggagctcacaaaggcccctcctccccttccccgggaggtccaggacagggcatccccaggacagacctgccctggggaccccggaacacaaggcaggtactgagaaacaggaatctctgggcagggaggttttcatatcctccaggtttaatagctttccctgagatggaaacttgggttgaaatgatttgcagctttccagattttctgagtgtgtgtctttgggtttatttttagccacaggcattcatttcttgccaaaaaaacctgcttaaataaaaccaagattaatatttttacttaacggaaagagttagtcaggacaggctttgaactgggactccttatcttgatggggagtgcatgttaacggtctggccttggcgttgacatcaacgaaaagggcctttgaaacggacaagagagaagggccctgggggaccagggtaggatgcaggaaaagcctatttgtgggacttctctgaagagagagagttcctcttcactcaggctgctcgccgctccccacccccagcccccagcccccatgctcttgcagtgggaggggggtcatcatcttcctggaaaggcgggagatcggctctggctttgctcagagcccggctgtgattctgcctcacttccagctgctctccttaccgccgccccctccgccccccacccagatcagatccagacttcttcctcctctggattcagacgcagcaaactgagtctcttctgcaggatgggctgaggctcagatctgatgccatctccagggcgattccctgacacccctcccctgagatggacttcatctcttcttggctctgtcctggctttccgtccttgcttatattgctgagcctgccttacttgagtgtcattgctggtctctctcacctctggcccttgagttcctaggagccttatgtatctctctatccctgtatacgtcttcacaatactgaaacaccttcctggttgctgaagagttgtgtatctgaccctgtgaaccgagaattgctgttacccccttttgattgaataagacttagaaagactggtcatttgacagagcttgcacaggaattatttatctgtttttaaatcactctgtgtgtggcactttatacaagaaatcacacgtagcttcccatattcagcaaatacatatgaggtgcctgttatgtgccaggcactcttcgggcagctttggctacagcagtaggtaaagcaaagaacctgctgcccggggaggcttacattttaatggggagagatgatcagtaaagaagcaagttaatgtataatgtcagatggtggccagtgtctgatagagcacagtgtcaggggccaagggattgcgaggagggggaggaatgtgcatggatcaggatcagggaaggtcccccgcccaagtgaagaaagagtgttccagcagagggaactgcaaggtcagagaccctgagagcatgcttgggtgctagggtgtgcagtagagtgagctacaatttcctgagattaagaaggccatgagagccccgggtgcagggaaggcctgttatctggagctcagtgttggatgggtcgaatttgagatgttttattaggcttgcaggtataaatgtagactaaatgtagactctgggatatataagtaaaaagatcatcagggaggggaacaacatacactggggcctgttggtgggtggggtagggggagggagagcattaggaaaaatagctaatgcacgctcggcttaatacctcagtgatgggttgataggtgcagcaaatcactatggtacatgtttacctttgtaacaagcctgcacatcctgcacatgtaccccagaacttaaaataaaaatacaatttgtttaaaaaaaaagttcatgagagttctaggttggcggtggcaaaagcgtgggagctgtcagttgtgcagatggtgctgagacccacaagctggaagaacatagcaggaccacgagcctgcacctcgatgaccggactgagcaccaagaaggtcatgggtgacttcgacaagcactgctttggagaggttaggggggaggctgcctaggttattgcaggcacctttggaggctggtaattatcacccacaatttatctgctgggatgggaagtgacttgcccaaggtcacagagaaacagggcagcgacttcacccagaccccacgtgctccatgcctgtttttcattccagtacgccgtgatcacttctccagttttcttgatctgtcctttcagcttctgagtctttcaggagggtttttttgggagttgggattgtggtgatcaataggctgggaatcagagggacccagtccaggcaggcccctcaggcctctgcttttcacccttagttccgaaggccctttcctctcacctagacatcatcaaagcatccccagagaggcagcagatatctgagaaggaccttgggaagggtcactgaggaaggttctcaagatcctggggggatgaggaaatgctgaatcacaagaatctttcgggttcctcttgctgttttcctctgattagtaaatttaagaatctacaagtcatcaccatcagcaatataacagtgtatcatttgtctagcttcagggttacaaagtacctttgtacatatacattgtctcatttaattaatcaatctaattaacttcaaacttcctgtgttgggagaacccttagggagcctgtggttttgtggtttctaagttatttgtttttattccatgaaagccttgccggggagcacaaaggtctaaacagatgatacgatatactgttatactgctgatggcgatgacttctagatttttattactaatcagaggacatgtgtttgtgtgtctgtgtaagtgattgggaagggtggtgggtgggtgatcaaagggatgtggggctcactgggagcttatcaagggtccttccttttaggtatcaatcttcttctctgatcctctgcagtgaaagtggggaatgcagtaaaattatgaactattttgcaaccagtgtgaaatcccatgtaaaggtttttaggtggtctgctgtcctgggggacctcccatttttttttttcccccactaggatgcaaaactgcttacaggctacctgatcctcattgtccacagttggaaagtagggacattaacagccacaacagtagccaccttaccagcttgccatgaggacagagttaaagaacatgcacacgttgcttggcacctaagaggcattcgataaatggtagtggttgttatcagtatgttctagttcccttccttctcctctagattcactaatgtgatgctaagaaaagcaagcagtttgtaattcttgaatgggtgagcagctggaagagtgagagagcctggctctgccctccttgggcaggctacattgtagagtgtccaaggtgggcaggaaaaaggcttgcttggcgggctccaggccgacctccctgtgggtccctgacctattgcctttgccatgagcactccggcctcagcaaggccgctccctttgtcatcctgtgggagatgataaaatacacacgaaggggccgtgagacaagctgggtgacagggatccctctttcctcctttttggtgtgttttcatgggtagggcatcattccaacacttccagatccctcttttcctccaagtctaggccgaagatgcgagcccatggtccaggcttttcttcctacctagagcctgcctgctggggtcccatcagaagagcagccccttccctgggactgacactaacagtgacttctgcatttgaagaaatgcagtctacccactaaccagacgtcccttacttatccttgctgtccttttaaaaaccatgccttaaagcagcaaaatcattctatggggtctttggagagacaggaatgggggtgttgtgtgtgtgtgtggggtggcggtggtatctcacctgctagatagcatgaatcaactcctaagtcatggagaggatttgtactgctcttccgttgatgctaccatgggtggaacctggactcctaagttagtatacattaattagttaaggagtccttgatccccagaccagccaaatgggtagcattgttgctcggccttctagtctgccagtaggaaagtccaaccattaggtcggggaagaagggtctggatttggttgacaatggttggatgggggatagaagcagagagagagagggagggcagctcaagggtatcttgccccactctgtttatgctgatgaacagcacatgtgcaatttctggagacacaccagtaagcttttctggaaactcaatcccaattgccattggaaaattgttctttgttcaaaacttgtgccactgtggtccatactgctagagctggaggtggggagaggcagcatgaaggtatatttatggaagaggtgtgccttgtttgccttgcttttgtaagctcttactagcactcttgcccaaacaaatattcaaaggaagcaaagacagttcaatagagatatatgcctctatgcctggcttctcaggcgcatgatatattcaagagggccccatatatatttatagatcaatgtgcccattatataagttcacacatcctagttagtttcttcttagatacttttacattgaaatactgcttattccttaatcaatctcttccttgtttcttcttcttccttttttttttttgctgagacagagtcttgctctgtcacccaggctggagtgtaatggcatgagatatagctcactgtagcctcgaactcctgggctcaagcaatcctcccacctcagcctcctgagtagctgagactacagatacacggcaccatgcctggctaattgttttaaatttttataattttttattttttatagagacaaggtctcactgtgttgcccaggctggtctggaactcctgagctcaagtgatcctcctgccttggcctcccaaagtgatgagattataggcatgtgccaccacacccagcctcttccttgcttcttttgaccaccagatccctagaagcccagattctcttcctaagagcaaaagaaattctagagagacaagagaggctcagaggctgagattcacactgagcctcacctctcccttctctgattggtgcttctgtaccttggagactagtcctctagccataaactttttttttttgagatggaatctcgctctgtttccaggctggagtacggtgatgcaatctcggctcactgcaacctccacctcctgggttcaagtgattctcctgcctcagcctcccaagtagctgggactacaggcggccccatgcccagctaatttttgtattttagtagagatggggtttcaccatgctggccaggatggtctcaatctcttgacctcgtgatctgcccacctcagcctcccaaagtgctgggattacagtggtgagcctccacacccggccagccataaacttttaaaccttatctccccactagactagccatcagtggaagcgggaaataggacttctatttcttgttgtcaccctcaccagcacccaacccaatgttccagacaccaacctagttcatgcctatgttggtttgattgttgggggcactgggtagacagtgtaggggccatactccagcatgaatgggaataaagacaacctgtgtccagcctggcccatctgtaaagctggcttctagccaccacaacaaggtggaaggaatggctagacatgctgccagctaccagtttgaaaagtgtcttctgttgttggaaaagcacaacctcctcccaccccacttcccttgttccctgtggcccctgggccagcgaatgcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagttttgtttttgtaaggaaaacactgatgtggcctcttcactgggccatctctgcctcagacttttggaaccatgactgtgatcttgtttggcttgtcttagtaggcaattcttgggttacacatgggtgataaggtgggatgggtacatgtgatagagtaggcactcctgatcccaaaatacctcctatacttgttctgactacttcatctgtgcttctccacctctccctgaagttctgtaaggctagaatatttttatgaggttgcctttcttctcatcctagggagaactcccaggccttagcttacagtgcatgttagaagtctgaagatggtatgccctaagatggaataaaaatagacatcaccatagtggtgataatgctaataacagtggtagcaaacacatgaggtttgggatggactacatactgttctcagcgcttatattaatacgaccctcacagcaactttatgaggcattgtttcatcattcccatcttacagattgggaaaccaaggcatagagaggtttagcaacttcctgaaggtcacccagcaccagggctgggatttgaaccctggctctcaggctccagagaccaggctctttaatgcaatgctatgttgctgctccaatagtaataagcaaatcacttgttagccacatgagaggcactgggctaagaaagccagagagattcaggaggaaagagccccagagagatcatacagtaatggtggaacccaaacttcaatgcagcttcctgactacaaaaacgtattcttttcactgaactatcctcagatgaaaaggttccaagctcaggctatttggggtaaggaaggagttggctggttgtatgtgcagaagcttccagcagtactcagctttatggggcaggtctgcttgtgacatcttctgtctaaatcaagtcaagccatttttgaaccaggatgttgctatttaaaggaatcccttttgccttgcccctcccacaccccccggccaagactcgctcccttgtttaccttctgtgttaatgaggcagagaagatgggtccaaatcatttcaggaagaatcagtggtaaaggctggcagacatgcctctgcacggaggtgaagctgttataacctgcctgtgagagttaatatggaggaaacagtccccggggcctccgggaggctggcttgtcgccgagaatactaccgcaatgttagaaacagaggtggatgcaggatcttgacagacattggcctgggatcttgccaacctctcgtttttacagcagacttggaaacaaccactcgcctcctcctaatttgagctgcctccgctaaattgctcactttgccaatgactgtgtgttttgccatcgccggcagggaaggtctgaaggggccattgattcatctgaaccctgacttcatgtctgactgcaagggtaggatccaagctcatttggaaagaaacaagacagaatccagtatggatgaggaatcagttcttagtaaagattttttaaaaacagagattagagtcaaataactgggatacatagtggagcatccacaatgaggaaggataatggagctaccaaaatgtgtgtgtgtgtgtttgtgtttgtgtgtgtgaagggtattttacttaacaagcatttattgagtatctactcctttttgggctaagtgcaacttgagataagaaagattgataggatctcagggctgaaggagttcaatttgtaattcaaagtatgactgcataagcaagccccattccaattcctgttgaggtcttagcatggaagtatccagcaccctcatcacaccccctgatagaggcactctctgccctaatggcagcccccctgccttttgttgctggttcttattattagacgatttttttctttggttgagccaatgaatgttactctctgcaatttccagttttggtattcaagacctgtccatttgctcctccatgtgccaattttacaaatacctgaagacagctcttgggtgcttctttttcacacaacgtagaaagagaagcacaaccttgtagaatctaaaagtcaagtcctctcctctttctgttcccagtgcatgtggtaaatgcctctctttcagccctcaacccactgggtgtaattacttttgtattcatagttaactagtatctactgggtaaatcctttctgccagacattgtagtgggaaatttcataagatctttcgttcaatcctgattccaattccctgatgtaaagagagttataccctctttatagatgagaaaattgaggctcagaaagaggaagtggtttcacttcttggtctgttaccttatctagatcatgtggatgctaatactgcccttgtaagacagttaagagcagtaaataagtgaaatgtacatggcacatagtaggtgtgcaataaatgggagctgttttcattggaacagcccttccatggttagcccatttcatttttggtgatgataatgatgatgatattaataatatttgtctagtgcaaactatgtccaagacagtatcaagagtttcacatttgtcatcttgactaatcccttcagttcaagagattagtatcattatgattcctgttttatagaagaggaggccagaaacaaagttacttacttgcatacagtcgcaatagccataaacagcagagctgagattggaacagttctgtctggctcctgagccccgactcccaattgctccttcttctaaccacatccccatagagctcagactctattgcatcccttgctatctaagcactggataccaagggctcaatcagaatgctaactgggggcactgtgggaagctagggtgcaccacaaccctgtagacatgtcaagatgtggtgaattaatgcatgcaaaggaagagccccaaatgaggtggttagaaaggggtcctagtggaaagagaacagatctgggagaccatggcattgtcagatggacaagggaggggggacaatggctctaacaggagaagtaggttttggattatggtaaagtcacaaagtcaagaaaatcctcagggtcggcgggggttgactatagccttggaagttctggagctggcaattgtgaatatttggggtaattaacttgaatggtggctgtttctttttcctccaacctccctctcaccccagggaattcccactcttgtaaacacaatcatctattccagttggctccaaggtaagagtgcaattccaggctccacagaggctagcgtgcccgccctgagatgctgttcctgatgtggttcaggccttcctaacctcttattgtctccttctgtctctgcagtgatccgggccaaggtggtggggaagaagctggtaaaggaggggcccttcggcacgctggtctacaccatcaagcagatgaaggtaggtaatgtcatcaccctggctccgggaaggtttttgggtttttgccagaagagtcctggctaagggaggcaaagtgggttggaactggggtgtgtgtctaagcaccagccagacccagcccttctgcctgctggagagggagctgctaaggctgcataaagggatgggtagggagggggcatggggctgccttgtccaagagcccatgcaggtggagtcactccaaggcacttgttaggaagctgagctctggagccagatggcagatagccttgttagctcgtaaccatgagaccttggtcaagtcactgcccctctctgggctttaatcttcccaattgtgaaatgagggggttggactagatcatctctatgaactcttctgagctctgactatctgggactcaacagtgcttacaggtttcatgcagccactgaggttacagcttaggtttacagccctcaaatctttacatggaaactgtgctgatcacaggaacctcatcccaaggcaggaacttcaccttctttccctattttcccagctgattgtcttcttgcatcctagatagttagcaatgtttgctaagcatattcttatcattaaacatattactgaggatatgaacatcatgaagtacaggaaggaggtatgcccttaagaaaaagaacaccagatttgaaatctagagaacctgcctcctagtctcacctctactcctaaatagcctgcttaccttgggcttgtcccttttcctgggccgcagttttgccacctgttaacagtgtggggttgggcttggtgctcctaacatcctctctagctcaggcattctaagcaccctgggatgcgggccatgttacttgtaaggaggagcgggtggtatacaatggaagggtgtactggtgattgccttagcacagaagactggggcttcaccttgaataactcagcaactggttcatcaccccatctttgtaagcacctctctacatgcagagctcccagctaggagccagggaggccgtgagggagatacagtttccatctttaggaactagagtcaggttgggagagaagaggcaggtatgtgtgtgactcatcagaagttcaatgtggggtgtgctgaggtccacaggaactgtccagccctttaacttattgctcatatttgcatccctagcaattagggtaggacctggcatgcaaaagtgacttggtgaatgcttatctgtctaatacgggcatgagggtgagaccccacaggcctggaaactccccagaggagacaagccgcaatgtccaggtagaagggagtggaggagtgacgcagcccacggtggtacccaaccatccccaaggccaacctccaggctttcttattcctgtgtcctgaggctggatgtactaattttgtggaacctgttgctttggattcaattttgcaaacatccacagccttctggttatgtaatgtccagagtcagccctggccagttgcccttggctgcctaagcttggtcatgagaccagcttatgtcttcagacagccctggggagagaaaaatgggcaggggtggggaaccagcaagagcaacaacaacgcaaaaagcccactttgcaacctctggcagacagcgcgggaatgccaaagcatattagaccaaagcagaggttcagaaaacacacgaacctgcctggtctggaacaatcctcattacgagacactcggtggtcagcagagagctgagagggaaatagctgggaggcagcagttcctaagcctgcctggtttccttcctaccatcagggcctggagaccagggtgaccagaggcccttcctgtggacataatgtcccattcccccttgctggtgtcagaccagccacgggtggttgtttagagaccaaacaacacttgctagcctatcagcatcagacactcccactcccaggctggtgggcttagaagacacactcccactcccagactggtgggcttaggctttcggttcaccatccttcgcctgagctcatgaatcatggtgctgggaattagatgtaggatccctcgtcttacttctgacagaggcgcaaaggggaaatgacttactcagagtcaagcatttaactaagggcagatctgatccccaagctgaggcatcggaatttcttcccaatcctgtgttctttatatgactcccaaatctccctgccatcttaatcatcagtcaccatctcatgcctttcattcactctgaccctccatagagggtatcatgatccatagaactggtcagtgcccttctatccagagacaccactggaatctgcttgtctctaggtaccagcctgcaagtcagacaagatacaggctagaagtaatagtccgtccatccatcctctcgtgcttccttcccaccctctctctgtgcttagtactgtactatgaactggggatacaaagataacactgcttataattatgataagacttggcatcagttaacatttactgagcaattgcttagtgccaggcattctgctaggtctttgcatagatcagtacttatactaacactgtaaaatagataacaccttgtcctctgtttgacaggtgaggcaactgagacctgggaggtcatataactgttaagattatatggccacaaagtggcaaacctgagcaaaactacagggtctttgcctataaggagataatacagtatggagcagcaggctgattcatcattcctacccactttggggtatataaatgcccactccatatgtttttagttcccagggaacaaaaagaggtcagtttgggtttgttggtttatcatccagcagtgtagggctggacttgtaatatcctgcaaagggtgtatcagaaaaatctttgtaggagggaagagagagaggccagagaggcaagcctgcatgagttttggcactggtccctgggagactttgttctagcagattagacagtctaccctagagagtcagaaggggtgagcaagggcttccttagagcaggactaaaggaacttggagaacctgagactccgagccgccctgtctgacctctctcttctctcactgatggaaggcaggcagaccttctcccgtctgctaactctggagcctctgacccatctctcaggaacacttcagtacacagagacctgcgatatgtgtgtgtgtgtgagggagcagggtgttagaatgttgagagagcttattgcaatcccaaacttggaaattagctgggctgtggggtgaaggtgaaagtttccagaactggctgctctaagctgtggggaccttatctcccatcaggaccatgagaaaccgatccactgtgccaggagttattgtttatgtagcggagacatgctctccagctggctgcaggggacagaacgtgggggacattatgtcccagctggtcctgggagggtcccatggggagacccgctggtcatgtgctttgcatgtcctgactgtaggcagagcagacctccagggacttccttcctttagtggtttgtctaaccaaatgagcaatagcagggtctcgcctttgaagctctagctggaagcatctttgacccccagcccacagggaaccattcttcttgcaatgcccgtggttcttcctgccttaggactctcatccagccctctgcagagactggctccatttctacattctctgcctgtcctgctagacaaattgctgtatagagaaagatcatggccgtgatagctcggtcggtctgtaaataagaatttgtgggtttaaatgagtccgtgatgtacaccagcatccagaacagtgttgatctttggtaggcatgcaagacatagttggaatcattgaggcaactcatgctgtcaatgtagagtgaaggccagacatttcataagaaatatgcaaatgtccccagactcagaaacttcttttttactttatttgtcccttcactccaagggaagctaacatcttggaactttgtgtagatgctaccaagaagaagaagaggggcccagaggcatgcagaacccagctgaaaaagaacaacccacttatgtctgaagttctaaaccagctttaactactcttgttaagagctgaggaagggacttaggagaaaggggaccaaactcattcctcctctccttacgaatttcagtataacttgttctaagctaacttttattgaatgttgtgggctgactgctattctaagtcatttgcttctctcaaacaccctaagaagtgctttgacccattttacagatgaagaaactgagacccaaagaggttaagtaactttccaagtggcgaacacaggtggcagagaagattgaagattcaaactctggctgtcagcctccaaaacctgaatttaccactgatctccatggcattggtttggattagattacctttaacatcttttccaactctgagattctaggattctctgatgtcaggacattataaacctattataactctcctaaatttgtcaaaccaattctagatctctatgattacagacatgatacttttagaatcaatatttaaatcaaggtaggattattacacagaaaacacaactgagtagaatctacctttgccatgttgttcttttcagaattgaccctaaaacacagcgctatgtttgtcagagccagtcatttgtaatgtgtcagaatttcgactctaggcaagtgctaggagctaaaatgcaggttccttcaaacttccaagtagctgcggtgccaagctgatttcgatgagttgagttcttactgagcagttcaaatgaccagactgtaaccaggggcttcattctctcacccacgaagcactagggcagtcaaggggaaagactgacgcagaaggaatgaggttcccatgggctgggtccaaaagacctagagcgagtgcttagttgaaacatttgccaaaacctcaaggaacacccacacaaaaataagaagttgctcggcacagaagtcagggtaggggatgttcttcgaaggccacactccatggcaggcatacagcagcacgcttaaacatggttcctgttaaggctagagaggcaccattcacatagaagaagtcatcatcgtgactctacccaccccgcgcccccaccgcgtaattgaatgctgagtgtggacggcacttcttccagcacttggctgcgttaccgtgctcagttggcaagccttgggggagaagagaggttcagaaggaagaccatctgagtccatcagaacaatgtgtgcttttaacaaggcaggggcgcccaaactcagtaggtccaacagaccaagttatgctatgaaggtcttgtggaccacctacccccgccaaccagtcaccacttaaaagatgagaaaacgccagctcacaggccaaatgggaggcatttagaagagacaccaatgaagagatgtctggctttgtattaattactgtaagtaaattaataccaaatgccaggaagtaaagtagaggcattttcctattataaacccttgggacaagcccagagaccaccagcagtccagggcttgtgtacgctgagaactgaggggataacagaattgtgcaacaccttggtgccccaccgcccccgttaccaaatctcacagttcacagtatcgccttggcacactgggcttgtgtaatactcatggacttgacctggaatcacaaagcggactcagcttctgttacattcattcaccccagtgactctgggcacacactgtgcctctgaaggaggcacagtggccataaatggaaatagcatttgcctgcttctggggaccttggtcatagacttctgaggctttcctgggagccagtctaagataatgggtaagagtatggactctgaaggcagagtcctctgcttggaatcctagccctgccatttcccaactgtgtggccttaacaagctacttagcctgcctgtgactcaggctcctcatctataaaatgggcataatagttcctacctcatagggttgtcatggtgattcgtgggctaatattaaaggagatttctcaacctcagtaccattgacatttggggccggataattctttgttctgggggctgtcctgagtattatgggatgtttagcaacctccctaccctctacgaactgttgtgacaaccaaaattgtctccagacattgccacatgtcccaaatatttcctaggggggcaaaattgcctccagttgagaaccactgtattagattatgtcgtagatacaaatagccaaatatcagcaatttcacgtggttcaatctaacaattataaagtatttaacagttaaaactctttgaactttgtagatacatttatgtgcttcatctgggataaacgaacccaatgctttcaccagacgctcagaagaataaaaaacatggagaatttctagcttgaattcaacgttcaccagccaaatagaatttctataaagtggggtttgtaatacatccctcccagggctcttttaaggatactgcaaggagaatgtgagtgagaatgtttttgtgggctggaaagtgtcacagagatatcatgagaatgctggctgagttcacgggactcaggtcctaaggttgacaaagaaaaaggacctttgtcacagctacttctctggatttctgaaaaggtgctgggatgtcagacatgtgtagccgaaggagtgttgtggggcagttggaatggggggtatggctggctgcacaggaaggtttctctgggaaggcaccaacctggctagtcaagaggatcggtggcttcatctggggtgaagggggccctggggtgggtagatcagtgaccggccactggacagctgaataggggagcgagattccctcagatccaatgtcagcaagccttctgggtactgagactcctctcctgtgttcctcttattttattgatacataataaatggacatattttgagagtccatgtggtattttgatatattcaaaaatgtatagtaatcaaatcagggtaattgggatattcataaccttaaacatttatcgtttcttcatgctgggaacatctgaattatcctctactagctactttgagatatacaataagttattgtttactgtagtcattctactgattcaatgaacactgggtcttacttgttctgcgtactcgtatttttgtacccattaattatatctctttgccccaatccttattacctttcttgcctctggtaaccaccaatccactgtccatctttatgagatttactttcttagctcccacatgagtgagaacatggtgtatttgtctttctgtgcctggcttattccgcttagcaaaacgacctccagttccagctgcattgccacaaatgacaagatttcattcttttttctggatgaatcatattccattgggtatagataccaggttttgtctatccattcatctgttgatgggcacttaggttgatttcatatcttggctattgtgaatattgctgcagtcaacatgagagtgcagacccctcttccatattccgatttcctttcctttggatacatacccagcagtgggattagggatcatacgggtgtccaaactgggaaagaagaagtcatgatgttccttttgcccacagatgtaccgaggcttcaccaagatgccccatgtgcagtacatccacacggaagcttccgagagtctctgtggccttaagctggaggtcaacaagtaccagtacctgctgacaggtaatggccaactctagcttctaggccagggtttggccaaggtccactgtttcttgacttcagaagaacacatacggagtagttgactcaccaaatgtccagtaaattgtaaggagtctctaatgttgaattcatcccacttacccagtgctaggagcttgaggctcctacacttaggctggactttggaattagctccaccactcacctgggggaggaaatctcctaatttgtagcttctcaactttactgtaaataaaaagggagtatctgttcctctccacctcacactcgacctgttaggcccgtctttgaaagttattcatctttaggcagtcagtgtagtaaaggagaaaacaaaaacaaaaatcattataaagggagtgaagagttggcctctagtcctagctccagtatttaatgggcttgggacctttggcaaatcactttacctctccaagcctcattatcctcatctggaaaatggggctacagtccattttaaaaggtgttgggtagggtgaaataaaatcatgggtctgaaaagtacccagccacagtgcctgggctaagtgggaacatagtaggtgtgaattctctctgggctaggctctggacaaaacaacctctccttgttttcttctttcctcctgtaggtcgcgtctatgatggcaagatgtacacggggctgtgcaacttcgtggagaggtgggaccagctcaccctctcccagcgcaaggggctgaactatcggtatcacctgggttgtaactgcaaggtaagctctggggtcactgggggaaggaggggaggtgctgacttgcagccctagaaacatcagctcccaatgcactgggtgccaggccctcggctgggaagggtatgcatgtgttaggccagggcagaggggcaggtctgagcagatatagtaaggaatgttgccccaggtggggcagtgaggaaggcagggaaggaagaatgcctttctgctgtaatcggctgcctccatgatgaccacttggaagctgctggggcatgagggctcttgagtccctggccccacctggcagttcaaggctggaggtataggatcctgacactggcaggttctcccaagtggtttcaagtgggctcaccctggtagctgactcatcgctaaccccaccccaggtaggcaaatgggcccaggactgcagagaccagatgctacagaaggtctctctttaccaggcccatccccctgacccaagtatagggccaaggtgcagcctgcctgctgtgggaggaagttgggccattctctcacttcatcttcaaaacagtcctgtgtggttttaattactatgatctccattctgcagatgagagctcagagaacttaagtaactagccctaggtcccacagttcactgaatctggtttccaacctagggcagctagactccaaagtttatgctctaacctttctaattcctcgattccctaaaacaactgagatctcccacctgagacgaaaaagtcctctcagtagtctaattctgctacttactggctgtgtgacctgcagcaagttacttaacctctcagagcctcctaaaactgtgataagaattaaagagaataatatcaaagcacttatcagaatgtctgttagacagcagatgctcaagctagtgctatttatattatgatcactgagggactgatgtggctaggcttcccatgcagtggccccagggtctgaatccaggctcggtagcctcaggcctgggcataccatggcagagtccatcaactgctgcctgttatctaattgcagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacacatctgctgtctcttgccttgttgtgttctgacgccacggggagttatgtatacaccagcaggccttgaaagtctgtccccagctccaggcctggacacatccctccctccatgcaccgctatggcctggccccaccctgctccagtccttttcccttgcagaaggaatcttaggagaggtgccctgccttgactttgctccctgattctattgctagagtcctccctagttctgctgaatctggatgtattaatatatctgtacctaatcacctattggtggtacaagtacccccagactggagtccttactcagccctccttgttttcttcctaagaatcccaacctggtggaggtggggaggggcggcctgcaaacagcagtccttgatgtcaactgcctgcttgaaattccaagtatggcttggcctagttgggaacaccaggaactcatgaggtctcacgacagctggtgaccttttcccagagcttataacaacctcctttcagagtatacagcagggcctctcactgtcaatgggctgggctggctgcagacccctcgcctgactttcatcccaccattgacaacgttctaggttttcacccttgttttaaagctactcctactatatgccaggtacagcactttatatacaggatctcatgaaatcctgactactcgatgaggttgctccacaatcatccacggtttttacctgaagaagttggggctcacagagataaagtcattttcctgagacctagtgtgtagacagaactggcattcaaattcaggctagtttgataatgaactctgaattttccccactgtaaggatgcatacagtaagaaaaatccagggtttggggatatgctgggtttcacatgtgcccttcttatctcaaccagcatgttctggattctgtgactcttgcccgatcagatacaggggaaagatcatcaatagaaattctgcttggttagagtgattactcctgaaatctgcagtcctacccatcagtatctccaaacaggactgtctagcccagaagcctgagcttggactctacaaacagccacagtaagtccccacctgggactatggtatactctattcattattctgttcccaaagacgcattccctgcaaggccaagcgcagggtcacagccttgaattcctttgaccagtttacgaagaccatcaactatgcaagcaggcatgttgcaggctctttcctgctgcttagagctcctccccccaacactttctggcttcaggtggagaacccttcacctcattcagaaagacattcacctcttccacccaggtatcctccaaatgggaggctgtaccacatatcctgagctaagccctgcttcccagaggagatctcaggtgcattcagaaattggaaagtgaagaggacatgtaaggaaactgcccttcaacaaccaatgcaaatcaaatattaatattactgctttttattaaaatatgagttgaaatcaggttccacaaaaggctcaagtaaaacaacatcccaccttgaaaacatcttttacctttataatcagcctctggttctaacatgcccccagaacgtgtcccctgatttgctgaaaatctccaagttccaaggaatgtggttcacctttgttatttgccctattgcctgaatttcacctggagagacgacttcccttaggaaatccaggcactcccacaggacactgtgactccgccttagagtctgcgtggtcagtgtacaacccctagagtccacctcctccatccaaagagaccgaggacaagtcatctgtattcattccgcatcatgcaaagaaacagagtaaaaaagggcactcaccattggcttatggttggggaaaaatgtttgctccacaagcgggaacttctcaggacccagggaatggaagatcttaatgagctgagagaactaggatagaagaggagagaacattgatcaactatt

SEQ ID NO: 11804 - DNA, 67479 bp, Human
  misc_feature (1)...(67479): n = A,T,C or G
ccagtagctctgacactcctcagctgtagaaaccttgacaactctgcacatcagttgtacaatggaacggtattttttactcttcatgtctgaaaaggctatgataaagatcaagtaagatattccaaagaatttttaaattataaagcagtttacacatgtgaattacaagtacctctcctccaacaaaggctgtgaaaaaagactaactctcagttactacggaatacttagtacgcatcttccaccatcttttgataaggtttatttgcaagatgtcaggccagtcaagcaccacaaaagtgacttctgagtgttcaacctctttcagaggctcatgggacttgcagagaatgtcccaaggtattggtggttggaaatttcctcttatgcttttcttcccacaagaatcaccgctagctttcccacgatgctttgggcaaggggatcctttcctattactttcattacaggtagagaatccatccatcagactggcaggacctctaaaggggcacttcatctgtttctcagaataaatggtccattcccaagttcaatcaaacgctatgcctctcttctgtcttttgtttaagtcttcccagaaagttgccatgatacctccataatgaactgttgcagtgcttaacaaacttcactgttggaaggttcttccttctatttaatctcagtctatttcttttaaccctattattgagttgtgaggggctggttatgatgtagtccagcatagctgtctcagaaatggttcagagaccattgcaccagcagatttgctgggctctagcactagtccttcattgattagctgagtcatgttgggcatatcacttaaactttctatgcctcaatttcccaccctttcaccttgtccctctgagccatggtttcctcctctgtaagaggcgaatagcaatatcttccctggctaaaggaggtcatcgactgctggatgattttgtgagcatttctattccagaagattatgttgtaattactatttatttatacattctcccactgcacagtgagttctaagaagagggaaccccatctttttcacctgtcctctagcagatagagcggtgcctatcacacagtcaagggaagcagagaataactttaagccaaaatttcctgtggtgagttttccgcagccatccacaattccaggtctcaggaggtagtctttatcttttcccctcacgccgatgccacggggcggggggggaaggcggaactcgggaccagggaccagggaagctgagactcagctcccttgggtgagattcgcgacaggccgggaacgtggtcagccgcggtcgctgccaaggtgatatcgggtgggagcaatgacgcaactccggtttccacttcggccccccgggatattttaccctaatctgtgggatcaggctgagcttcctggcgttctgcagcagtaacaggttggcgagcggagcccgggatttcccattcgtgcggagctagccgccggtgccagtcggcaggcgccccccagcgtcccgcggacgacgaagtcctggcctggtcagcccaggtgggggtgacgcacctggctcaggcgtccgcagcaggctgggtagaaccacggcaggaagggtggggggctgcatccccgattaacacaggctgaagcgggtatccgcacctataatcatcgacaactctgtcccacagagggcagaagcgtgccttgccctatggacgacggtcgatgaaaatttcacgagttagagtatctaaggctacagcgtggcctatagggtggttgattccaagtcaagatggttgcagcgccaacggagctcctggcaagagaggactggacctgtgggcggggcggaggggcggggcggggccggggcggggcctgaccgagaggcggggccaggtgctgggctgtctctgcttgtcaaaaggcggcagcgnnnnnnnnnnnnnnnnnnnnnnnnnnncttgtccacccgccggccggtaccaggtgcgaacccgggtagcagcgggaaagggggtctcaggatagggactcggggtcggggcgtctgggataccggggcctgagcgcccggctgcgagcattagagtctaagtctcagcggtaaacttggctactgaggtccgggctgtcgtgccatgaggctgggacactaaggggcactgaggtttgagaaagctgaagttcgtgccaggctggcgaggggagcagcgacatcctcggcgcttaggagaaatgctccgctaacacagtgcttagcacttgggcaacaagaagtatttgtttccttcttctgtcggggcgccttggcatggagtggaggaataagaaaaggagcgattggctgtcgatggtgctcagaactgctggagtggagggtgtgtaaccttatttattgtcttacagggcccaggtatggtcacctgtgatggtggagttgggtcttttaagtaatttttttttttttttttttttttttacttttctttgaactaccaatgagtttagacctaattggccctattttttttcaggacagcctgtcaatagatgttcagaggaactcaggggcaagcatttaaatgaggaaggggctcaaggagtagtttctgtttgaaaagtgaggtgccctggatctgtgggtggtggtgaggaagattcagaagtatctaggagggaacagcctgtggtctccagggccagtgtacaactgcccctccttctcttcacccagggaccagagtctgagacctagcctgggctgggggagccttaggtctccaagcccagacccttctcacagttcctcctccttctcctcctcctcctcctcctcctcctcttgttcctcctcctcctctatgcgtgcggtgagtgagtcagcctcctgtctgggctcagttgcagccaaaggggccagagcccaggcaagcagttgggcaggcattttctgagcattgcagaagctctcctgggcagagttcagctctgctccagctccctgctggaaggtggtcttcctcatgggcaggggctcagatacccaacacagcagtgcttatggaatggctatgagatgattctagcaggaggtgaccgtgaagggatagtggctttatgataaatctacatctcatctttctcctgggataaggaggtgcatcccagcactgcaggcttttccagcccttccttccatttctgcctagtggtctcattagcagcccatctctgctagtgaagggggtgagcaaaagaaattaggaaagtctggggccagagaagtcatggtgttggcaaagaaggctttaactcaggctagggagtgagggtgatttgctgaggtagaaatgggttatctgaacattggagcctcaattctatggactaagagtgttgtgtgttgagagacctgccgtcccttccctgtccaagtgctggagggaactgtgagtctttctgaaacagtctcagggctggcatgcagccagaccagaaggtagtaagactgcacatttctccctggcttttgttttgggtgctagagatcgttgaacagaagtagccctccctgcagagtccgtggcccccactcagcagcctctctggacctatttgagaagagtcctgggaggccaatccagctgtggggctgactcaaactgcaaaaagctggggaattcacagtctatgctctggctgggtcccatggctttgggtttggctggtcttgatcagctgtgacttggacccttaccaagctaaaggagggactagaaaatggggtaagaaaggaggggaaaaaatgagagttagaaagccttcccaaccctttactcctcttcggcagaggccatcagactttgtttgtataaacattatggaaggtcgggtgctgtttggggtgccctgatagtttgtgtttatggtttctcagtattcttcccctatttgacctcaaaactgatctcttttgtaactaagccccagaggaagctccgagaggacctcctgaacccctacactctacccccagaacagatagcaggtgtccaaagcccaggctgtgaatggagaaaggcctgggaccgagtgggctacatcaggtggctactacatcaggtggttatctaagacacgaaagggagttcccattgtttcattccttaccccacatcctaaggaggcaccgctgtcctggctggaataggcatctggaacctctgctagaaactcgctgttgcctgtgcagcagtcaggtcctaggggccagagagccagagacgggaggaccacctagatgacatttggtgtgttgctgaataaagaattacagggctccagcttccatttgtccctgctgcaattctgttttggatgcaggtagagggaaataaggaattgaccagatttgattaagagcctcttgtgtgcccagcatgactccaggccctctgagagatagcaggaagcagaacccaccagaccaggcccctgactccaagacagtttgagccccagggtgggcagcagttctcaggctctccctccactattgtccagttctgagaggatccagctgggctgaagccagcctggctgccactctgggccaccaaggccttgcttgtcattttgcttccctctgatttgtccctaaccttttcctgtgtcagtgccctcctagatatgctagaaagagtgcctgtgtaatgtatcttgcaaactgggatacttctgagagtgaaaggggatgccatgcgtggttataccaggacaatggacataaacccaaactttccagggaaaaatggaatattaatcaccctagtgatcatcactccaaactcagcagaggtcacagcagtgatgaggggatgataaggttgggggaggcttaatgctcaagggaaaacaggggtagcttaattctgaggacagcccccgacaccctagcctgctccctggtgttatcagccaattctcgtcttttccctggggcggcactgctcccggccaccctgtcctgggacccagcccaccactcgtgtgacttcccttcacccttgacttgtgactggcctcacctttggttttcctgccccaccccaacctcagacagggacaggaaggtctgccaactcctcttcagcttcccctggggaaattggggttcatagtggagccaagactgggcctcacgtttcctcttccctcttcctccatatctacagcctcctcattttgctcatccagcttcccagacctctggggaccacactatcccacagaaagtctggctgtaaagcaggtaagcagccaggaaggcaagggtaggcaaacctcgcccactctgataaaggacataggtcacctataatcaggttccggggaaatgaaaagcaaagtggaggccaaagccagggagaagctgcattgcaggagacagagtcagttcccaaagacactagagtttgcctctttggtctggtctgactattggggaaatggtccagggtggggagaggctgttcttgctcaatccaagtgacaggcgttgatggcagtgcctgcatcccgctgtggcgacatgtggaagagaaactgtcctgccttctgggtcctgggtcctcatggtccagatgcaaagggtgggatccccagaggtccagcctgtgggtgatcgggcataggcgtggagggagcagagccgccacgatgaccatgtagtgactctcagttactctgccaggaaggaagtcattctcactgccaacaaatgaaaagtgcaagtgaagatctcttgggaagtcatgtctttgaagtgacttgtgggcaaggggggtaggtggtgagaccgccccaccccaaggctggctgggagaggatgggggtgtctggttggtgaatagcaggagtggaaggcagaagcagtcagtactctgtgagttggaatgtgtgtcatgcttttgcaaacctgccctgcaggtcctgtgccagggaatagactaagtggtgttcccagaaccagatgccatacaaagtcctcattctgcacaggggagagtcctggtcctaagcagggtgtgggcagctgcaccagcgggaaagcggagtctgtgcagactcggcagttggttcctgagaagctgctgcctctcactggccttctgatgacaacctggagcttggaggtgttatgcaaggtgggacattccaggcactgtggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctactatgtgctgattgtcccattggccaatggggagctattctcactttgcctaccttttccctctcctggctatcccttaagggctcctgaacctagcccagctggacggagaaatggactctagcctcctctgatagcctcatgccaggccccgtgcacattgctttgcttgcctccctcaatcctcatagcttctctttggggtaagtacagttatgttctctagcaggcatagtggggaaaccaaggtctaaagagatgcagccacctgcccaaggctgcagagtcagcctgtaaccactgctttacacggcttgccagccctgggcctggccatacaaaccgctttgtcagagcctggagacagaggtcgcaggaagagaaaatgctcagcctgccccaccccctgtgggtctcagggttccttggtagatgactaaaattttaggtagtgctgttagaagctagtggcctggcagaacaggagaaacacagggtctgagttagactcttgggttcaaatcttggcgaggtcgctttgtagcttgtgaccttgggcaagttatttaatctgtccaaatctcagtgtccttacctgtaaactgggtatagtaatagctcccttgtaggactgtgtgaggattagatgatgtaagtcaagtgcctggcacacagtaggcccttgaaaggcatgtgtattcagtagatatgggccaagagcctacggtgtgccaggtactagtcaagacactgggaatttaacagtggggaaaaaagagactctttcacttcttttcaaaatttctagcccagaagcctgtccttgtgagaggcccgtttagaactcaggaatggctgtcctggcacctgactaaactcagatttggcaaattggtttctctgtcatttgttagctgatgagcttgtgaaggttacttagcttctctgcaacttgggttcttcaattcttttttgttcatttttgaaaaccgcgatatatcacatacacaagattatatgtttatgtatagattaaagaatcctataccctgtacctaccacctaagttaagagtggagcattcacagcaccttaaaagccccctctgcctctccccatttgcattccccttccttactccccaccccaaagtgaattttggttaattgtttccttgcttttctttgtaagttatcatctatgtagattttacaaaacactatgttgtttcatttcacatggctttgaagttcgcatacctgtgtgttctctgtgatgcactcttctttgagtcaatatgagttttctgaggttcatccatgtcgatgcacaccactgcagttcatgagtttgcactgctgtgtagaattccattggaaaaatacaccacgatttgtatatcctcctctcactgatggacatttgggttgtttccagttgagctattacgataggacagtactgctaggggtgtacatgttatacttgtcttctggttcatgagaaactcacaagaatttctgtagggcacatacctagggttggaattgctgcctcccatggaattctatgttcagcattgctatagggtgccaaacagctttccaaagtggttgtcccaaaaaacacttccagcagtggatgaaagtctccattgttctccatccttttcaacacttgatacaggcttcatttctaaaatgaaaaagttgcattagatgagtttctacagttataatgattagctataatagttgtattattcatgacctagggacccaatttctggctcatgtgtgtgcctgtctgctgcactctgtacaggtgaccacatacatgtcacagcctgagacatgtctcagagagagctctgtgctgggcctctaagtacagttgaagcccttcctctctgggcttccaccagcagtgcttgagggatcccacggttctacatcctcccaaacacttggtggtctcctcagttcaaccaagagcctggtgtcagcagtgagcccatactatgtgctcaattaatacctggggaggaatatatattttccttgggcatcagttttgagaaaaggacatggaagtataagaaccatgagtttgctggctaatcaaagcacacagggctggggcagtgatggattcatgtctgtcctgggcttcttgatcatttaagggctccagtgagatggggtgaagtttagtagtctctactggccatctcttcagagtctggccttgttctttggccttttgacttgtttaacctgagaagcaaggggtagctggaggattggagtggagggaacagaggcgatgccatggggaaaggagccaaatgcctgtagagaatccctttccctttgaaggtcgaataccctgctaggactactggggaaaagaggtgttaactacactcaccatcctggtagccacataaacagccagatattcaccacccatccacccatgggacaaaggaatgtggctggctggacagttgcatgggccacctcagctctcaactttgtaattacctatccagtctgtgcctgtcagctccgggcaggcaggtgcttctgccctgggcctcactttggctcccaggcctgtgctgggatcagggacagggctctaccttctccagccatcccctcaccccaattccacccagtgtctctttctataccaacctttgacccttgtgaggttaccatattatgtaatagctgacaatcataataaccaatggttactataactcactatgttccaggtactatgttcagtgcttttcatgcattttctcatttatgcctctcaataatcctacgaggctggtaaaattatacccattttatagaagaggaaaccaaggttcatagagattaagaggctaaattccttgcccaaagacattgagctactaaatcagaaccagaatttaaattcaggcttaagtccagagtgcatgttctcttcctcacttgtgcattgcctttcctgcagtgtcctggtcattcagctcagtcttccctcctccccttcctgtctaggagggctggaaaaaacgcagcaggtggtacgagggtgaatggggcagttccaatctggccagggagatgctggaaaacaccttcggggcagagttctttgttccaaacggctctgaatttccggacttctgccaggggcaggaagtgacttctgcccagcctctttggcaagcacacccatatcttgggtgccatgatgttaagaagtgggggaggggctgcctcaggtaaaattccattataatgaactccatttgaggtctgaccggctttgttgaaaccacgtgcacagcctgggaaactggaaatggagtggaactaattcgaggttgggtgtcttttagcaaagccccccgaaggtttggagcctagaaggagaaggagaaaagagtcagacccacccccaggtcctcctgaatgccaagctcctgcgtggtcctgggcagggcttgtggggagagctctgtgcgtaactccacctgtcagtgctgtcatcgtccattccccccactctactccgagccccgagaacagatctgaatcctgtctctgaagtgcccctgctccacacaataactaacatgtcacagatatactcactagatggttttgtctgtagaccaggtgcctgagcaagaaaggagggttgaagggcaattgctttgtgtcattaaatcatcttcaaaaactgggctgcaactcagatgaattctccttagtcattgcagtaattgtgcgcaataataagcactaacgtttactgagcaggtactacgtgccaggcactatgctgagcacttgacgtgattatctcatggactcctcacagactatgcagtaggtggtgttatttttctcatttcacaggtgaggaagcagaagcttagagagtgcatttcattggttcttgttgcacagctagtggtagggagaattcagggttgggcacacccaggccagctgcctccagagcctgcacttctaaccgtgagctctgctgtcagtgtgtgctggtcagggggccagggccaggtgggtcatgagtgaggctggagggatgcagacccggtgagatggactggagagcacacgctggttgatgggagcagcccctctcggcccagcaggcttccggcaggagcttcagcctggtgtggccagattatctgactttttcatagaaagctggacattcagattttttttcaaaaatgtaaactcttgatttctaaaacattgacagccaatttaaaaaaaatgaaatgtgtaatcactgttggtgttggggaaggacgggtggcaaacagcaaacatcacagtcaggtctgccctgcaggctccactgcatcctctggtagtttttttttaacaggtaactgttatagagtgggataggaaaaaccctgttcctgtagaattccttactaacgtactagaaggtacccctcccagaatgtgataatagctttataatacagagtgtttcttccttgtgagttagaaagaaagctttcagagtaagatattccaagaatacattcccctcctttcctttctcccctcctccttctctccctcccatactctgtcttctcaggaaggtatttcctcataggtattagaagaaaagttgtgtgagaaaaatcaaaaggaaactaacagaggatagggtcttaaggcacaaaaaaaaggagaaagtttggggatgggcttggtagacaacgaatgaatggatcatgctccatgcaatcgttcaaggtgttttttcacagccttcccctttttacctgaatttattcctcctcctctcctattcttaaatgcctggaaaaataatagtaatgcaatagctagtatttttatagagtgtaattttagagtgtaacaatttttataacacatttgaaatatttatctcagctgacacaacagtcttatagaatctccttttggaggcttggtaaagtcgcagtgttttctccttcttccttgcattctgtaagagttgtagccacggaggatggaaactcctggctcccgcgggccttccctgtcctgccgccctcatgccccatgtggatccacaggtggaggcaggtgtggcaggcagttagtctgagtccttgactagggtcccacctctataaaatctggtgccagcaagagtaagggagtggacatgggaagggccctaaatggatagtgaccccagttagtggcccaaggccagcctcccccgccccaccctgcctgtcactctgagctattgttccaaaagctgggcagaaaataactcactgggggaattattttcatctctgttaaacttcaatcctgggctactgaccagcctagctgcagaattatttttcaggtcagggggagttctggaaaaagtaagggcaggggagtgaagggaagcaggaggcatctcacccaggggcggagacggaccaccgctgctgacatcctccctaggatgctacctgtctgcagcccacctggcagcaattccagctgaacaagtggggcccagcccagtcagaggaaatggggtttcacccacaagtcttttaattgaatctaggttctgagctagtccatcagattccttcttgagggatgtttgcctctgccagaaagagtattgagtgcagagagtggaacttctgccagctggttcagacatccggtgggcagcaggcctggctcagggcagctggggggctgcagacagctaaccaccaggagggaaagaagttgctcctctagggaccctgagtttagctcctcctctgtcctggggcagcatttatggaaagtaccctgtggtttaaatctgttctgtctttgccccctggctaccaaagaaaaacaaagaagagggagatgacaaatgggtagggctggggaaggggaatcatagcttggtgagggttcaaggcttagaacagagacagctgtttcctaccactttgtggccctggggaagaaaactccagacagattctgatatttggcctgaaacgttgaaccaagagggttatcttcaattatagctctgagggtaaggcaaggcttgtgtcatgttggccagcagtgagtttggacagccagactcaggatatggactggcatgtgcctatctgcatgtgaggtgctccacacacgtctgtggtgagtgttgtttgtgagcatcgtgtattttgcctgatgcccttccttagacaattcctggcaatgagcaagtgaccttgttgaccagaacagagtaggctgagtgggctgagtggactggtggaggcaggtttggggatcctgcggctgtgggcaactcacctctctctgcgcccatcaaccatatctgaccaccctggacagactgaggaattaagtaaggattgcactggtgatatggcagctgagttgttcactaacctcccttccatctgcccttattgaatcatttgttctttcttttgattttctcccacaaaaccttttttttttctattcagctaggctgaatttttcaggtctctcctttaattctctcttctagctcgactactgatggtcctattcttctcagggttaaggatctccctgaaggactgtgggggacagtggctttgtgtgtacccaggctgggacttcagctgtgctgcagaagaggcctgtgcatagctaacgtctcaatgaaacaatgagagaggccctgttgtcacaacactcaaggtggattcaggttggaatggggatctgaatggggtctgaaactcttcagtttcaataaatcgtggcaataattaaaaattcctgatattcaagactcactgggtttaacttgaagaagcagagaaaagagtggaatgtacttcctacaggcctttgacatgagtgtggccagttattacgtctcttcctggcaccctctccctctctccagccacattgaatgagtttctctgtcccaaacatgttctttccctttcgctctcagcttttgcatgtgcagtatcctctgcctggagtgctccttacgcctcttaccacaccacattaaactcctctgctccttcctgtctccgtggagaggttgagaggggacagcctccaaagagccttctcttctcttttctcaccaagatgaggcagaggctcttgcatatgctccctctagacctggcacttacctggatcgtaggatgtgtcgtactgaattggaggttcctggtttgtcccccatccccaccccccaacccgcggtagactgtaagctcctagaggacagggtctatgtcttgctcaccactgtgtctctcacttccagtacaggcctttccatgtggctggcacttaaacataggcagggaccctatcagagataaggcagcagaggccagagtcaatgtccaccacagtgtgaggccaagaagaaatgccgccacatcctatccctggccctccaggggtgtcctgaagagggaccctacccagaaggatggccagaagcctgaccaaacagctctggaaaagcttgttagggggaagtcattctaatcagaaatggaggagcagccgatgtcaccttggggtgactgctgctgcccttgaaagtgagtgggaacttcctacgtggcccaggtcctgagaagctgcatgaacacagtacaggggaagtgtccaccctcactaataacctagaagatggagacggtacgtttgggcaaatcagccgtgtatgggaccggagctgcctggtggagagttagcccagccctgcccatctcagaggaccctggggatccttccctgattctgacacaggcttcagaatctatcccaggataagtgaatggccttcccaggccttcaagagctggggcagccagaagtccaggcccactgagccagagcccaccccatgtctaggtgaaggggcatggcagggccattcttctgccagggcttccacggttctcgctgccacctcctgactccagcccctcggcacccacctcagccttctcctgagttctgctttctgcttcaggtggtggtgggtgggggtgggtggtggtggttgcccgctgccctggtaacagacagaggggcatcggcatcctggaggtagtcaagcttcaggtcccactagagtgagaacagatgcaggtacaggatcagcacttgatgatgggggaggtgggggatggaggtgacactggatgagaagggacaggaaggatgatggctgtaagggtggtaatcagtgacaacttgggagccacaggctttatgttttacgtggaggaaaagtccagatttgtagctcagcttctctgattgttaggagagagattagaacaactcatttctcctcaccccaagaagttttgaaagagttttagaagccacagacagtgggtggggtggtcagttttttttcccagctcagcaaaattgtggctttctgggcaacgtttgtttggggtggagcttttgggactgagaagcaggcatcctgcccttcacagcacctctctcgggcctgaagttcttctcattttcctggattctccattgattatactaaagccaggtacagttataataataatagttaacacataaagcttatggtgtgccaggcacccttctgagggctactcagagatcagctcgtttgatccccacacaagaactgagactcaggtattatcatgtccctgtttgtagataaggagacaggaatgggctctgggggcatctgaacagtggtcaggtggccaggggcatcaggctggcccaggtagctggacaaaggcaaggggtctgatcccaaggatcccaaatatctcagagctggtaggacctggggtttgaatactgacctttgacacaatgcggaagagtctacgtgactcagagatcacgttggtcccagaaggaaaataaggaaaataagcctggccaccctggataggggtaggttgttgggcctcaaagaggtttgcctgagcaagagtggctcaggcctgggcaggccactgtccccaggagcaccctccctgcccatcgcgtccctctgcccctccctcctgcacatgtcacactgaccacatctgtagacatcttgagttgtagctgcagatggggaccagtggctcccattttcattttagccattttgtctcctgcacccactcccttcatacaatctagtcagaatagcacttctagggcacacgttctcagtccaagctgtgggaaagctccccttatccaagagagtttaaaggtagtgacttgggtttttgcgagtgttttgtttagtaaggacttgtggggaggaaccgtgctaagccataaccaatgaggagaagcaagacagcctgtctgcccccaggagccagtcctctgctcttctgcagtcaggccactgccttggggctctagtcattccagtggaagatgaatgtaacctgcctggtgacgtgacaaccgtttcctccctgaccccagaggagctggctctagaaggttgggatcaatcctgaatttagtttatgtgttagatttatatatatatatatatataaaatatatattacatacataatatatataaaatacatattacatatatgtaaaatacaaaacaataacctttctggggtttctcgtggcagttgaaatagtccctcatgtggtcgtcagaaaataagccattcctcatactaatatgggataagctccttgacctctgaggagcaggagtgcttcctgctgtgtgttttagaatccctccccgccttgtttcgtggcagtgaaatgcctcttggtcctgtccaaatgtgtctttcactgattttttgaatcatgttctagttgcttggtcctgccacatgggtccagtgttcatttgagcataactgtactaaatcctttttccagatcagtataataaaggagtgatgtgcaattaaaaaaaaaacaaaaaacagtggctcaggcctatgtggactcaggctgcgggtcccagcgttaagacagatgcttagcctggagggaggcacacaggcacactggaagctgggcttgggagtggcttggaagcagctttctcccgctgtcttgagctgcttttttgtttttgtttttgttttcagagaaaatcccatttagccatcagctgcactaacactagcagtagtttgggtctccccaaagaagggctggacctactctctccctttggggatgccccagtttctatttcttggtctccaagtcactgaacaaatagcctccttgtctcatcaacttttccctgtagcagatatccttgggaagtacccccatgctagtgtcccaggaagacccacctggagtagagaaagctcaggccaggcgtatcccactttcctctaaagtactccctgtcttgagttcttgttcatgtctttggccacgggagctgaagccaggagctggagttagtcgggcaggagcatgtgggtgatcctagcaacatttttgtttctctgtgttgattgtaagaatgtagtcaatgctgggaggacctgctgcagtctgcatcaggcctcctacagggaactctcagccccaaagggagagtacacaccagcttccatggcccattcctaccccacaccacatcctcgccctgaagctgctcaggcaggcgattgggggtactggactcggccaggctggaggtgagaaagtatacttccttactgtgtggccttggatatgtcacttcctctctgattacctcagaggagactgagaagagactgaggccatcagagaggaagtgacatgtccaaggccacgcagtaagggagtatacttctcctctcttgtttttattgactttcttagaattttttctttttatttgtagttgacacataataattgtacatacggaatacagagtgatatttcaatatgggtacacaatgtgcagtgatcaaatcagggcaattcgcttatgtattgccccaaacatttatcatttctttgtgttgtgaacattcaaaatcttctttcctagcttttggggaatagaaggtaaattatagttaaccagagtcaccctgcagtgttgcagaaaaccagaatccattcttcctgtccagctttaatttggtatttgttaaccaacctctccccatcttcccctccctgctacccatcccagcctctaaatacccatggttctactttcacggcctccgtttcttcagttgtaaaaccagagagattgaactgcagcttctaaatgggccagtcccctatgcgtcaccggccactctccagcagtgacaggcatagcctgcctgttacctggagagcagtaatcagcccagaaatcttgttgacaaagctaagggcagagtttccattggaaaaaagcagcttgcaggaaaaattgttgataagaagtggaaatctatctaagtaagccatatatctcctgctccactgcctgaggcctcatgggctccccactctgagtcctgccacgctccaagaagctgctggagttccccagagtagccttggtgaatgagagtatgtagcctggtttccatggagtgacccactagccctgtgatatggtttggctgcgtccccaccgaatctcaacttgaattgtatccctcagaattcccacgtgttgtgggagggacccagggggaggtaattgaatcatgggggccagtttttcccatgctattctcatgatagtgaataagccttatgagattctgatgggtttagcaggggtttccacttttgcttcttccgtatttttccgttgccactgccatgtaagaagtacctttcaccttccgccatgatactgaggcctgcccagccatgtggaattgtaattccagttaaacctctttctcttcccagtctcaggtatgtctttatcagcatcgtgaaaacagactaatacaccctgatactgcagggggtgtcagtccatggcttttagcaggttctcaaaggtgatgcatagtcccaaaagggttaatgaagaacaagcttcaggggtaaactccttcctacaactactgtgtcatcagccactgaatttcccatcgttcagtcagtcataactggtgagcctcttaaatgttcttagaggttcttagagctgcgttgctggggcccagcctcctctggaaagagccaagtggcagacagaggaggtggcagccctgctgggagcacacccagcactcacactgctccatgggccctttccatagaacagacactgttctctccaggtgcaggccacaaaggtggacgctgtctgtgctaccaccttactcactcttcttgtggggatcatgatcaaacctgggaatttgatggagtctaaatcaaaattaagtgtaacccaggctatcttctgctgcttctcccctgcaacttcactcacaacataagcattatagagtgttctatttttataattttctgactgatggaagtgaagtgtcttagggcttagtgtcttagaaaagtctaagagtcttagaaaaagggatccttttcctttttaatttttcttttcttctcctttgttttttttttttttttttttgagacggagttttactcttgtcgcccaggctggagtacaacggtgcgatctctgctcactgcaacctctgcctccctggttcaagagattctcccgcctcagcctcctgagtagctgggattacaggcacccgccaccaaagccggctaatttttgtattttttcttttttttagtagagacagggtttcgccatgttagccaggctagtctcgaactcctgacctcaagtgatccacccactttggcctcccgaagtgctgggattacaggcatgagccaccgcgcccggccagggctcctttttctaatgtgcatatggtaccatatggtggccccctaagccctcctctagagctcctgtgcgaatggcctagtagctttgtctaacatggctacaaagagctatctaggaggagccattgaaagctatggggtgctgttccatctgtgcatgatacagagctttctaagcatagagccatccaaagagagtggattgccgtgggaggtggttctccactaggaaaattattcaagcatgggctagaaaactgtttggctagaatatcatagaagaaatttaagatgattggactaggtggtgctgttgccttccaatcttgagattttcagagctgaatgttatctattgggttttactgtggacattgtggtctgtagaaaataatttccaatcgttcttacacatatttaaaagatgtgtgtatgaaggagctggggagacagtcggggcaggaagtagtttggatatgttctatttatacagtaaaccctctccactccccattattatcactctgttctctgtcagcttcttctgggaggtactgagactgttctggacaaagaaaatggatacatggtggggatggtggagaagaaagagagggtatcaccttagctggccatgatattgttatgcctgagttatgcaccagaataaagagatgacaaaaagttaggtaggtcatgcagtgcttagcactcgatggggcagagtttaatggatgatgaaacgaaaaatagcaagacaagggtgtgtacgcacaagtacatgtgcggttgtggctggcggacacacaggcatatcttctcctggaaaagcccaacacttggttgactctgtgtgtggcaattttaggaagaagaagaattgtctcccactctgtggggaaatagcttagctttccatttctttctagaaggagtaggaactttggaacaatgtcaacaattagaaagcccagtttagatcactccagtcccaacctggcagagagaggacccctctcctggggtcgattaggggccacatcttttgtgcccttcctgctcattggcatctgaggatgagtgagtctcactcactgaggcatgaatgttgtggttcatctggctaatgagggatcagggagaaagcttcatctcatttaaggtcttctttcctggcgtggctcacacctgtaaccccagctacttgagaagctgaggtggaagattgcttgagcccaggaattagaggctgcagtgagctgtgattgtgcaactgcactctagcctgggtaacagaggagaccttgtctcttaaaaagaaaaaaaaatagtgcttctcatgatgggaattccagtcttggagttgcatgctctcagagctagaaaagacattagcggtcagacttcttgtccactccatggtccttctcagagtcacagctttaccacccttaggagggtccagtcaatgtggagttaaactgagccatgagggactttgatttttgtcctcccagggctctgcccaggacacctggcaattgccaccctgcaagactgccgtaggcgagatggccccggggatgcccatttaacagaagctgccgcaagatggggccgcctgtggtgtgggctgacaggcagacgtgtaggagaggcaatggttgtggcttcagtgactggaaggaaacgtgttatcttctcatttcttgctaaggcaaggtcagcactggggtcagggtcaggcagggtttttgatgtgggatgcaggccctggagggatggaagccaggggctttctacagagttgagctcctccccctctgcttctctgaagcttagtgctgggggtttggtatttctaaagcagggtcaggagagggttgctctggggacggtcccagcaaaagcagtgggatgttctgtgtactcagaacatgaattgctggtggggtgggcgtgtgacgtggcagagggcaggtattaagcagtttttccacctgtcctcctttccaccttatgtctttgccccactttcctataggcttgcacttggacttagaggctgaatctaggatatctctcctaaaaggaccgtccactattggaaagtcgagtgaggaggagaggcccatctattgaatgggattttcccagatgagaggggctgggtgacagaaagtggatggaacctggctgaggcctgccatcccttggcctggggatccttggaaggaaaagaacaatccccaggttcttccctcatgacctggggattgttctctgcattgctcctgacttagtggaagtgaaaggtgtccatggcttagggttgcagaaatgactcagagctaagctacctagattcaaatccagctccaaagacaatcaccttccctgcgcctcagtttccacccctaagataggggcaataaagtacccactggaggaggctcttatgagagtgaagtgagtgaggacacaggaaaaccatggagcagggcccagtgcggagcagtaggcatctgctctgatgattgtcattgcaaaaggacccagttgggcactacaatcagcctgtcctcatttggccccaggaaccaccacttgcctagctgtgggaccctgggtaagtcactcagagtgctctgaaatttggctttgctacaagtaggactgctccctgcctcacagaactgttgtgagggctaaatgaaataatgtatgcagagcttagcaggcctggcatgtagtaaatactccggaaacattttttttaagttccagggtggttgtctacctggatgtcacctctgacctctgaaaaccacagggattgaggataggaaagcagtgctcctttctgcatccacccggtccccacctcaccttcctgagcaccaggaaaggagcctgaggaatcaataaggccagaggaggaaccctgcagagcgtggtcagctgggaaggacttgggcagtaggagcagagggggcaaaggagggcctgggttgggggtacgtggcagcatgcctgtcctcagcagacacctcccactgcccatgcttcttgtgggggtgggccagcccagcttaggttatcttggctcattgtccactagtgttttcctcagatgctccctgggagctggcagtactggagggggtggcaagtggcctcagtcggctcacagttctaggaccgggcccaggtcttggaagccccttgagctctcccccttccctgcttaggccactggaagacagaggtctccaaagaaagacaaaagctggggtctagacataccccatctggggtctgacttaaaggcctttgccagggtcacctcctgttggcatcagagaaggaaagaagtgtgtgtttgtgtgtttgtgtgtgtgtgtgtctgtctgtttgtctatgtctgcaggtggacaagtagggccgggtgtgagtggaagtggaaaggatactattctgcccatccctccttgctggccccccagccagctgctaagatccagagtctgggcagcagagtcaaccctactgcagctgggggtgttgagcatgtctggggaagagctaaaagtggcagaaaacatcctgtttgaaagcaatgctttgctgtatttaacccctgcaacacctgctccgcctacacccggtctccacagacaggagatctcagacacctgcctttgaagctgtcccaagaggccaaggctgtgggctgccatccaagcctgccccattcccagctcctgtgcggcacctcctctgccctgcctggggcagccgtcttcccgctcttagcagcaggacacatggcccagttgctctgcttcctgagctgcctacaatctggagatggagggggtagtgagagtgtgggtctccctaacgaaaaggcccttcctccctcctgacaccctgggctgtgagaggagaaggagtgcctaggcgggaggctgtttccttctgcctggggctggttgccgccaccgcttcccactgctcctgctactccctgcctcgagggagggccatcctggctgctgcccagccgccacccccacacccctgccagcgatgacatggcatgcctgctcccaacaagccacttctgtttgcagtcactgatctggggactaaagtccctggaaagagcctctcgtgcccacttccttagagactggggaggcggtcagcgctccgccttagataaaaggtttccccttcttcatttcagaagcctttgggtctgaagtgtctgtgagacctcacagaagagcacccctgggctccacttacctgccccctgctccttcaggtaggtgtttcctcatcagccgcaacttccctggctttctgttttcaaggggcggggtgggggggaggggcataagaaggtggtgggcaggggaaggaagggataccacccaggattttgcaaggtgggtcccgggccagcagagtctgcaactgagatgcatgagtgtgtggggtgcgggtgggagttcagagaagggctcaggagatggggcttgctggctccagccacgaccctggctgggctctcctgtgcgtctgatgtttcctatccagcccccatctcctctttctctttgctgccttctttagtctctgcctgtcattcctgggactttcagctctcaagccacagaggcttggacatctccacatgtggactctggtcctgggcgctggcttcttgatagcagcaaataacctcaagcagggttgggtcttctgtcagctcccctgaaatggtctcattcactgtgggcctctggctgcttgatccagcctttccagccttcacccccagcatagagacttcctgatgtcaaggcagcaccccaccccattgcaggactgccccgttgctgtgctgtggtagtatgttgttccactcgcttgcatcatagcatctccaaatgagtccatgtgatgctgaacatgtgttgactgatttaacagatattccttcctaccccccatttgatttctctgttttccacgaaatccaccggatacttgggagcctggatgacccagactctgtagcaacaccacgatgactcggagctgcagcatctcagctgacccagggttaagccacaagcatcctggacagtttcccctattaccccacaatgatattgggcctccgggatgctggccacatcttgaatgtgtgctatgttctaaaacctgcaggcatcagcttggacttgggatggtctttggggacaatgttgatagatccacaagcactttttctatttttaattgttttttaaattatgaaacgttttgtatattcagaagggcatgcaaacacagatatacaaaacatagatgtagtgttttgctaataataataagaagaagataccatatgctcactactcaaaaaatagaatactgctactatataatgcacacccctccccgatctcatctctccaaaggtttctgttaatcattcctttgttctttttttctgaacttttcttataggttcagggggtacctgtgcaggtttgttacaaaggtatattgcaagatactgaggttttgagtatgaatgaattgtctcccaggtagcgagcatagtactcaataggttgtttttcagcccctgcccctgtccacttgtattcccagtgtccattgttctcatctttatgtccatatgtacatgatgtttagttcccacttataagtgagaacatgtgctattttgttttctgtttctggctttgtttccttaggataatggtctccagctgtatccatgttgctgcaaaggaaaaaggacagtgtatgtgtgtaaaaaggacagtatacgtgtgtaaaaaggacagtatatgtgtgtgtatatatatatatatacacacacacacacatatactgtattttctttatctagtccagagttgatgggcacctgggttgattctgtgtctttgctatcgctgcaatgatctttgttctctttctgaaagtgcttctctctttatatataggtatatatttatacttgctaaactttaatgtatatgtagctgctaaaatttaatatatacattaaatatgtatttatatatttaatatatattaatatataatatatattaatatgtatttatatatttaatgtatatattatatatacattagagtttagcaagtataaatctagctgtgaaagaaattagcaatagtgtcactattactattaggatagttcaaaagtaattgcgatctttgccattatttttgatggccaaaaccacaattacttttgcaccaacctaatacattaaggtttccaggaaaagaaaagctaaatgaggttagggaatctccgaggtctgtgaccgggattccctctgtccctttgggactgatgataacatattcttgcttatctgcaccacttctttcccttggtgtgaagctctttggggaatttttagaaagtatttgttttattcatttggcagtagtggtttctagacatatcttaaggtttgggcctctctgggcctcatttgtaaaggggatgatgataatagcatctacaccatgaagtggtatgaaggtgaaataagacttaatgagctttgatattccacaccctagatcagagatcatgggcctagtcattgaaaagtagctcagagcctcccaagggcccccagaatctgcctctgtcacccaagggcaggaggaaatggtaccctggggtggagtgggttcttgtctcttgtttcctggctttctctcttatttttcttctgacatgaaggaccctttgcctagggtcaaaggggtcactgaaacctgtaatgacccttttgaggattcagataaaattgggagaactgggaggcagtagggtctgaaagcatttcagggcagtctgaggtatcccagaatcatctctgagcctgacagtagacgggatcagacgcagcagacaaagctgggggcccagttttggctaatgaaagagtcaagccagctgcttcctgagaaggccttcccaaagctgtgggctttcgttccgtctgtctcttctccttttcctcaagtatgaaatccatctctagatgataatgcctgtttagaaaaaccatctctgaaaacacaattaattgtataggactcacatgactcagaaggacattcaaaataatgttttaagtgttgttgccaaaaaaaggggggggaaatatcttgaaatgttgattgtcttggtacaggaacaccaggggcataagcctattagccctgagctttatggttgtgaggagctggggctggaatgaccagggcacctaaatcctcaattccccccaccctcaagaggaggagacctgagggtttctctccacatgtaggtgctgaggctgagggaggactctcattttcccttggagggggcgttgggcaggatagaagcccctgacctggttcaggtctgtgcctgaggcagagctagtgccagtagcatgaatgggttcatgcatatgatccttacaccctggaagtaaaacacctcttccaatgcagacagcgggggcatgcagaggtgaaccactaaacccaaattaacctgacagatgcaacatctgaaaccaggcagctgattccaagccatgctctgagccagctatgtagggcgaatcatgtatgagggctccgaaggcactgtgctcaggcctgggccctggggagatgcccacccttgctgagctccctggtggtggggggtgggggcggtgggatgaggctgggggtgggtggcaccaaggatgccagctggccctggcactgactctggctctgaccgtggcctgcttgctgttcttacagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggtgagccctcctcccaggctctccccagtggaaagggagggagaagaagcaaggtgtttccatgaagggagcccttgcatttttcacatctccttccttacaatgtccatggaacatgcggcgctcacagccacaggagcaggagggtcttggtgagtggtatcttcttttccctcctctcagctccagatgttcctctgactctcttggaaatcgctttcctgaggttgctgtgtgggtctctgtctttccattacgcctgtaacccacagcctcctacaccaacccacgtgtccatccttccagagtgaacctcctccctgttgatgatcacagcttcctcacccaagagacaggcatgtctttggggaaagcccaagaacttggtttcagagcttgccttcccatccaatccaaactgttccttggaacaagggaaatggcacctcttgtcgggtcatcacgatctgtacccatatcttcacccaaggactgtttgtcctggtctgaaagccaaccttggaacatccaggcagtgtcaggaatgtacctgcattcctgtttgatcagggccagtttctttaccaacacactccccttacatgagcccaggattacagatgtgaaaggtgtgggaaaagcactggaggttcccattcaaagccagggtgggagcgtgggaaagggatgaattggggcaggaactgggaatcatgagaaattagcatttggcatgtattggagagagagagagagaatagcctgaaagaaggcagccaaaacagatcttctgtctagcggtctagactggaggtggctatggcagggctctaaccatcaaatgaggaaagcacaaatcaagtccagaggaggatgctgaggtcggcttggttgttgtctaaaccggagtgctctcctcgccttgggggcacagtgaattcaagtccaggcgcttgtgtgggactcttactcaaggacttggggtctctctgtcaacacaagctcctgattcacctgccctctgcctcaggaatcagcaggcccagagtttcatggccttgagcaattgctgggcagtggggtttctgtgggtgctaattgcctgtttggcctggcactggctgcccgcttggcttcccggcagcctactctccagctcggggaaccagacaagcagcatcgctggctctaagtcgtgttgctgcatttgccaatccttgggcctgaggtccacacatcctgcagggtgggccttctagagccccagttgtgtgtcccaggtgacacatggaccctttcctgccaggtcctctaacttggggggctgccttgagtgctaatgagaggggaatctaacgcacacctcagcgcctgcttactaccatgaaacccatcagaaaggcatggtctggggtgctggccatggcaataatttatgggatgtccttgctcaaatggatgtccttgacatatctaggttttagttaactcaactaatggcatgcatgtattgatatccaccccctctgctacatagtgttaatctgaggattaatgagatgacatgtaaaaaagtgctttgaaaaacactttttcagtctgatgaaaaaagctgagatttttgagcctgatgggtcaccactgctgcccttcatggaaccatgctctcataaaataaacaaaagcctcgcagccagccagccagccactttcctcgtgtgtgtgtgtgtttgtgtgatttttttgtagtgatggggcctccttatgttgcccaggctggtctcaaactcctgggctcaagcgatccttccatcttggcctcccaaagttctaggattataggcatgagccaccatgtctggccttgtgtttctttcactcattccgtcaccagacttcaatctgcatttataatctggcattgggctaggagttgtcaatatggagattctcaccgaaggtcatatcttgtcagtctgcaaccaaagcatttggttatggagtctctacccccaaatccactctctcctcctaggcctcctcccccctgagattcagctctgggaaatgagaatcttaggtggcagctggttgggtggtgacacattggaggccagttcctcactggagtggctctgactgctatgcatctgtggttgctgcccttggacacaccactaggctgggaatcctcaggacaggagcatgtgaggcatctgggtggagagaggacaggtcctgtcatgccccaggctgagtgtgaaagatggcagaatgaacaaggatggtatgtttgtaatctgtgtcaccacagactgacagagtggctgtgttgcttgtgggcacatgatgccaccttaacccactcttagtccaccttgacaagagcccttagagtctgttgctggctgttggtcacaaccactgcctgcaatgcctggcactatgggctgcaggctggttttgtcttgttaccctgtcctcagtctaccttacttagatctttactgtctctgtcttgatgactaagctaggctgctacattctaaagagccaacatgtctgtcatttgcttgaggatgtggatgaaagagaatgagtggggttatctatggattgttcaagagtaatgttcagaaacttgagggaaggtcactgaagctgtcaagaaagacagctgcaaggttctgaattttgtttgatatgtacataaacaaacacacacatgcacacacacacacacacacacagtcaaccttcattattcatggattctgtatttgcaaatctgcccacttgctaaaatttaccaaaatcaatacttgcagcccctttgtggtcatttgtgaacatgtgcagagcagtgaaaaattcacatgacttggcacctatcttcccagccagggtcttcacaatctatttagtgctacattttttgcctttttttgatttttattggtgactttgctgtttaaaacagttcccaagcgtagtgctgcactgctgtctggtgttcctaagtgcaaggccgtgatgtgcctcacagggaaactatgtgtgttagacaagcttcctgaggacaacagtgctgctggctgtttgatcaatgttaataactcaaccaacaatatctattgaataagatatctttaaacagaaaactcacataagacaaggttatgtgttgatcagttgatgaaaattttgtgaccagaggcttgcagaaacctcaccctgtgtttcctccaggaacagtgtttcaatattcactaatccagtgtccacagtgactatagaccataactaccatgaataatgagaatcagctatacatacatcatttctcctcttcttccacccctgatgcctgcttctccttctttgcttcatccaaattttatttggaagttttccattttgatctggtccaaatagttgcttgagaaccctgtggtcactcatatctgtttgtgaaactctgatcccaggaagcaaggacaatgtcagtggtctgtaccttctctgtggtgggtactgcatccttgcatccttgggaacacagagatgacaggaaccaagtccttgctctcaagaagcttgcttgaccatttcctgatagttattgatagacagcattgcttgaatattgggtcactagctcttttccaagccctggagaccagtaatccaatcccatttgaccatttagtatttggtttggcttctaagatagttaactaaactgctctaggagctagttgttatcatcaaaacgagtctaagactcataatctagctgaagtgtgatgatggttagaaggttagagagggatcacagttctattgatctatgatcaggcattagaggccattgctggtcaattcctcctgcaagctatttcatgttgcttgtgcttcctgttattctggaatacagggacatcctcagagaaagatgatatttccagtgtgaatataaggttggcacaggcaggcttatagatggccagacacctcttggctatatgttaacaactaaagcataagtaagagccagaggaggaaaaacatttggaataggtctattccaaatgacatatatagtggatgatccatatatgtatatgcatgtggatgcatatggtcatggatggcttcgtccggagtctgatataaaggaaaaggtgtaatggacagagaagaaaatcagaggaacccctttgatgaagagaatgaaggtggatggtgaggtttaagagctgatcctggaaggcaagatgagaaacaggtcatcgtttgcctgcttatcttgtcttcttcctccctgttgggatgcttaaataaggactctgtgcagctacaagctaacaaagacagtgcagagaagtgcgttttcgcttcctagctccaaggttcttgaggactttgttaattatgggtcatgcggagtgcagggggcaaaaggtaggctggcgaggatccaggaagatgaggaatgttctggcattcaggaaggtcaccccactgatatttgtagctcttctagcaacctgatgtgaaaggaagcagagaaatagggcagatgtccaggaatttaaaacctaaactgcttaaaggagagaaaatagagaaaaaagggaggaacagccacacagggtattctatgggcacaagtaaatgagtgaccaagaagtcagtgttgctggagagactttgtccaggtccactttggcagctgacctccattcacagatattcaaggatgtgaatgaaagagaatgagtggggttatctatggatgttccaagagtaatgttcagaagcttgggtagaggaggccaaaatatttggagagggaaggtcactgaagctatcaagaaagacagctgcaaggataggattttacattacctttttgtcattcttttatttcttttgaaattcagcactctaatcagggctcatttgcatgactttgcactcagcacacacttgagatcttccctgtgcttgggttatacagggccagtggagagcatggtcagatgtgaccccacacttccaaagcatccttctagagactgcctgaatccctagagggatttgtcctagaggagtccttcaaacagcctctgcttcatgctcctggactttgggaaagcatgtttttgactgctgctctagcttggattgagagatggtacattcctgatgagaaccatagtatatatgaagatcagtgtattagtccatattcacactgctataaagaactacccaagactgagtaatttataaagaaaacaggtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggaggctgcagtgagccgagattgcgccactgcactccagcgtgggcgacagagagactccgtctcaaaaaaaaaaaaaaagaaagaaaacaggtttaattgactcatggttctgcatggatggggaggcctcagaaacttacaatcatggcggaaggtaaaggggaagcaaggcctgtcttacatggcagcaggagagacagagagcaagtgaagggggaagcgccacactttaaaaacatcagatcttgtgagaactcactcagtatcacaagaacagcaagggggaaatctgtccccatgatccaatcatgtcccaccaggcccctccttcgacacatggggattacaattcgagatgggatttgggtggggacacagagccaaaccatatcagtcagattccttgggagtcaaacagttcttgattctaattccagctttcagacttgctagctgtgacttaaagcaagttatttaactttcccgtgcctttttgtgtcacttgtaaaacagggataatatctacccaaaggttgtcgagagcattggagatagtatgtaaaatactgacctagaaagcttccagtggtgatagctagtatcattatccctttttagtgtcttagttttgaggacagatggtcctttcttccttttctctaccatggaacttggaaagtataactatgtgatgtgttggcagtggtctctgaaaagaggttcctaaacagaaggagttaaatatcaggtatgaagagggaagggctgggccaggggctctgagagagcttcatgtcggtcaaaggctgggtagaactggctggtgctcaacagaactggacagtggttgctgtaactagcacaggggctgtggctctagacatcaggagctacagcacatgaaacagaaatatggtttcaaactctgctgcctgcaggctcccatgctaggcacccagagagcaggcctaagacatggtgtctgcttcaggggtctcaaattcttaatgagatgtttaaaatctactttaaaatctactttcacccactctcagcactccctcccactgcctctttctgctagtttctcttctttccctttatttagggtttcctttgtccaggtcctgttcccttttcctttatttagttcttacaaccctctctgaaatgttgctcccattttacagatgtggaaactaatggatgggaaggttaagtaacttgcccaaggttgtgctttaagatttaaactcaaacatatcgatctaaccaaagactgcatttcatttttaatgtttaggtagttgtagtgggtagtggattttttaaatgtaacgtcataatatggctttttaaaaagccaacagtttaagaggatatgtaagtgaaaagtaaatcacctattcaacccaattcttagttccctacctcctccaggaagctgtcactgttgccagctcatcgtgttcgcttccagattctttatgtaaaagtgcatatgtgtgtgtgtgtatgtgtgtgtgcacacacgtcaccattctgcatcttggttttatctgctaaagaacacttcttcaagctcattcccatttcagcattcttcctctttctttttcatagtcacagagtattatatggaggttctgtgagataagaaaccagtgcctggctgggcacggtggctcatgcctgtaatcccagcactttgggaggccaaggtgggtggatcatttgaggtcaggagttcgagaccagtctggccaacatggtgaaaccccatctctattgaaaatacaaaaaattggccaggcgtggtggcacatgcctgtaattccagctactcgggaggctgaagcaagagaatcgattgaacctgggagccagaggttgcagtgagcccagatcgtgctgctgcactccagcgtgggtgacagagtgaaattccatccagaaaaaaaaaaaaaagaaagaaagagagaaaagaaggaaggaaggaaggaaagacagatagacagacagatagaaagagagaaagagaaggaaggaaggaagagagagagagagagagaggaaagaaagaaagaaagaaagaaagaaagaaagaaagaaagaaagaaagaaagaaagaaagaaagaaagaaagaaagaaagagaaagagaaagaaagagaaaagaaagaaaccagtcctctgtcatggtcatttaggttcggtctttggctcctccagacagagctgcagtaaccaccattgcgcccatggaccgatctacccacaggataaatacctggaagtggctttactgcgttaaaatgtctgtgtgtttaacatgcttcgcattgccaattgccctccaaaaaaaaaagtctgtgctcttttctacagtgctaaccatcctttaatgtttttttaaacccacctgaggagaaccccctgatgctgcctctcacatacatgtaggcccctacatcatttgatgtaggtctttttattcctttagatttgctggggtataattgacagatagacatggtctatatttcaggtgcacaactcgatgttctgctatacatatacattgtgaaatgatcaccataatcaaactagtaagcattcccagcacctcacatagctttcagatcaggagctctcgctagttcctgtatcctgagcagacgctggaatctctgtgacagtgcagtggagatggagcccagaggggatagttgaccctacgcctgggttatgcaacgtgcgtctctgctggcagaggccacctactggagaaaggcccaactgtcccaggcctgaggccctggccccaggctcttgatgcttttgtgaggtttttgtctctttctgttttgataaactggtctctggcatgagaatcggtcaatgtcctctctcacccctggctttctagaaactgcatctatatttagcttggttgccccacccctacccccccttcctgagctggggtataaatgccaaccaaccagaggatgacagggtccaggctcagagagcagctgaggcaatgggctctcatggaaacctgaagctcttgtttctcaaatccaaaccagctcacaggcaattagtattgggaggaaggcagggtagggtgtagaccttcaggacaaagcacagagccagggttgggcagtctggctgccctgactcctcgtgggcagagagtaaatgacagccacacatgtggaagtgcccttggaaggcaggagaacagggaagaacaggacctctgagccaagaggatctgtggcccagcaaacagacatgttgggccagacacacctgaaaggccagctctgggatctgagttccagagagcctctgggtctggcagttggagctggggagcaaactttctataccctgaacactgaccccacgctccagagcgtaatggtgtcctcttccttttcagtgttctcgggcttcatatgacaactcttaagcagaagcaagggcgccaaactttttttttacccccagtactttctcttttattttttatttctagagacaggatctcactttgtcacccacactgaagtgcagtggcacaatcttggttcactgcagccttgacctcaccagctcaagcgatccttccaccttagcctcccaagtagctgagaccacaggcgcatgccaccatgcctggctaattttttttaatcttttgtagatacagggtttcaccatgttggccaggttggtctcaaactcctgagcctaagctatctgcccacctcagcctcccaaagtgctgggcttacaggcgtgctcacgccactgcacccagtcccagtactttctcttaattcagctctgcactattttctcttcctattccttttttttttttttttttttttttgagatggagtctcgctctgtcccccaggctgaagtgtagtggcacgatctcagctcactgcaagctccacctcccgggttcacgccattctcctgcctcagcctcccgagtagctgggactacaggcgcccgccaacacgcccggctaatgttttgcatttttagtagagatggggtttcaccgtgttagccacaatggtctcgatctcctgacctcgcgatccgcctgtctcggcctcccaaagtgctgggattacaggtgtgagccaccgcgcccggccttctcttcctattcctagcctcattcctgttgtcaggcaaagtggggctgagtggcaatctccaaccctccctgcgtatagacatctgagatggagcttcatatttaaagtgacatgagaaaaatgagagaaagatggcgaagcagtggaatctcttttcaggcaaccctgcagctgggggggctgcccccaagtgagggtcaaaggcaggctccctggagcctggggaaggacagacggggcctctgataggccctggggcctcaagaagctctcagtcccgggcccagtctggtgagaggctttggctcacatcactgtaggtggtggctgggctaggctgacgatgtgctgtcttcttggtgcccatggccttgcaggcttaacaggaagagctctgagccagacaagacagccagtgggaggacagagcagcccctcagtgaccagagcgaaatgcccggttgttgaaaaacaaaaaaaaaaaaaaggaaatgagagtttcttctgaaatagaaacttctggtccttgagtaagtttagagaattacgggcattctgaggcctgagcatttgtggtgacggatgaagcctcaagaaccacaaggttggtgggagggacaccaatctcatgtcctggaacatacagatgtccctgtggggataattgtatctcgtttctggggaaccctaacagttcccaagatgcttccatattctcttgtccctccagaaaagcagcagtaaacaaatagaggtgaacggcaaaaggctttttgtttctacgaagatggaaaaaagcctggcgtataacttctttcttgttagctactgcagggttaggactgggcctgaggcgggctagacttggagctaaggagcccctgatagcctggtgctgctccacctcctgacaaccctggctctgcagtaggccccttgggtgatgagggttgtcacagcagggtaccagagccaaggtccaaaaccaacagcagctgcttccttgactgttgggtcattcttggcattgagccacctggggctgtttggggcatcaacttcactgagcactttaagtttctggggttgaaaacaatccaggaagctaaaggctaagccttagatccctaagacttccagacctaggagcctgcacttcttgctgaatatcctcacctgtaagtttcttaacctcagtggtcccacgtataaagggagggagttacactgacggtctcttgggccctctgtggatctaagagtctgggcctgcctgggactgccagtagagccctactctggtctcttctctatcccaggggctgagtcggtgtggtccccagctgtccatttgctagagcaagcttgacaattgatgagtgcgattcccctcaaccccatgtatgttctagtgaatgtgaacagtgagtcatgttttaccaagaatcctaactaatgcctggcccctgagcagatgacgtcagtagctcatctccaggaaggaaatggttgggcctgggctttggcttggaaggcttgggcatcttcacactcagcagttccttggaagatgctgctgctcatgcagacagtgattctgccaccatctttccccatctaactatgtcagaaaagtggggcctactcctgctggggctgggaggaggacaggactctcaggacatggatgatgaaaagcctctagggaggtgcctcagggaggtgtcctttatgcagcctcccaaagtccacgtggtgtggctggcagtgggagagaatgttcgaattaggaaaatgagcccttaaatgtgcacacttgtgcacacacacacacacacacacaacttacataggctacaagggtgccacttttctttttcttttctttcttttttttttgagacagagtctcattctgttgcctaggctagaatgcagtggcacaatctcggctcagtgaaacggccgtctcccaagttcaagtgattctcctgcctcagcctcccgagtagcggggactataggcatgtgccaccgtgcccggctaatttttgtatttttagtagagatggggtttcactatgttggtcaggctggtctcaaactcctgacctcatgatccacccacctcggcctctcaaagtgctgggattacaggcctgagccaccacacccagcctcaagggtgccacctttctagctaagaacacttcagtagttttctgggttttttttgttttgttttgttttgttttttgagacagggtcttgctctgttgcccaggctggagtgcagtggcatgatcttggcctactgcaacctctacctcctgggttcaaacgactctcctgcctcagctcccagcccccaagtagctgggactacaggcatgcaccatcatggccaactaatttttgtatttttagtagagacggagttttggcatgttggccaggctggtctcaaactccttacctcagatgatccgcccacctcagcctctcaaagtgctaggattacaggcctgagccactgtgcccagctctagttttctgttcctacagagctcctgcttcctcttcctttcaaaaaacccaaggccaggcctcaggatttccacctgcttgtctggccccttctttttctgggcaggttctgggatgtctagagctatggtttgggccttttcttccttccatgtacacatctatccctggaacaggagctattccagtcacaggtctctagaatctagaagacttcatgctgagactagcatccttacttctcatagcggctcattaaatgttattatgctggctactctggagatttcaatatttaaaaaggtttcttcggccaggcacagtggcttacgcctgtaatcccagcactttgggaggccgaggcaggcggatcatgaggtcaggagatcgagaccacagtgaaaccccgtctctactgaaaatacaaagaattagccgggtgcggtggtgggcgcctgtagtcccagctactcgggaggctgaggcaggagaacggcatgaacccaggaggtggagcttgcagtgagctgagatcgcaacactgcactccagcctgggcgacagagcgagactccatctcaaaaaaaaaagggttttttctagggaaatgcacttttgttatttcctgtttaattttttaaaatgggaaggggaacagagtactgtaaaataagtataagagtcggggcgtggctgtgcgcgatggctcacgcctgtaatcccagcactttgggaggccaaggcaggcggatcatgaggtcaggagatcgagaccatcctggctaacacggtgaaaccccatttctactaaaaatacaaaaaaaaattagccaggagtggtggcgggcgcctgtagtcccagctactctggaggctgaggcaggagaatggtgtgaacccgggaggtggagcttgcagtgagctgagtgagccactgcactccagcctgggtgacagagcaaaactccgtctcaaaaaaaaaaaaaaaaaagagtcggagtgcagtggctcacacctgtaatcccagcactgtgggaggcctaggatagaggattgcttcagcccaggagttccagactagcctgggcaacatagtgagaccccatttttacaaaaaaatcaaaaaattagccaggcatggtggtatgcacctgtaatcccagctatactggaggctgaagcaggaggattacttgaacccaggaggtccagcctgcagtgagctgagatcatgccactgcattccagcctgggctacaaagcaacaccctgtccccccaaaagaaacaaaaattaaaagaaaaaaggtaagtacaagccatgattggagctgggcaggcaatgaaaggagaagtaggaatcgtttggtgcccagcctagaggtgagagtgactggcagctggggtgggcctcatgtcttctgttggagaaatggagaccagggggcccagaagacaggtctccgtgatgacagggtgaggagccggaagttcagtgacccagggcagggtgtgtgctctctcggcaggcgaagcatgaagcggaaggcactattcacctgccccttcaacggggactgccgcatcaccaaggacaaccgacgccactgccaggcctgccggctcaaacgctgtgtggacatcggcatgatgaaggagtgtgagtgtccaggggctgggcagggtttgggcctgaagtggagtcagggaaaggccttggccactctcctgcaagtttgggcagagggtctgcctgcccttcctctgtagctgccagcatctggggccagggcctcagtgggaccagcagctggtgacagggcagctggaagtccagggtcagatgcactcagcggccctgtgcacctcttgaggatctgtgtgttggtgtcagaggccctggaagggtccctccagagtggggcctgagaggaaggagaggccggacactgccttcaagagtcccttctactcctgggtcagggtcttcctccaggatgtcattcttttttcacagctccctgttactcggacctagagggaagaatgaggttcaaggacccccaggttctatgggcttgggaagagagggctgatgtgggttaggaagggcaggagtgatggggagaattagtattcagagcatagttggcatccacgttctgtcccaccccagcctcccagcctctctggcgccttgagcagatctgagggcttgtgccagggagagaccaggaggaaagagtctgccaggggaagcactgggttctaggacgaccctctgaatccagatggagaaagaggagtgattctataggacttcctgtccctctctggggttggagaagaccaacatggcatatttacatggatattttgacccatcactgaaaacaacacttgaactttgcatcagagctctaggacagttatttggtaactagagtaggcattgaattcagtagatgctgggaggggccagcctggccctctctgggctggagcaaggccagctgggcatgggtgctctctgtacactcattcctttttctccttctcttgctcactcctgtctgccatctgcatccagacccccacccggccctaggacagaacccaggccctcctagctgtgggtctgaggaatcggagtcggagtcggggtggggatgttgctcagatgcggaccctcctggctatgggaccgtttggagtggttggggatggggagaggtcaggtaacaggaagatgtgtcagggacagaggataagtcacagaacagggcttagaggatagcaaatttctccgttaatgggaaaaaaattatctgttgttgggacacagaggcagagctgaggccctgaccctgggcttcctctttgggccttgacctaggcttctcttctgtgggtcatgactcctccctcctgatctgacggctccccagccaacactggcagccctgaaaggtgtttccagggctgtggtttctccacaccatcacagggtgcaggcctgggcacgctggtcgctcctaccctagtccctgccacgccctggctcctgtgtttatcctggagagaataagaagtggaggctggaggcccgggtgccttaagaggcttcacacacattctcagtgggccctgctcagggtgaggcgttagggtgggcaccaacaaggtgtgctcagcacagtcccatctccgcagagaagacagcctctgcaaagcagggagtccggtttctaaagctccagctaaccaagactggcacgaggttccactgcagtggttcgtaaggcactgccacaggagttcccctcaggactaagctcactgatgcccaagaggcccctctcctacctcaggaggaagaggatgtcttactgacttaaaatagaaagaacatctgagactcagagaggtaaagacctcaggtctggggtcagaaagcaagttggtggccaagctgggactagaatcagacttcatgtcccctcctacctgcctcctggtccccataaacagcgctgcatccatggtgaagagcagcaccagcctggggtaaatcagggggccctgcccaggagcaccctaccacgtggtgggaacccagcagcccagaagcgatgtccaccccatccctcagccacgcccaccccagcctaattctctcctgtggagtcctgtgtccccatcctgctgtatgcccaaggtagcttctcgccacaccaccctcctcatcccagtgcagggagcagtactcagttctagatgggctggtggagcggggatccagttaaaatagaaacgtcctgatgctttttactttcctgaagggaagactgtccaggaagagacattcccagcctcaggttagtccagcttcaggaggcctcaccagtgtgaagtcccccggcctcagaaccctgggagagctgcacatttcttatctgggctgggttttgtccccaaggcatagcatcccagagacaattgagtgtctcaatatttgtaaaaccacaggaagaaagctaaaagcccaggctcctgctgtccgagcaaggaggtgggccttccatagaagaggcacaggaagggaaaggatgaggacagaaaccctgtgtattgaccaactactgtgtgtcagatagcacatcaagcacatgcattttcttctgaaattctcacaacactccctaaatatgtaaatacttttattttttcaatagctgaggaagctcagaggaattaaaatatcatggctctcagctaataagatgatggtatcagcattcattctaatctaggtctttctgcttccaaagggcaggcttgtgggccacacccgaggcagcctctcgtggccccagtgggtcggagctcactccattgtgcatttccaggcactttcacatgctctaagagatggattgaagacagcttggtcccaccaaagactcattttctctcttttccattcttagttgactttataccctgggaacccaagaaattttataactgagttcttgctgtttgcttatactattacctgtcctgcacagaaccacacattgtggtaacttgtttgatgtttttacagatgtatgtcttttctccctggtgttagtaaagtacctggcacatagtaggtgctcaataaatgtgtggaatcaatgaatattagctcctcattatgcttctttctctctgtatatcttccacaggtctatagatcagtaagattctcccaaacctgatcatgtctgtgccgttcatttggaaacattttatgtcctcttcctgtggttgttcttagcccatccttggcatcttgaaatgttttcaaattgtttatgttgcagatcttggcttcgttaaggagagaacatgtcttgcatgggaataacttgcgcaaaattatttcacactcagcaaggagcttaaaatgaagtcaaaaaaagcttctgagcagccatgtaggttttacaaagtccacatgccaaaactcatgcactttagacgcctgatcaccagacagcccaacactctttcagaacctgtttactcttattctaggtcaatggcttcatatatcatatagtgtcttcctatatgatagtaatgacatcttaggttcaatccattgaaaaaatgataagaaatttcccatgaaattaacaagatctttaaacaaattatttcgtaaatcacagtgcatttgcatatgtgaaagactttagacttattcagtcctcaagcaatgttgccttgcagaaggctcatggattgggcctgtgtgaaactggtagatctcagcatttcttcctctgttacctccatagaagatggaggttgctatttgatgcaagtgactgggaggaatcatgttatagggttaaacttgaactttctttgtctctttaaagtgggtaatttacaagctttgtgacttaattttattttcacactcttcagatggattggaacacaatgcctgtcaaaactccatggctgaaagccaaagtccgcttataaccagatgtaatcagacacagtagaggctagtggttatgaccttccactccagaaccagactgcccaggtctaaatgctggtttcaccactgttagctgtgtgactttgagaaaggtagaaagcctctctgggcctcagctccctcatctgctaaatgggaataacaacagcacctgccttaaagggttgtcatgagggctaaatatatgagttaatatacaaaaggctctcagaatagtgccttatagatagaaaaactctttatgtgccatccagcattacgaatattttctttttattacatcaaacttgatcaccagaacttctagctcccaagagatcagaagtaagtcttaagggggagaaaggcacacatccagaggcagacaccaataagaagacaacgcatagtttaacagggaggtggacactggaagcaagaaaagcagcccaagaactccaaagcccagcacgccaagccatgcaatgcggggcagacagcctctgacaactctgaggctgtaaccttgtcctgcaatgttcagtaattattcagaatgatacctctgaatcatcagggaaaggttatatgacgttaaaagtgttccgttacaaggttttctgtcttgaaaatctttccataacaattgtttcaataaaagaggtcagctttctcagctctctggtgtgccaggtgccattcactacattgcaggagacaagcagcactagagtactcactagcctttcctgaaccaggaaaatgatttgcacacagttggtgtaatctgtgtggatgcatttgatatttggtgtcagactattgagcagacaccacggccaggtagcccctccggtctagcctttatgggggaaatataagaattgtaagacaaaggccgggcatggtagctcacgcctgtaatcccagcactttgggaggccaaggcgggcagatcacctgaggtcaggagtttgagaccagcctggccaacatggtgaaaccccatctctactaaaaatacaaaaaaattggccaggcatggtggcatgtgcctataagcccaggtactctgtagcctgaggcaggagaatcgcttagaacccgggaggtggaggttgcagtgagccgaggtggtgccactgcactccagcctggataatagagcgagagtctgtgaaagaaagaaagaaagaaagaaagaaagaaagaaagaaagaaagaaagaaagaaagaaaaagaaagaaggaaggaaggaaggaaggaaggaaggaaggaaggaaggaaggaaggaaagaaggaaggaaggaaggaaggaagggaaaggaagggagagaaaagaaagaattgtaagacatggaccctgcccttaagtaacttgtaatctagagaaagagaccttgaacttcttgggctccgtctataggtaatgaattgaaaactgtgctaaccatgagtcttacagagcagaagataattgggtgtcaatgtgtgtgggaaagactaaatatgtagcaggcataggaaatgaggctcagcagaaaaaaacaaggcttgatgcagatcagggcaatcaagaaatgcttcatggaaaaagatggctatgatgtaggcactgaagaactggtagaactcatacaggtttgggggagagaaaacccagctggacgggcacctagcacaactggaaatgcaggggcgagcatgagcaggtcatgttcccaggccagcagcaatgccagcatgcccagaacagaggctgtgtccagaagcactaagacatgaagtctgaaagttaggaagaggccaactttagtttggacgtggtcatcagtaggggccgagaaaagtatctgggcaggagaatggcatcacagaatcactggaaagttagcaaagtccagtcaggctgagctacgtgcctgtagacaccatggtgtggctggcagaaacaggtctccctaactctggtccccaggtgagcaggaaagacaagacacctaatcttgggctccccaagcgagggcttacccccattgccttccctggatgctccctgccccttcctctcccaccctgcctgacctggtagggtctgtgcagacacccactgtgggaggagagttggcagctgtttgggcaggtgagtcagtcacctgggtgtggtctactcccaggctccctgtggagggaagcaccatctcttgcagtagcgctcgctttcctgccatgcctgtggcattggctgtccactccctcccagcataggctcttcctcaccccacagcaacttctctcgtcctccccctacctgagggcctgggccaatggacctttctcaaagcctggaactcacccaccctgggcttctggttcctttctctgctcttgtgaaactccccagttctgtgggcagatgccctggcagcagcagcaccaagcaagtagctacaggccaaaggccctggtgcccactcctgccgtcagcactcagcaagccacagccaggaggtctgtttgcccagccgccgtgccaggcacctttgctcccagcatcccctccacccccacagctgccccagcacagggaggcaggcagaagcctgcaggtggtggtggggctctctatggccccacaccctgattagtggctggagagaacttctaagattagagctgcaaggcctcaccctttggggccttcaagaggacttgaaaacttccatggacagaaatgtcaaggctgtacatgctggaggaggggtggttttgcagagaaccaaagaggtctagtctttctatattccacagtcccatgtctggaaacctggatgtggagacagccacatagaggagtcctctccacatctcacttccagcgctatgagagctctggcatcctctcttcaccctgatatcttcttcaggatcatggaacatcagggtagggaagagaagagaactaacatttagtgagcatctgctctgggccaggcatgcatccagttctcaaatcagttgatcctttgaggcaggtattattacttcccccacctgcatgtcaacacacacagacacacacacacacactttatggaggaaggtacaagaaaggaaccttggaagaacttacatggtccaaatctctcattttacaaacaaaagaacaaaagcccagagagtttgcccaaggtcccacaacttgttcttgagaaccccgactccctaaagcccagatcatcccccctctcaaatcctctttttcttcttcttgcatgtgccttccttttcaccatagcaaacccaatttttcttcacacagtggagtgggagtctccgtggcaggaggacccccgagggagccccgagtgttaaagcccctcctatcttggacctttacccccaaccgcaggaggaaggtttcctggaggagctgctggccagccctcctgactccccttcccaccccacagtcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccgggtatgtctgcctgctgggaggatgagccggtccagaggagaagcactagtggagccagggcccagggagtagggacagagggcaggggacatcctgaacagaactggggtagggacggaggctgctctgcccctggcactgggaggcttcgccttcctgtagaccttcctcaaagccattcctatcagagatcagggccaaggtaggaaggcaaccccaaaatgtgggtctgagaccccatctttcccttccagcctccagttcgtgtgaatgatggtggagggagccatccttccaggcccaactccagacacactcccagcttctctggggactcctcctcctcctgctcagatcactgtatcacctcttcaggtaagcaggacttcagtcctccatagagtaagggagcgggggcgaggagtccaccgcaccctgccctggggctgctggatggaaggaggtggaaggctccctaatggaaacttacataaatactgtgcgctatgcagcgtcttcacaacagcccctctgttacagaaaggggtgacttacccaagggcccacactggggaagaggccaagctgggattccagctgtgtagcatcagcctcccgggcccatgctgtttcctctaagccaggcttcagcccatggccccctccgtggaggtgacctgcttcctttacgtgatattttaatcctgggcccttcagaaggtgaaatttggagtgggaaggtgaacgtgttggtcctattgaggtccaccttccacttgagctctggggaccactctggccctggaggacctgtcccctccagctcagctgagagtctgggaggcatcatgctttccttcctttctttttttttttttttttaaaaaaaacacatatgtatatttagaaaagaaattgtgctgtatacaatctgatgacttgcttttttttatatggcattgtttttccataccagttagtacgcatccagaatataatttttaagggctgcatagtattctggaatacaataatgtacctaatcccctaccattggatatctggattatttcctcagcattttaataagaaaacagtatacttgtagccaaatatttacacttatcggaaattttccccttacaatgaattcccaggaagtgtgactactggtcaaagagtacacacaattatttgactaatgtcaaatagctttctagagtaccttcagtaatgtgcacctcctttagcaccccagccctcataggcattgcctaatttcctgcatctttataaatactggcatcaatatttaaacatttttgtttctggtttgtaggtgaaaattatagatgttctacactgcagttctttgaccattagcaaggttgaacatttttttccatgacttgatgggtcccaaattctttcttgattgagatccataggaacagcacacagtctgcttgaggaagtctcattgctctgagtgtctctggctctttgattttactgccttatgctgctgaaagaggcagagagagtcccagagggaagcctggggctgaagggtgacctgtggagtcactgtgggattcccagctggctctgctgccagggcacaccaggtttttgcagggtctggcaggagggggcctggtccaagtatccttaaatagctccttctcttccctcatctctcccagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcaggtaagaaacttctgcaatctctggggaacagagtcagagtcctagactgagctacaagaagggttggagatcactcatccaccacttcttttttttattttttatttttttaaacggcatcttgctctgtcacgcaggctggagtgcagtggcgcgatctcggctcactgcaacctccgcctcctaggttcaagcgattctcctgcctcaacctcccaagtagctgggattacaggcaccagacaccacgcccggctaatttatttatttatttatttatttatttatttttattttttttccagacagattctcgctctgatgcccaggctggaagtgcagtggcactatcttggctcactataacctccgcctcccgggttcaagtgattctcctgcctcagcctcctaagtagctgggattacaggtgtgggccaccaagcccggctaatttttataattttagtagagacggggtttcaccacgttggccaggctgctctcgatcacctgacctcgtgatccaaccaccttggtctcccaaagtgctgggattacaggcatgagccatcgcgccctgccctaatttttttatttttagtagagacggagtttcgccatgttggccaggcttgtctcaaactcctgacctcaagtgatccacccacctcagcctcccaaagtgctgggattacgggcatgagccacagcagccagcctccattgcttctttaaaatagagattcagaccctaccctagacctgcgaaatcagaatctctggcgtaggcccagaaatctgtatttagaaagtgcagcctgtcttgcgttactctgcaggccagcactggagagctagtccatccccgcactttctggatgatggtgtggaagcccagagaggtccaatggccagccaggatcccttccaggtgttggagccagcatgtcagagccaggcctagaactcccagctcactgctgtgttcactccagctggcttgactggaatcctcatattatctctttaaattcaacgatatgattcctccacaccccaactctgagagcagaatgaagtgatagagagaagggcttggccatgtagacttgtgaaacagtctaggaatcctggagagagataggtttactggcatatatgaccctggcatccttcaccaaaatgtacatttaaagaccatttcctggctgggcacagtggcacatgcctatcccaacactttgagagactgaggtaggaggattgcttcagcccaggagttccagaccagcctgatcaacatagtgagacctcttctctacaaaaaaaaaaaattataaattagccaggtgtggttgcacatgcctgtagtcccacctactagggaggctgaggcaggagaatcacttgagcccaggaggtcaaggctacagtgatccatgatttcaccactgcactccagcctgggcaacagagcaagaccctgtctcaaaaaagaaaaaaataaagaccatttcctaaccatactgatacatttttgccaaaatatataagtataaggagttctactggagaagggatcctcctttatcaattcattcatataaatttcattcatttattcctatgtttcattgttttaacactagtactgtatataatacttatatttaaatactcatgcagtgttaattttttttttcttttttgagacggtttcgctcttttcacctaggctggagtgcaatggcgcgatctcagctcactgcaacctccgccttccaggttcaagcaattctcctgcttcagcctcccaagtagctggaactacaggagcgtgccaccatgcctggctaattttttgtattttttttgagacagagtttccctcttgttgcccaggccggagtacaatgacgcgatctcaacttactgcaacctctgcctcctgggttcaagcaattctcctgcctcagcctcctgagtagcagaaattacaggcacgcaccaccacgcctggctagttttgtatttttagtagtagagttggggtttcaccatcttggccaggctggtcttgaactactgacctcaggtgatctgccagcctcagcttcccaaagtgctgggattacaggcatgaaccacccacgcccggccaatattctttttttttttttttttaattgaggcagagtctcgctctgtcgcctaggctggagtgcagtggcatgatctcggctcactgcaagctccgcctcccgggttcacgccactctcctgcctcagtctcccgagtagctgggatgacaggcgcccgccactacgcccggctaatttttttgtatttttagtagagacagggtttcaccgtgttagccaggatggtcttgatctcctgacctcgtgatccgcctgtctcggcctcccaaagtgctgggattacaggcatgagccactgccggccaatattcttaaaacaatagagtattgacacatttaatagatgtgttgggaaatggctatatttatgtatatttgtatcttcattcttccccaaagttcatttggtatattgccataaaatacataaacaatatggttgagaaagagaagtaaatcaatctcaagcaatgttattgtctttcaagtagcagcaatagctgtatttacggcagaaggggcaaaatgcttcctagatactaatgctcagattcagtgctggaatatggggagctggaaaatgagttaacattgccggctctggatggaaacagattatgaggtgccatatattggtgtatggccctcttagctgtgtagaaaagccatgagttattgccgaaattaatgccttgccagtgagatgatggtcattcacagagctaaacccagaactttccagtttgtttctgccctgagaaaactggctctgtgttattttatgcctctcaccaacccaaataacagaaatttttcgatgctcttcccctggaattaatgtgaaaatggtgaagaagagaaaactggcagacagtgctgagacactcctactgcattgcacattttggttgtagtgataggagcgagggcccctctggcaggcaggcaagcaggagcaagcgacagatcttgtgtgagcccgggcattgctctgagcccagggtttaccctcaagaggctttctttggaactgacaacacattccgtagagcacaagttccaactccctcctccacgcttcacgttactgtttgcaaactccacatattccaaagtcttgttttgtgtaaacagctagggaaaaaacacagaagcactcggcttccatcctcatgtcaggcagcagtccttgtctacacaggcttcatccttccctgctctagtggggagtaggacagagggcccccacggccctttccagatacagtgattccaggttcagtgattccaatggtggctgagattgcatacacgggaaagctgccctaaaaagaaagttactcattaaatcggattactccaatgctgcccccttcactaaggaaccccagcctccaatttctcccatgctcaaggcccctatccattgccctcccacatgtaccctgacacaaatagcactactctcagtttctcttcccgaggttaagttgaagtctgccctcttcctttcatcatgttctcctctgtcccctagtctgtccttgcaactcatggctaaagtgaggtacatatggcaggtacaggagctgcccagccattgatgcaaaatgggttaaactgatcctgaacatgctagggttggcttctctgtcttcagtatgacttgagaagtcccagagcagaaggtatgccaatgaaaatggagcaggccttgctaagagagcttgcagggacactggtatggacgctctctgtgactggacagaggtgatgctgagcctggactggagcccaaacctaggctccaactgggcccagggtgggccagcccagtagctctctggttctgctgctttccacacttaggggttctattgttccaagacatagaagaacagtggctgcatccctggtggctttgatcttgctgcctgcaggcaggggcggagggtgtggggaaggcaggatgagacttctgtgtgggtgtgtgggggcacaggatgagtctccagtgggggcatgagaccaacgtggggcagggctggatgggctgttcttggtgtgaactgtgctacagtgtggccttggcctgctctctcctcccatctctcctcccttagcctctcagtctcaccccacaaatctccctccctgctggcactgcaaatgaaatgcatggaggaggtggcatcagcagcagcatctaaatggccaagagcagccttagatctgaggacttgggacccccaggcttcactgacaagtaaagtacacaagagaccaggccacataagctgcagccctgccctcttctgctaaatgccttcaccttcattgccatttccatacctagggaagagccctgggggttatcatgcttccttcgtgctgtgccctttctccacattcatttcttcatccatccaacaaatagctttcttacataaactgtgagggacaaaagttgttgagaagacagtccctggcatccagggatttggtgtctgatgaaagagatagacatgtaaacaattgctgcaaggagataagagccctgctacaagcctgctggaggtaccgtgggaatgcgggaggggaggggaggggccgggctctgcctgtgggggtgggaaagacgaaacagcaacacaattccagtcacatctcgggtgcccagaagcggctgcaggcgtgaagacagaggagggtgtaaatgtcacacaggtgagggagggggaacggagctgtgctggtgcctatcatcgtggaacaagctctcttatggcttcccctgtaactccacctctactcccaccacgccaccatccctggtcctggctgtgagctgtatttagaaaggccctgtatttccaggctgtgggcagtcatttggggtcgttttgggtttgtgttcctagcagcaggatgtctggatcacaaaagcagtgatcccactaaaacctctctggcctgcatccatggaagatgtgttcactgctggccatctgtttgagtggggcactgaacaaaaggctatgtataaagttattcctcccagaattacctatgatagcaaaaattggaagcaatcaaaatgttcaaaaatagataaatggaagactggctcaataacttagagtatactgttatgatgtaacatcatgcaaccctctaagaactgggctaaataattttgagtgatataggaagtaggataaagaattagtataagctccagtatgttaaatgtatactccctctctctatgtatatttgtgggtatatatatatttgcatagaaaaaagacaggaaggtgccaggcacggtggctcacacctataatcccagaactttgggaggccaaggtgggcaggactcacttgaggtcaggattcaagagcagcctggccaacatggtgaaaccccatatctactaaaaatagaaaaattagccaggtgtggtggcacatgcctgtagtcccagcttctccgcaggctgagacaggagaattgcctgaacccgggaggcagaggtttcagtgagccgagattgcaccactgcactccagcctgggtgacagagcaagactgtctcaaaaaaaaaattaaaataaataaataagaaaaaaagataggaagaaaatacgccaaaatgtgaagtgtggttatgagcaaatttaatttgtttttacatttttatgtattttccaaagatttgataatgagtatgttttacttgtataatgagtcaaaacaaaaatggggatggtgttcatttttgtgttttaaatgtggattgagcatctagagaaaagtgacaaggatggtgagatgttagacattgtgtcattagactatctgaaggaggacacggcagttttcctttttaaaaaactccattagttatggttcaaaggaagtcccatggctagtggagaagtctggttctgggtttattgagcacaaaactgtaaaccacaaatgagtgtactatcacgtggattgtagctcaatagaagaggtcattaatctcggcgctaacaaccccatggctgtgtccagaggccctgagctccctgaccctaggagagtcctgcagaggttatgtaggagccatctctaagagttcctaagaggggccctccaactctagcacgttgtgattttttttcaatacagatcctttgctggccatcctgatcatgcaagccttctcatttcccaccatctatcacccattgatacaacactctcatcagttaatatcagcttcccatctttatatataaacatgcagccattgacggggtgacagcctatctgcaggatatccaggaggaagtagacagtcaggaagagaaagggagtaaaagccagaagcaagctgatttgtgagccctgccttttcctcgccattgttcagacaagcccattcctgactcagaatagtggaactagtcattggcctctcaaatcatcaacgcatctctattgatcatcttgtgctgacggctcaatggtcagtgtgtgggcaacagtaaggtgattaagaaggaggtgctggcccccaagtaacttacaaacaagagtagaaaacaagtggccgggtgcagtggctcacgccgtaatcccagctccttggggaggctgaggcaggcagattatctgaggtcaggagttcgagaccagcctggccaacatggcgaaaccccgtctctactaaaaatacaaaaattagctgagtgtggtggcaggtgcctctaatcccagctactcaggaggctgaggtaggagaattgcttgaacctgggaggtggaggttgcagtgagccaagatctcaccactgcactccagcctgggcaacagagcaagactctgtctcaaaaaaaaaaaaaaaaaaaaaaaaaaaaaggagtagaaaacaagcatgtaaagagcagaactggaggagacgggcaaaataagagcaccagcaatgttcaaggcatcacaatgacatggccctaactgtgctaaagagtcagaaggtgcggggctccagtggaaaacacagtggattcaggaccagaaaaacaaaaatggagaattagaagggtattcctggctggagctgtagtatgctgaaaggcgtggtgatggctgggtgcagtggctcacacctgtaaccctggttctttgagaggccaagatgagaggatcacttgaggccaggaatttgagaccagcctgggccacatagtgagacaccatccctacaaaaaaaatttaaaaattagctaggcgtacacctgtaatcccagcactttgggaagcctaggcaggcagatcacaaggtcaggagatcgagaccatcctggctaacactgtgaaacctcgtctctactaaaaatacaaaaaaaaattagctggccatggtggcgggcacctgtagtcccagctactcgggaggctgaggcaggagaatggcgtgaacctgggaggcgaagcttgcagtgagccgagatcgcgccactgcactccagcctgggcgacaaagtgagactccgtctcaaaaaaaattagctaggcgtgatggtgtgcacctgtagtcccagctacttaggaggctgaggcaggaggactgcttgagcccaggagtttgaggctgcagtaagccataatcattctgttgcactccagcttgtgtgacagaacaggacactgtctctaaaaatactaataaaagaaattagctgagcatggtggcgcatgcttgtagtcttagctattcggaaggctgaggtgggagactcacttgagcccaggagtttgaggctgtagcatgctatgatcataacactgcactccagcctcagcaacagagtgagatcctgtcacaagaaaaaaaaaaggcacagtgagaacacacagcatctgaatgtggagtggcatgatgctgctagaatggaaggttggtggagtttaccatgggaaagggagttggaatgagaggttggagccaagttagggagtgtgggcctgatcctagggtgtttgagagtcagtgaagatttctgagtgcaagaggacattgacctgcagcagtggtaagaaagatgaatgagagactggagagacacaagtctgggattcctgtaagaggctattggaaaagacgctggagctctgaaccagggcactcctggtaggagtgggaataagatcacgggcttgagagacatcctagagacagagttggctgaatttactactgagaaggactggaggacagtaggagggagaggaggagaaaacttgggtgttgttgaagataccatggccctaccttttgcagaccaccatattcatgcctcaatgctgggaacttccctgggctccgtttcctgtgccccatagctctggctgcttggtctctgagtttttcttgtcttagtaactgagctacttcacttctggccttggcacatgatcacagtgttgaactgttctctctcaaggaacactcttgtcccttccagccagcctgcaagctcctcgatgaaagacccagggtgcatgttggtgcccagcaggtgtatacctgtcaaagcactaaactgatttgtgtggcttgaaggcgtttactggtaacctgacctccttccctccctcccctgcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaaggtatgcctagactccacctcctggggagtctttttcagctcccagattctggctccacccgtcctggggtttggctccaatcagatacatgggagggagttaggcaccaacagggagagaagggcgagggtcagacccatggggttggaggtgggtgggcggctcctcagctctgcccgcagtacctggccattgtctctcacagccggacacagcctggagctgattgagcccctcatcaagttccaggtgggactgaagaagctgaacttgcatgaggaggagcatgtcctgctcatggccatctgcatcgtctccccaggtatggggccaggcagggaggagctcagggacctggggagcggggagtatgaaggacaaagacctgctgagggccagctgggcaacctgaagggagacgtagcaaaaggagacacagataaggaaatacctactttgctggtttgcagagcccctgtggtgtgtggacgctgaggtgcccctcactgcccttagctctgccttgcagagtgtgcaggcgattcgtaggggggattctgaggaactagataagcagggttcctggggccacagacaggcctgcgcattcccaatactcaggctctgctcttgcgtgaactgggctcaacattcctgttatttgaggtttcttgcgggcagggtacaaaactttggagcctgagagatggttctgcctatatagtttacctgattgattttggaggcaatgtgcagtgacccttgacctcttccgctggttagaggtgagaagagggagaaaaggccgaagaggaagttattgtgaccttggggacatgatgtcggtgatgaggtccaaagaggggcggccctgcctcagcctgtgctagtggcctgtgcccagggatgctttcctggactggaggctcaaggaatggagatgggctcctctacccctgcccagccagccttctctcattcattcatccacttagcaacaatttattgagcacctattaggtaccaggcactatgctaggtactggggttcagcagcaaatgggacacaggctcctctcccatgaagcttaggaggaaacattaaacaaatgttatttaattattaattcctaacaaggcaagagttttaaaaataaagtaagtgatgctacagaagggtagaatagaaggagggaagctgacgtggtctgggctacagaggtagagtgttgccaggaatggccttttggaggaagaccttttaagctgttatccaaaggatcagtaagagtctggcaaagatagcagagcagagttccaagcagagggagcacagatgtgaaggctggtggccagagagcatggcgcatcgggacgctgagggatggacagagcatggacagggagcaaggccaggcagggacagggccaggtgcgcccatggaaggacctaggtctggatcctaaatgcacggagaagtcactggagggctttggggccaggcagtggtatcaccggtcagcagtcatagaggggtggcctagggggtgctgccgttgagtgtctgtgtgggtggggggtggtgggattgagccagtgaggggcccagctgagagctcctgtgccttcttctctatccccgtgcccacagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaatttgccttatccttataaggaccttatgggagatgaatcattattacccccatttgacagaaaggatagcttgagcaatgccacactagcaagggatgggatttgaaccttcagcagctaggttcagaagccacaaattaactgctacattgtcctgcttcctattgagttgggggacctgacagacgactgatggtcttgctagctctctcctagagaggagataaaagaggttcccattcctaaagcaggccctgagccaggaaaattagaggtgctggaccaaactgtgctctactcccaggaagtgtgcagtcaatatatgacacctacgtgagaccctcaaaaatgaaaaccaaacagctactggcaaaactgtgtctgccattagagatggcggctgtgccagtgacctggaggattacaaatgactgctgtgcagaaacaggactcctaaggggcccaacttatgccgatgcactccattctgcttcccaaggaagtggggtttatgatgaagggtagcattgctaggcacagtaaacaagaacacagcattgtgatctgaaaataaggaaatcatgccagctaatgtattgattgaggataagttggcctggggatgtgattcactctaatttttcagaaacatctgaaaatatttcaaaccaaaggctaaaatgtgtttcagtgggatgagatggacttaggggaattggggttagaacttgagggttattttgtgaaacatgaagggacttagagaaaggaaatcaacagctgcataaatgggcatgtctctggctggagaaatgtggagaatggagttctgatacactgttagaaggatcttatgtagcatttttatagctgacctagaagaacacaaaatttccaaggctgtgttataatgcgcttttccaggtaaaccaagaggaatataccccaggaaggttgcataattaggatcaagtgttttcaagttttcatattccaagctttggttctatgcctacactgttcaatccagtagccactagctacatgtgagtatttaaatgaaataaaggtaaacatctagcttgtcaaccgcacaagccacagttccagtatttgataacctcagggctaccgtaagagacagtgcaaatacacaacattttcttccttttttctttcttctttctttcttttttctttcttttttcttcttttttttttttgagacagagtcttgctctgtcacccaggctggagtgcagtggcacaatctcggctcactgcaacctctgcctcccagtttcaaaccattctcctgcctcagcctcatgagtagctgggattacaggcacctgacaccatgcctggctaagttttgtatttttagtagagacagggtttcaccatgttgtccaggctggtcttgaactcctgacctcaagttatctgcccgcctcagcctcccaaagtgctgggattacaagcgtgacattttcatcatcgcagaatagtctatggggcagcactggtctacacaatgcattcttatctggtactaattgtgaatgactccatgaggatgctggcgtcatgtgcttctgttgatctgtagggcagaatggccactaacttgacatcatatggaagtgctatagggaacatcctccccttacaatgggctatgccacacctggggtagttcgaatgagtctgcttcttaaaagagacataaagcaaaaacactgcacagaccatggggttgataggctcaaagcatcatgtggtataaatagctcactggtgtgctaggagtattgattcctttagccctggagcaagcaaacagggcctgccaggagtgaccacagcccttcaatttccccagcttctaccaggctccttgcaggctgcctgtgcagtgcaggtcggtctgcctgccccatggtccctgcagatgacaagaaggatggatgctgtctgacacctccagcatggcca

SEQ ID NO: 11805 - DNA, 17645 bp, Human
cctgaaactgaccagagagctcctcatgtgggtcagtgtccctgccagggcatggggccaggggccaggggccaggggcatgagggagcctcccagagactggaatgctgagccagggctcctcagaggaaaggatgtagaggagggcccaggaagtagcccagtggggccagtttcctctcctggacagctaagaaagtacttatgaccttcggccacctgggctgtctgagcaggcagggcctgctggccaccaccgtcctgtacaggcacttaggggaatgaatcttccccacctgcagccccagcaaacacacaccaggctggtccctggcaattcaccccaagagccaggccacagctgggcagaggggtggccagtaacagctggtgtcattctctgcaggatagcccctggacaagaggcataagacccactcatccttgccctgccccaggcacacttagaaaagtcctctcaccgggcctcagtttcccacctataaatgggaagatgccaacacgcccgagtgggactgtggtggggcaggcaggaggtgggaggagagcccagatcatcccaggccttccctaggggacgcagggggaccctcccttctgggcctggttcttccagcacgttccatgcagcaggcaagagggccaggcccaggggttcctgacagcttgctggccctggagtccagattcttgtttgttggctggcgctaggcctctggattggagatgcccggggcacaggcggcccacggggatctgcagcagggcctcggcccctccctctgcaggggctcgtctggtccctcccgctctctgcctctcctcatttatctctccctttctgcttcttggctctgggtccagtcctatctcccctgtttcagtttgtcttttcctagccctttgcgctctctctgtctctctcagccctgcttgtctcactgtctctggctgggggatctgtctctttcacttccacttttgctctatttccctgctactgtctttcctttctccttgtctgtctcttctcctcccctcagccagcatctgtctgtctctgcctttctctcctgctccctccctccctcctctccagcaccttccaatgccaggtggggctgccattccttccaccttcccagtgacccgccagtgtgactgccttgagaggaaagtcctaaactgtccctatcttcaccagcctgccctcaaatcattggttcaaatcgctgtcgagaagtttgggagctcccagggcgggggctttctaacagctctgcctagctcgggcctgccctcaaccgcagcatgcagggcagccacagacaacctctctgcaacttctgatgcctccgtgcccccatccacagagccctggctctgggggactggggactctgggacatccctaacatggcatgcagtggcggtgcgggaggacttgactgcccctctggagccctgggcccggggactccaggccagtgcctctctgggtcgggatggggatgtcaggccagcaggatcatggtacctgcctccagggagggcaacgtccacccactgagtccagcccgcccaccccacccactccggagcacctggctctgccctcaggaactccctgagctttgcacacagggccgagacacctggatttctctggttccctgagtggggccagcttggaagaatttcccaaagcctattagagcaacggctgcctcctgcctgcctccttgggctgggcagggctgagggcggagggagagagagagagagggagggggagaggaggaaggaaaaagttggcaggccgacagcacagccgtgtctgcatccatccagaggaggtctgtgtggtgtggggcgggccaggagcgaagagaggccttcctccctttgtgctccccccgccccccggccctataaataggcccagcccaggctgtggctcagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacgtgagtggggtgtccctgggcttgggggggttctagaatgatgctgaaaggcactggttccatcctctgcccattgtgcagatggggacactgaggaacggagaggacaagaggttgctggaggtcacgtagagagctggggggaagagctggggctggaactcagctatgcatgcctcccaaagcctgttttctgccaggcactgtgggaagctgagatccagagaataatggtcttgccaatgtcccctgcagggcatctattatggggaataagcttggccagcagttcctcgccccttggctgtagctttttggcccttctcagtcctgcctgtgccgccagctccctcctcctgcagccctgcaccctggggaaactttgcccgctgtccccagccaccctgaaccaaatgcccagcctgtctgcagctggctctgcaagtgtgtgagcaggactccctcagggagccccccatattcacactagtttccaaataaaccacctctaggaatcaagagaaaggccctcttccactcttttgcccctgagattagacaaagataagggagtgaaaacactctctggggctgtttgaaggcagttttcctggattacagtatgggctggggggcaagcgctgggctccatggtctctaggcactgagaggtgtggcgtgtgtgtgcatgtgcgtgtgcgtgtgtgtgtgtgaaggtgtgtatgtgtgcatgtgtttgccagcatgagtctctgtgcttgtgtcaactgtgtgcatgtttgtgctgctgtgtaagggtgtgtgggggtgagtttgcaacacgtgcccatggctcctggcttgaatggggtctggactggggtcactaatgacaagcagatgctggtgactgggtggcagctgtggaaaagaatgtctcctgggctgcttagcatggcaaattggccctggtggcagctgcctgctgtcccagacacggcctttcccagctcctcagacaagtgcaaactcaggccgggcttgggccacagcaggggaggatttggcctgagagactggggaaggcttggaggatgtctctgagggcccaagggacaggtgagcaggcctgggggtgcccttacagggagggagagaagccaaggagcagagaggaggactcgtctagagagatgaggctggcggggctgtgggcagggcatgtgggtgtggggacggtgtgggccatctctgagggcgcctcagagatggcagatagtgattacagcagctgtcctctcgcttcccagccaaagttcagatcctgcggctggcagcccaggagaggctaggtgaaggtctggtgcagagggcagctggctcagcctggccatggggggcttagcacttctgtgtcacggtgacacctcacccaacctcctctgcagccaacctctgctaggcccaagattgaagattagctccgtgggctggagtttagactttagccagtttagacgtggccgcgggggatgtacgggacagagctcaggcaggccacatcaagctctgcccccccaggcctcagttgccagtgggtgcagagcttgtggcctcagggagttctgctgggtagggtcaagctcacactgaagcttggctgggtatgatgggctgggggagcgtccctgtaggggagtggatgtgatttccaggctttctggccccgtctcttccctcccatctcacagggcggagcctctgcacctgctggcgaaggcttcaccctctagtatgcgcatccgaggcagaggcgggagggtgggccccttctgtgccatctggaacagaggccacaccagcctcccgtgccccattccctccctggccttcattttttatagtcaccccaatacttgggctgggcgtgttgcaaatgggagagaaagaggagcagcctagtgtggggtccggccctgggctgagaggcagacacctgggttcaagacgtgtccactgctaacttgttgagcttctttggagctgcggaccctgaccctcgagagggaactcaggtcttgtgacctcacagccacacccagacagccagctcacttcattgctttgagcttatcacccatcccacgaaagctggctaagagcagcccagcaggggcagtgctgaacataagggcgcttagcatgatggtgggggctcaggcgctgtcctgtcccaacagtggaagggtggggttcaggacctcaactctgggcctagaaatagagaaggtacccctctaagggctcccgtcagacactggccctggaactggaggggcctcaggggtggcctggatgcctcaagaggagcagggaacagtctgggcagcaggtgacacactctctttcatgacctggggtaggctcctgcagcctctctggccctgagccccagcccagtcaaaacctgggtggggcaagtggttggcatggagatttccaaggaaaacagagaaagatgtggcaggaagtggttggggtgagtcagggggtgtcccttcgggacatgctggggacaactttctcctgactgactcagggctcaggatatgccctagagagaccgtgggcctccgtccagcctgcaaggtcccggctagttctaagagccaaataccaattttggctaagggtgagaggctctgaggctggggtggacactctcacctgtccctgtcctagctcagccactaacaccatgtggcatcacacaacagactggcctgtgtggccctagttcctgtctatgagatagggacatagcagggtgtggctgggctctgagaagtaggagatgctggtggactcaggattcctggcatttgctggcttttttcattcttctgctgtctggtctgctcagccggctccctgcaagcatgaccagggactgctgggtgctcaatgcagggctgggttagcccggctccctcccgagagaagcccacagccctaggtcaagataagccagtgcccagctgcctgtgatatgaagcaggaggcagatgcgataagaggtgtcagggcgggcccgggaacttttgaacttaaggggtgggagggccaggaaggcatcagggaggaggtttcgtaggagcctgaatgtggagacactgcagagggaaggggcagagggactgtgtgagcaagcacaggctaggaggaggtgagggccgtggtacgggagttgttgggtatggtcaggctgggggtgcatgggaggagggtggtgagggctcaggattcgggccaggggctgcatccgggggaaggggtctggattcccagagcctgtgatttcagcccgctgggctcaggcagagggcaaagctaccctcttcggggtcttctcccagccctgctaattccaggcctgactgctcaagaagtgtttctacctgcagcatcaggggcctgactgaagccctaagttctcccctttatcccgtttttctgggcttcagtttccccagtcatagagtgagaggcctcttcatgccaccagttctcccgggggtgctgctgcctcctccagagctcaggggagggatggggaaaggaaggcagagtttccatgtccctgcccagcccgtcctgcccagggaggggctgggggctgggtggtgatgccacatctgggacatataattactgtttccgccagccccagatgagggggagggcacagagatggggagctttgtggtggagacttccctcaccatggaaaatcctgacgctgcttcccctttagggacctcagaacagcccagccggtcccagtgttgcccaccctgatgcttggccctgactgggatttgccctgggaactctgaaggggccatgctttgagaggggacacggcctcctgggatacctgtctgaggggctcaccccctgctcaccactcccaggccacagcctcctgtcacaccttgccttcccttctccaccccaggcaaccttctagcagcatgaagtggccattagctcactgcaagccaattccagatggtacccccacttagtctagggcccccacccagcaggggccatggcccttaccttctggaagcaccaatgagtctggagtctcctgagtggctgggatctgagccctcacaccgggaggtgaaggcaggaaaatgctgtccgcgaggccctgcaagtggccaggatcccctcagtcagggcttccccatggggatgagaggggctccttgcccacatggagtggtgcccagggggatcatgaggggctgtcttcactcagccaggagctacagttctgtggggtgggcagactctgaggctgaaatctccaacttaaaagatatccggaaaggccggaaaatgcccccggcccttccagcagctcctttcagtgcctgcaatctcgctgtcagggccccttgaaaggcagatttctactcagtgtaaagaaggttgttgttgatattgttgttgacacgaagaaggggctgtctctaagtcaataagctccctgccattaggggtgtgcaagtagatgctttctggtgaggaggctgctttgggggtgctagtctatgcgggggtccagtggggtgggtgacaggttctgcagcataggctttgtgtcatgctgagatcagcaattctgatggcctgcgggggatcctgtgcttaggtttctggatctggggctggagagtgaccaccccgatgtgaggcaggaggcacttttggagactgcgggggctcgaatctgggccaaggcctccattttactgatggggaaactgaagcccacagaggcgtggagacttgtcaaggtggcactgcctcctagcccttgattattcctgctgctccaaagtgtacacacatggcacaaacacaaacatgcacacacatgtgctcttacgtggaggacacacacacatggtacacaaagcacattctcaagactgggtggtcccactcagactctgggacccaaggagggttgggcggggattcctcaatggagccttttcctctccctgccctggagttaggaaaagaaggagggagggagggaggaagccattgctttgtgtattgtttcttgtcaggaagatgaaatggcttctgggagcaaataaaggccttgttgagacctgctgctttctcacatggggggctcatttttttctcttctcttccctctctagctggtagtggcagctatgtgggtgtgtgacacagggagacagtgaggcacccagaagtgccatcagacataccagtgcaaacacacagcacagcctccaggacctcatgtcctgcagggatgcctgtatgatatagctgttcccagggaggccgaggcacttggtcagtacctcatcagttgatgaaaaagagtgtgcattctctaattcaggggtacagggttttcatatttttctgaagtcaagcttgttaattatggggttcaaaccctccctgatcatgttattggtagttttcggctgcttcatttattctgtacatttctaatagaagattgttaacatttttcactctggtggtagggtgatccagtcctccttgtaattttgtcaattttcccctcatttatttttaggctatgttgtttggtgcatacaagtgggggatttttgcagttcctttatagatttttatttttttttttgagacggagtctcactctgtcgcccaggctggagtgcagtggcaccatctcggctcactgcaagttctgcctcccgggtttatgccattctcccacctcagcctcccgagtagctgggaccacaggccaccacacccggctaattttgtttttgtatttttagtagagacggggtttaaccgtgttagccaggatggtctcgatctcctgaccttgtgatccacccgccttggcttctcagagtgctgggattacaggcgtgagccaccgcgcctggccagttcttttatagatttttaaaatgtaattattgtgtaataaaccacttacaatctaacaaaaaagagaaagagggagtcagccctggacacatgtggtcatcacagacacagcagacacttatctacaaagacacacagaggcacacaaaaccaggaatccccccatgtccacgtgtgaacacccatggaggagtgacactctggagcccacataggtcccctcactgcccagtgctgagtcttggaggcactggggtgggcagggcaggcctcgatgtctcctatcccttgagaacgaaagctcagagcctcagtcaggcctggctctggagcctgctcttccccaaggccagggcaccagggtgcccaggccaagtcaggggccccatgccttggaagccaccctggttggcctgtctatgggtagcagggagtgcttagagcacattgcctggagagatcatccctgggctgccctagagccaggacacactggcagccacagaaccaccttctgccagctcccaagtccaagctgggaatagccaggtcccttgactgggcctaggagtggccagcccattgacctgtgagtgtagggtggcacagactatggggcaaggatcctggctttgctgcatcctccctgggcctcagcctctgcgtcatcatctcactgagccatcgcacaggctgccctctagggctcccagaggctaatgattggcccattgtttcccagctagaaagtgaagaagaccgccctgggtccggagagcatctctggagccaggctgcccctagcaagggtgggagttctagaaaattagcattctctgccacttctatcagcacacagtaagcctcccctcagaggcgtgggcagagaaatggcagaggtcccccactctgtcttcaccgagctcccaggccaggaggagatgcacccacataggccgcaggaagattgatttcctacaagatgcacagagaattcagtgagggcatggtgggtgggagcagaagttaattccagccagggatctgggaaggcttctaggagctggtggggtctgaactgggccttgagtagtgggcttacaagggcttagcacaaaatggagagcttgtatctttctgacacttcagaagaaatgtgtggattattctttcggtaatacttgcattcacaaaacccagggctgcagacaaaagcgggaagacaattgagaattgagaattgagaattgttctgattcttacttttttttttttttttttgccttaataagacctgggccaggcaaaactacctggggatgtgcaaatatatatgtacatatatataaaacaagtgactacaatgggaactgtccttgtttaagcaagttttcaaatttaatgggttgtaaacagtaacgtacatttgaagtattttacctgctctttcctggacattgagtttcaacaggcctttgagtgccccttccaattctgaattatcaagtgtttccagatgtaaataatgcaagtgtattagatagttgaaggaaggttgtcagtagatgttgaagctatcaggggaggcttcctggtggtagtggtagtgggtattggagaggaaggctgtcagcccatgtggttctcagcagtcacgaaggcacattccagaattcccagggcaggtggctgacccctccccttcccaaggactcagagtacagggcctggaactatcaccctctgctctgcccactttgcatgaaaagcatgttgtctttgggtaggggctggggctctcgcacctggttaagaaccagaggagatgagctctttctggtcacatctgtgagggatggggctgggagggttctccaaggcgggagccacttacagcgatgactccattaatcatcggggaagggctggtttcaggacttctgccagctagcaattaggccaaccctggagagcagaagagagaggaatagaaggagccacgagcttcctgagggctcagatacagagggacaggggcctcacaggtgcaagtgtgggtgggcatcaggactagccgggctggcctcaccagcctcaaccccattcagcctgtcctaactctgggcaggcttctgccagcagctccacccgccgtcactccttctgcctgtccccagatcctgcacacacaatgagaagaaccaaaacaagagtcactaccactgccccatccctcctgcgtcgacaactctttccaaaagccctgagacggcccctttggcctttgaacctcccagctgctctggagagcaggcacggacaatgagatccattttgcagatgggaagactgaagaccagagggaataggccatgctcatggtgccagaaagtagaagagtcagaacctgaacacagggcttctgcctctttggcccaaccttgggacagaaagggaactgggcattggccagagggctggcggacctaagggatgtagccctggggtccgccaggaaaggcccaaagctggggctgcaaggcaggggaggggatgtgagtcattccctgtaacccagggctgcagacaaaggcgggaagagaattgttcttgtaggatggcctcagggtggggctgggaaaacctccaaggtgtgcccccctaccttggattttgcaaaattctctatggccttggagacactcccatatcctgaggatgggagctgggtagtttgtctcccagctgggaagtgtttgggtgcaccagccctgcctgggagaaggcagcctaagtggcctcaagtgggcatctttgcaagtgagcctttgctgatgtggtccatctcccctgtgtgagtgcacttagcccctgggacggccacaaagcatagtggaaggtgctggggcttcctggggaggggtcctccgggggcagctgcatggggagggccttcatgacctcacagcagcttccattcccttctctttccatgagtcatgtttctaaaagtggcccaggagtaagtggcagccagacggtggtggcggggcctatctggccaggcagagggagggtgaggctgaggccagcagtggggaggaagaagagagaaggagagacagggagggcagggccagaagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctaggagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcaggtattaggggctgggctggagtttcattaacacagggggtgggttcaaggcctgatttccactacctgccgtgtaggcttgcctgggaccctgtgatgggctctgaaggcccatctgagggtccgcccttcatgcctgggcctgggaggcctgggtatccttggggtcctgggacacagtccctgcctaccctcctcaccagtcctcaccacctctctcccctgcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctgtgagtcaggggccctcccagatggaggtgggggaagggagggcgggggctggtggggtgccctgccatgggcagccagtgggactcccgacagggctcttgccattgggtggaggatggcgggtcagcgctgggggctgggggcagggtcctgccctggagaggagcacagggacctcctgcccagcttggggtcagcactcctctttccctgggtctcattgtcccccaccctgattgttctctttctccctccaacctctccctcctctcactctctcttcacctatgactctctgccttcgcccctccctctgtttctttccctcacagattgactacactggctgtgggattaaccctgctcggtcctttggctccgcggtgatcacacacaacttcagcaaccactgggtaggagacccacggggggtggggtgggaagctttggtgtcccatggtaagcctgaccccaccctcacagtgtcccttcctgttctggaggctctgggagacagccagaggacaggaaatcaggaaactgaggcctgccatgtagaggcaggctgggggtcacactgccagcactttcaggcctagtctctgccctcccagctcggccctgccccatgctgcctggcctccaggtcttcccagctgcgtggttaaaagtggggctccaaatcctggctcagccactttcgggtttagcatgaccttgcgcagtgtgcttgagctttggtttcctgagctgcggagggggatatggtggtgcccacctctcagggtggccgagaagaggaaagggctcactccccatctgtaaactgagctcaacacagaggaggcgctcagtggattttagctcttatggttgtggatgtggatgtgctaggccagctttgcattagacaatggtctctggggcccttccaaagctgggagtgtgggggcagtggccttcctcaagaaggggctgctactgcccatgcctgagctgggccccacagaggcaaggagttgaccctaccacgtactctggcctgggccggttctgaggggcaccggaatcatgatgttaggatttggctctcctacctgcctccatcccaggtgggaaaaacctgtccaacggggtggtgggctgtggggtaacctagggaacgcttcccaggggcttttgagtggagccctctgaacacacctgctctgttcctagattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtccttcaggcttcctgtagtttttcttcttttgatgctgtgtccccacaaatgtttctggattactccacaaggaaatcaggccactgctagagacccagtctgaggaggagccactgcctccccttctgccttcaagacccctgatctcaggcaatggatacagccacaccacagaaccccatctgagggacacagggtcctgcccctagtaggagacttccagagcccagtgggatgactttggagacctgggggcagggaaaaggggcaggcttctgatcagtttaaatggaccgatgggagccatttctgattccggagtatggaagggatgggggaaagcagggctgaagtctaacagccccctcatcccctctaccctccacagagcagggcccagggaacactagggattgctccaccttcctccctccctccactcacatttgcaacccatctgacctgggctgggcgtctcatgggagacagactcactcatcagagcccagtgcagttagggctacttcaggctgagactgggaccctggctcctgaccctcccgacgtgcacacacacttagtagtgcctgataatagggaacaggtatcaccacggcagtgggctgaggcaggaaatagtgtatggacaggtcctggggccccagcactgctcctgggagacacatggttcctgtcccctctgtggaatgcctggctgatggtgatataaggggggctgggtctcagggagccaggggctaggcatccgcaatgaagactgaggccatgttgatggaacagggtttctaatttaagtgtgccctgggtcactaggctgtctaagtccctgcaaatcagtgcatcacatctgcacactcttttccgttcccttgcaagaacttctagcccatttaatagataaggaagcttatctcccagcttaagaggggcatataaatggcagagtgccagccaagctatgggaattgggtatgggccagcccgctgcatcccaggcctgcctgtgagggtgtgccgaggctatctctcacagcccttctcagcttgtctccttaatttgtcccattcttcttggcctgaagccctcccaatcaccactatgggcccagccacgccacctcaactcctactcattcacttctacccccacccccatttcacccccgctccatggcacagccttctttagtgtattgcttagatatgacttttagaatcctagagccacgaggcagggcctgaataagccattagggaactggtatttcttgagcacttaccatgtgtgaagaatctctctgagattttgcatacattcgctctaatctttacaacatccttagaaggtagagatacgtgtccccatttgtagaagacgccagggcccctgaagatgaaatgatttgccgtaggccacacagcaggttggtggcagaattgggatttgaacctattctgcttggcttcaaagatcaggctctttgcacgatgtggtctgggccggttttgtcatgattcctgctaagttaagctctgggctagccaggaagccggactgcatgaagaaggcagccactcctgcagagtgggcatggggagggggaagggaggagaagggccagccacagagccatctggcatctggagaagcctgttcattccagggctaactggacgtggtgtcacccaaacctccctgctgccttccacggcctgactctccccctccttgggaggaaagtgtctgaggaccatgttcacccagcagaatacctgagaaggggaagggcaatgctgcaccatgagggataataatgcactaagacaggccctcagctacccatcaggccagggggcaacagctttgggctaaagggatcctagactcctcctcaccttccagcctgtgggtttagtgctccaggcaccccatctctttggggctacccctgactctgatcttctcatcttctatacag

SEQ ID NO: 11806 - DNA, 13607 bp, Human
gtactgaattaggggaacatggtttctttttggggagatagaaatgtaaaattttggtaatggttgcacatctctgtaaatatactaaaatccattaatttttgcattttattttatttattttatttttgagacggagtttcgctcttgttgcccaggctggagtgcaatggcatgatctcggctcaccacaacctccgcctcccaggttcaagcgattctcctgtctcagcttcccgagtagctggaattacaggtgcatgccaccacacccagctaattttttttttttgagatgaagtcttgctcttgtctcccatgctggagtgtgatggcacgatcttagctcactgcaacctacgcctcccgggttcaagcgattctcctgcctcagcctctaatgtagctgggattacagttgcctgctatcacgcccggctaatttttgtatttttagtaaagacggggtttcaccatgttggccaggctggtctcgaacccctgatctcaggtgatctgccttcctcggccgcccaaagtgctgggattacaagcgtgagccactgagccgggccaatttttgcattttacatagatgaattatatggtatgctaattatatcttaccaaaaattgaaaaaaaggaatagtactatcagccccaatgtgcccatcatcaatattctacatgtttccaatgttattgtatctgtttgcctacagtcgaggccctgatatcctgtttgattttcttgaattgccaaaatttgcatacatgcttacaaaaataatgcctgttgaatttgctagatatgtaaaggtttggagcaaatcaggtgtattaaatttattaatattgtttgaaatgtctaaggcaataattcccaaacttcgttgagggagaaggaaagcttttaaaatcccattgcccaggtggcatcccatactgttactgggaattatgcattgggatggatcctttaaccgaggagattattatagccggagctctgaaccagcaatctcagttcttgtgatagtgagcaaagaactacaaactaacaccaaaatgcaagcttaaagcaaagtttattgaagcacaataatacactctgagggacagcgggcttatttctgcgaagtgaactcagcacttctttacagagctcaaggtgcttttatggggtttgtggggaggagttgaggtttgggctgtatctgagtgacaggatgatgttatttgattgaagtgtatagctatacaatctaaaattaaactgtgcatggtcttacctataatttgttaagaaaagcctcccagggatgggggggcaaaactgtatgtaaattctattataatgatggcatgatgaacttggggtgaacttgaagacaggcttttgtgttgttgggcatgtgccaccttagggaatttccacctgtaccctcctttctctttctccaggatattttggccacagactttatcataaactccatcccttagggtggcattagggtagtcttgggcctgaatttaggtgggccagtggctgtcttagtgacagcctttccgctctcttctgtcatcccctcccaactgctaatgtctaactacctaacaattacccattaaatcagtgtgtctggggttaggagcaggcctcaatatgtttaatcattctccagataatcccaatactgtaaagtttgtgaaacacttgtcagataattcaattatgaaggctgtggaaggtgtttcagtaggatctaattggttaatgttatgacttaattaatttgaatcaaaaaacaaaatgaaaaagctttatatttctaagtcaaataagacataagttggtctaaggttgagataaaatttttaaatgtatgattgaattttgaaaatcataaatatttaaatatctaaagttcagatcagaacattgcgaagctactttccccaatcaacaacaccccttcaggatttaaaaaccaagggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttgagctgagctaagcctggggctccttgaacctggaactcgggtttatttccaatgtcagctgtgcagttttttccccagtcatctccaaacaggaagttcttccctgagtgcttgccgagaaggctgagcaaacccacagcaggatccgcacggggtttccacctcagaacgaatgcgttgggcggtgggggcgcgaaagagtggcgttggggatctgaattcttcaccattccacccacttttggtgagacctggggtggaggtctctagggtgggaggctcctgagagaggcctacctcgggcctttccccactcttggcaattgttcttttgcctggaaaattaagtatatgttagttttgaacgtttgaactgaacaattctcttttcggctaggctttattgatttgcaatgtgctgtgtaattaagaggcctctctacaaagtactgataatgaacatgtaagcaatgcactcacttctaagttacattcatatctgatcttatttgattttcactaggcatagggaggtaggagctaataatacgtttattttactagaagttaactggaattcagattatataactcttttcaggttacaaagaacataaataatctggttttctgatgttatttcaagtactacagctgcttctaatcttagttgacagtgattttgccctgtagtgtagcacagtgttctgtgggtcacacgccggcctcagcacagcactttgagttttggtactacgtgtatccacattttacacatgacaagaatgaggcatggcacggcctgcttcctggcaaatttattcaatggtacactgggctttggtggcagagctcatgtctccacttcatagctatgattcttaaacatcacactgcattagaggttgaataataaaatttcatgttgagcagaaatattcattgtttacaagtgtaaatgagtcccagccatgtgttgcactgttcaagccccaagggagagagcagggaaacaagtctttaccctttgatattttgcattctagtgggagagatgacaataagcaaatgagcagaaagatatacaacatcaggaaatcatgggtgttgtgagaagcagagaagtcagggcaagtcactctggggctgacacttgagcagagacatgaaggaaataagaatgatattgactgggagcagtatttcccaggcaaactgagtgggcctggcaagttggattaaaaagcgggttttctcagcactactcatgtgtgtgtgtgtgggggggggggcggcgtgggggtgggaagggggactaccatctgcatgtaggatgtctagcagtatcctgtcctccctactcactaggtgctaggagcactcccccagtcttgacaaccaaaaatgtctctaaactttgccacatgtcacctagtagacaaactcctggttaagaagctcgggttgaaaaaaataaacaagtagtgctggggagtagaggccaagaagtaggtaatgggctcagaagaggagccacaaacaaggttgtgcaggcgcctgtaggctgtggtgtgaattctagccaaggagtaacagtgatctgtcacaggcttttaaaagattgctctggctgctatgtggaaagcagaatgaagggagcaacagtaaaagcagggagcccagccaggaagctgttacacagtccaggcaagaggtagtggagtgggctgggtgggaacagaaaagggagtgacaaaccattgtctcctgaatatattctgaaggaagttgctgaaggattctatgttgtgtgagagaaagagaagaattggctgggtgtagtagctcatgccaaggaggaggccaaggagagcagattcctgagctcaggagttcaagaccagcctgggcaacacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagaggaaagagcagtttggggtaaatcaaggatctgcatttggacatgttaagtttgagattccagtcaggcttccaagtggtgaggccacataggcagttcagtgtaagaattcaggaccaaggctgggcacggtggctcacttctgtaatcccagcactttggtggctgaggcaggtagatcatttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactcctgagttcaactaccatggctagacacaccttaacattttctagaatccaccagctttagtggagtctgtctaatcatgagtattggaataggatctgggggcagtgagggggtggcagccacgtgtggcagagaaaagcacacaaggaaagagcacccaggactgtcatatggaagaaagacaggactgcaactcacccttcacaaaatgaggaccagacacagctgatggtatgagttgatgcaggtgtgtggagcctcaacatcctgctcccctcctactacacatggttaaggcctgttgctctgtctccaggttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtatgtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaaggtatggtggaaacacacttctgcccctatactctagtggcagagtggaggaggttgcagggcacggaatccctggttggagtttcagaggtggctgaggctgtgtgcctctccaaattctgggaagggactttctcaatcctagagtctctaccttataattgagatgtatgagacagccacaagtcatgggtttaatttcttttctccatgcatatggctcaaagggaagtgtctatggcccttgctttttatttaaccaataatcttttgtatatttatacctgttaaaaattcagaaatgtcaaggccgggcacggtggctcacccctgtaatcccagcactttgggaggccgaggcgggtggtcacaaggtcaggagtttgagaccagcctgaccaacatggtgaaacccgtctctaaaaaaatacaaaaattagctggtcacagtcatgcgcacctgtagtcccagctaattggaaggctgaggcaggagcatcgcttgaacctgggaagcggaagttgcactgagccaagatcgcgccactgcactccagcctaggcagcagagtgagactccatcttaaaaaaaaaaaaaaaaaaaaaagagaattcagagatctcagctatcatatgaataccaggacaaaatatcaagtgaggccacttatcagagtagaagaatcctttaggttaaaagtttctttcatagaacatagcaataatcactgaagctacctatcttacaagtccgcttcttataacaatgcctcctaggttgacccaggtgaaactgaccatctgtattcaatcattttcaatgcacataaagggcaattttatctatcagaacaaagaacatgggtaacagatatgtatatttacatgtgaggagaacaagctgatctgactgctctccaagtgacactgtgttagagtccaatcttaggacacaaaatggtgtctctcctgtagcttgtttttttctgaaaagggtatttccttcctccaacctatagaaggaagtgaaagttccagtcttcctggcaagggtaaacagatcccctctcctcatccttcctctttcctgtcaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctggggtatgtgactgatgagagccaggagctgagaaaatctattgggggttgagaggagtgcctgaggaggtaattatggcagtgagatgaggatctgctctttgttagggggtgggctgagggtggcaatcaaaggctttaacttgctttttctgttttagagccctcaccgtctggcaccctagtcattggagtcatcagtggaattgctgtttttgtcgtcatcttgttcattggaattttgttcataatattaaggaagaggcagggttcaagtgagtaggaacaagggggaagtctcttagtacctctgccccagggcacagtgggaagaggggcagaggggatctggcatccatgggaagcatttttctcatttatattctttggggacaccagcagctccctgggagacagaaaataatggttctccccagaatgaaagtctctaattcaacaaacatcttcagagcacctactattttgcaagagctgtttaaggtagtacaggggctttgaggttgagaagtcactgtggctattctcagaacccaaatctggtagggaatgaaattgatagcaagtaaatgtagttaaagaagaccccatgaggtcctaaagcaggcaggaagcaaatgcttagggtgtcaaaggaaagaatgatcacattcagctggggatcaagatagccttctggatcttgaaggagaagctggattccattaggtgaggttgaagatgatgggaggtctacacagacggagcaaccatgccaagtaggagagtataaggcatactgggagattagaaataattactgtaccttaaccctgagtttgcgtagctatcactcaccaattatgcatttctaccccctgaacatctgtggtgtagggaaaagagaatcagaaagaagccagctcatacagagtccaagggtcttttgggatattgggttatgatcactggggtgtcattgaaggatcctaagaaaggaggaccacgatctcccttatatggtgaatgtgttgttaagaagttagatgagaggtgaggagaccagttagaaagccaataagcatttccagatgagagataatggttcttgaaatccaatagtgcccaggtctaaattgagatgggtgaatgaggaaaataaggaagagagaagaggcaagatggtgcctaggtttgtgatgcctctttcctgggtctcttgtctccacaggaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtcttttttttttttttgagactctattgcccaggctggagtgcaatggcatgatctcggctcactgtaacctctgcctcccaggttcaagcgattctcctgtctcagcctcccaagtagctgggattacaggcgtgcaccaccatgcccggctaatttttgtatttttagtagagacagggtttcaccatgttggccaggctggtctcgaactctcctgacctcgtgatccgcctgcctcggcctcccaaagtgctgagattacaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcacttactcttctacctcataaggaatatgttacaattaatttattaggtaagcatttgttttatattggttttatttcacctgggctgagatttcaagaaacaccccagtcttcacagtaacacatttcactaacacatttactaaacatcagcaactgtggcctgttaatttttttaatagaaattttaagtcctcattttctttcggtgttttttaagcttaatttttctggctttattcataaattcttaaggtcaactacatttgaaaaatcaaagacctgcattttaaattcttattcacctctggcaaaaccattcacaaaccatggtagtaaagagaagggtgacacctggtggccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaatcttttcaaaaactttttttttccgggatggattgaaggccctgatttcaccacaatgcaatatattaatgtagcaaaattgtacttgtaccccatgaatatatataatcttaagaaaatttttttagccaattattattacttactagatattaggctgtgttctgaatcttaatttaattcctccaaagaatcttatgaggtaggtaggagctattgctgctattctgttatgcttatgttgctgttatgaaaccaaggcacagagaggttagttaacttgctgaagaaaatgatgtgctggatttttattctagctattctggaataacaactacacaaccttatgtctgagccaaggaaacatacggtgtggcaacagttaccatgtttttaggaacagcagcactcctaatgtttgctgcagggaaaaaggaatctcagaatttgcctgatccctataatttttttcctaaatattttga

SEQ ID NO: 11807 - DNA, 54252 bp, Human
  misc_feature (1)...(54252): n = A,T,C or G
catcaactggaaacctcagcatcagcaaacgacgacagagcgttcatccgtaaggtgaaccagaaaagccagttcaatgacttgtttaaccatggtccatctcagaaccaagagttgggcctcttatttaccagaaaaattgtgggggctttgtgatatggctttaaaaaaatcttgtaattgccaggcgtggtggctcacacctgtaatcccagcactttgggaggccgaggtgggtgaatcgcctaaggtcaggagttcgagaccagcctgaccaacatggtgaaactccgtctctactaaaaatacaaaaactagctggatgtggtgacgcgtgcctgtaatcctagctactcaggaggctgacgcaggagaatcacttgaacctgggaggcagaggttgcagtgagccaagattgtgccattgcgctccaaaaaaaaaaaaaaaatacattaacataaatttaaatattttataatgacaatccacattaactacttaaagcataagctattttccaggagaggcagcaagtgcattctactcccatgcccaagaagaaaggagcgtgactttggtgggagtactaggagtttctactggagcacttgcccgcagagtgagaaacgttcctagagaggaagttatacctgctgtggaatttaagagaatcttgtcatattttgacaagttttttgagatggaagtctcactctgtcgcccaggctggagtgcagtggcgcaatctcagctcactgcagcctgcacctcctcggttccagctattctcttgtctcagcctcctgagtaactgggattacaggcgcccgccactacgcctggctaatttttgtatttttagtagaaatggggttttaccatgttggccagactggtctcaaactcccgacctcaggtgatctgcctgcctcagcctcccaaagtgctggaattacaggcgtgtgccactgcgcctggctaatttttttttttttttttttttagtagagacggtggtttcaccatgtcatccaggctggtctcaaactcctgacctcaggtgatccacccaccttggtctaccaaagtgctcggattacaggcatgagccaccaggcccagtcaacgtgatgtgttttggaaccctgaattccttggcttgcccggagggttttctttttgttaatatctttgcttgctttctagtatttaaaaaattgtgttttgctctaactatgcaatggctttaagtcttagacaaatttccagggagcaaaacacactcaaccatttcataataatcagaagagagctctgatcaataaataagcaagactgaattttacaaaataatccaaagtttaaaaccaaagcccactttttgcatgatcctttaagagaaagaaatctggaagcaaaacaccttataaaatgacaatgcactttcaggagcccagggcactgtggtgaaatgatgatggctagtacaggttataagccttggggaattatttatgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagcttatgaagtgctgggtgagaccactgccaagaagtgcttgctcaccctaccttcaacggcaggggaatctccctctccttttatgggcgtagctgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattccgggaaggctgatgggcatccctcttcccagccacagaaccagagggagtccccaggtagatggttccaagaagggagttgaatcttgggttccacctcttgcctgtgacccacggggaccccagtttatgcctcactgttccttggtctgtcaagagagcctgaaatagcattaggttctcctgtccttctcagtccttgacaattaattctgggaagaatagtgtggcatgatatttgggatatttggatgttaacagggtcccgatgagcaggtttctcaagaaattatcttttattcttcaatgaatttccttttattctctgcactcccaccccccaactaagaagctatcaggaagctctttaagttcaggttaatttgctggagacatgagtactcatatatcaaacactgggagaatttaagatctcagaaaagtttagcttcaaggatgtatacactgcttttacgtcttaggaaataacacctaggaatttccttacaagtgcaactttacagaaatttttaaaaatatgcatactcacttttagaacattactacttctcataatcctatgtatatacatgatatgtatatgtatacgtgtttatatatgcaaattttaaatttcattccttgtttcaaatggattttctcgaagattttttttttttgacactgtctctgtcagccagactggagtgcagtggcgcgatattggcttactgcaaccttcgcctcccaggcttagcgatcctcccacctcagcctcctgagtagctgggactacaggcatacgccaccacacctggttaatttatttttttgtagagatggggtttttgccatgttgcccaagctggtcttgaactcctgggctcaagtgatccactcaccctggcctcccatactgctggtactacaggcatgaaccaccgtgcctggccaatatttttttttaaagaaataaaaaaccaccaacttctacctcaaaccactcttcctaattgagtgtgaattttctaataatgtcttccctttgcttactcaggaagacagataagaaagtttatagtgttttttgaaagtctataatggcaacaagtagaatgctaactggctgtagaaagaatttattaagaaatgaaacataatgatgcatttcaggagtctgcttgcttgtttaggggaagtgcccagtcatgctgggctgtgtactggcccagatgtaggagtgtctttaaagagggcattttatttacttattacatttttatttattttttttttactttttgagacagagtctcactctgttgcccaggctggagtgcagtggcgtgatctcagtccactgcaacctccacctcatgggctcaagtaattctcgtgcctcagactcctgagtagctaggtttacaggtgcgtgcaccaccacgaccagctaatttttgtatttttagtagagatggggtttcaccatattggtcaggctggtctcaaactcctgaccttgtggtccaccagccatggcctcccaaagtgctgggattacaggtgtgagccatcgcgcctgacctatgtgttttattttaataggttttggaggacaggtggtgtttggttacatgaataagttctttagtggtgatttgtaagattttggtgcacccatcacctgagcatgtatgctgtacccaatgcgttgtaagattttggtgcacccatcacctgagcatgtatgctgtacccagtgcgtagtctcttttccctcacccacctcgcaccctttcccctgagtcctcagagtccatcgtgccgttcttataaagagggcatacttttaggaaggtttttcaatgtgatttctacatccacagggtctttgctaactcagtctaagccaagaacaggaaaatcttgacaattaatcatgctctgcctctggaagacacatttcaagtaaactcgtgttatttctagctattggtgacttatccaagggtctgagtggtcttggagggagcaggggaactagagtcccataaggactccttcacgccattctcaacatctatccataccccatctgcccctcaacactataggaaatacaaaaatgagggagatatagtcctgacacttaagcaacttataacctggtgaggaggagaaaaacatagatataaatatagtaataccagtcagagtgtggtaagatctacggagcgttgggctatcagagaaggcttcatgaggatgacatgtaaagggagccccaagggaccagtaaatttccatcaatgagattccagggagagagaccccaatgagccaaaacacaggagtgccttagggagcagcaggtggtccaatgtgctcctgccctggacagggagggtggggatatggggaattcaaactggaaagttaggatgaggtaaaatgaatcatctaaggcattaggcatttttagtctgtatattgctgggccctgggatgtggtcagaaagagaattctcctagtgataacttcttaacttcacctagtaggcaataaagaactacaagaaaatttaaaactaccatttataaagtaacttctatgtgccagatatgtgtcctattgtaatcttcatagccactttgcagtatggatatcatgaacccctagatgaagcaagaacccaaaactcagactcgcacaggcagtgagagtgccagggtttgaacctggtctccctggattgttctgtttctgttcattgcaaacagggtcagcgctttatggagatgatactggcatagagtggagagagatcaggtgcacagagacaggtcatgaggctcttaaaatagtccaatcacaaggcaaatgaggacccagtggccaaagacaatgacaggggtcaagtttctggaatcaacaggaatttctaggcatcactccagggtaagaaaccatctcatcacagactttttctccaagaggaacctagtcttgaaacaaatcagactttttattcctcagggtaagagttctctaatgaaatcagactgtcaacagatgcaatttctagctgattcataagggcagattttcattctgaaaatttccaaagccaccatttaacatggcaagggtttatgaggacatattagtcaacttgagtgtttttagtctctatattactgggctctgggatgtggtcagaaagagaattctcctggtattaccaatatggcacgttattgaaggcacctttctcagaactgtggaaattctgagagcttgtatgtcccttgatcatctttctttcattctaggaattctgtgatcaaatctttatcctctagactcaaaaataattctttaaaaaaacagtgtggaaacccattgagataatgtgtttgtgtaattatccattcttgtaaagacaactgcccacaatggaatttcccatcttcacctttgtcagtcaaacacaaaatgtttaacccttcacatttaatctttcaacttcttgagatcccaaagtattattgctactgttacttcattcatcttcaagacatgtcttgaggctgtaagggctttcctaaacattgggagctcttcataagacagttgctactttccttaaaacagcatgccttaaataggcagtttgataaatcacctgtgcatatacttcattttagatgtgagaattgaaaaagaaaaaaattgacttcacaattctgcaccaaaagaatgagtttcacgaatgcgtcagttagaggtgctaatatagaacggttgctgagctctaaaactccactactccaccccactcccctgatagagaagtattcccagactggtttttgcctaaagccttgggtattctgaatacctctttgtgatttttttttctcttcctttttgagacagggtctcactctgtcactcaggctggagtgcagtggcgagatattggctcactgcaacctctgcctcccgggttcaagtgattctcctgcctcagcctccccaagtagctgggattacaggcacctgccaccacgcctggctaatttttgtatttttagtagagacggggtttcaccaagttggccaggctggtctcgaactcctgacctcaggtgatctgcccaccttggcctcccaaagcactgggattacaggcatgagccaccgcacccagtcctctttgtgacttttttgttggagtcattcttctgcgagctatggatatcatcaaggcaggcagtccctcaacgtggcagctgttcccacccttccctgctcctcttcttgcccaaggatgagcagaaactttacagaaaaagagagaattccctcaggaaatgaggcatgttgcttgaggtcacagggaatagaattagcaggaaaataaaccttgcaggaagcagaaagtgggccaaagcactgaggagaggacacggggagggcgtgagtttttgacagatttctctctgtaaaatgaggaggtcacccagggatcttgaaactcccttccagttccttcactctatgtcaaggattccagaaaggaaataaaataagctctgcttaaaaggcattttcaagctggggaactttgggatgaaaaagtttcccaaatgaagacatactggcacggtcagggttgagcgacttttgtgtatcaatgcacccaagcctgatgtctcattgtgggttatttccagctctgaagaagtactgcctggcagccagcatgacccactgcttctgtaattgctgcagttgcaggtgtcaacgcaaaaactccactcactcaattctcaaaatctatccaatatctctcatgccccttttcaatactataggaaatgtaaaaatgagcgacatagtcctgatccttaagagagtcataagttggtgaggaggagaaaggcatagatatagtcatggtaacacaagtcatatgtggtaagatctactgagcatggggctatcagagaaagcttcatgagggtgacatggaaagggagccctgagggactggtaaatttccatcagtgacattccagggagagaggccccaagacacaggggcagcaggtggtccactgtgctcctgccctggacagggagggcggggtcctctgctgtttgtttgcttgtgtaggaattttcccctcaaacaatgtccttgtctcccatgggagaagttttacatgagtgggaacctgtttctcttctctatcccaggccattccctgagagaagagaaaggggaatcttttttttttttggacagtttcgctctgtcgcccaggctagagcacagtggtgcaatctcaactcactgcaaccttcagctcctgggttcaagtgattctcctgcctctgtctcctgagtagctgggattacaggtgtgcaccaccatgcctggctccttttttgtaattttagtagagagggggtttttgctatgttgcgtaggctggtcttgaactccgagcctcaagccatccatctgcatgggccttccaaagtgctgggattacaggcatgagccactgtgcccagctgaaaagagaatcttaattcagttgattacttctaaaagttataagaccttcttcactgaaagagttcacatagaagctgaacttgaatccagccctcttaaatttcagttcaatattccctgcacatctgcacatctttacatgaattctcagtgatattccttcatccatccattcatgcatgaggattacagagatgaagaaagttccagctcttatcctcttgtgctcacagtttaacacgggagatgaaactgctgctgaatggctcccattctgaagtcagccaacagtgtttgccaatagcccccactgaataccccaccatattctcaagtaactcactcatttaggggaaaacaataatataattgtctctagaaattttaggtattctccactctaagattactcagtgttttgactgatctcaaggcgactccgtggtttgcttctgtcaaaaagaaaacacagttcccactgggaaatgtgtggagagtaatggttcaaaacgccagctgtacattagtgtatatccaggatgctttaaaaagtgatggccaagactcataagatgaattaagcggactctctggggaacagaaccgaacatcacaataccttcccttccagttccttgaatacttccaaatcgcacttaggattgaaactcaccaaattagagagatggaataatgatttccatggttggtctgattcactaggaacaggtatgctcaagcagtacttctcaacctttaatgcatttggaaatcatccagggatcttgtcacggagcaaattctgactcgggaggtcaggggttaccgcctaagattctggtgcaaacaggttccacaggaggcctatgttgtgggtgcatgaaccccattttgagtaacaaggctatcaagtcagagaataaatacgcattgcttttacccacacagaacttgcgactgaaatgagaaaataggctgagtgtgatagctcatgcctgtaatacctgcactttgggaggccaaggcaggaggatcccatgagcccaggagttcaaaaccagcctgggcaacatagtgagactctgcctcttaaaaaaaaattagaaaaagggaaaaccaatctgggaaagatcaaatattgatcaaacattgcaaataatgccataaatgatcagaatagggagagtaacatgctacctggagaactagaaaaaaaattctcagagaaggtggccctgggacctcctggctctgaatggtggttctgaatatcaggagaggggctggagaatggtgttttctagtgatgctgctggagtcgtgtacatggaccgtgttccatgagtagtgagctgaccaattagagagatgaggggtttgccaggacaactacataatgagccatatttcaacatacatgcagttttgtgtgtgtgtgccaagcaaatgagtctcagattctcggacaaaaacgaatacttttgctcagacagacagcatgtgagtgcttctcccccagcttcaaccctgcagtgtctacaggtgtcattggtccccggtagacgtcctcggttcaatgggtcactgatcacttatcaccagcaccacatgaccctggatggcagccaaagagttcctgggtcttgtttccctacctccacatttttttcctgacccagcccgagccacgtgcacaccacagggctggagtcccagtgcttttgtcctgacagcccattctcccactcccacacccaaccagttccccggggggtttttgaccagcagctccgcctgcagccctcgacccggatccaggcatcctgcttaaggaggggttcaggtggcaggaaactccagggcaacaaagtgtgggtggcatgggtggggttgaccggaaggtcactgtgctgggaggaagaggaacgggtggagggaaggcaagatacggatcaggagtattgacatcctgtgccagtagaggggcctgccccatggtggaaggtgtggccggatgagctcgctggcccatgtccccccgtttcccaggctttttcctcccacgctgtatgcagtgcaagaacaagctggtgcaattggactagcagcaattgagtccttttacccaaaagaagaagaaagagcaatgtttcaaaagaataaaaaggaagctgcagccaggtgcagtggctcattcctgtaatcccagcactttggggggccaagaggggaggatccctggagcccaggagtttgagaccagcctgggcaacatagtgagaccccacctctattttttaaaatgataattaattttaaataaggaagtttgtgaaagccattggtttctttattctaaagagcgtggaaaataggacagtctccaacaggccctgatttcctttggtaagaaaatgagcaaagctatagactaggaaacatgactggttaaagccggcccatgcaccaactccgatactgatagttatgtttcctttcgttcttatttgcttcaagctttgatccagaaaacatttgaacactagctagaaccaccacagtgaatatccattgcctaaatgctatctttcaggtattatgttcagacatagtattactttggttaattctcaaaataaagtaggtcatatgattatccccattttctgcctggtgaactgtggttaaatgggcttacagagattaaatgggttgcctgatgtagcccaacgaggaaggggctaggataggaagcaggcgctctcattccagaacctgccttttttcctcctgtctaaactgctgctaaaggtcaaagacaaaggtgccatgtgagcagggaagttatttttgttttttacaaaggtgaagtaataggctgtgagtaatgcccactgctccttcagccccaggtacatgcagtgaggcggtacccacagagccgcgtggcactcctcaacctgctagagcagccggcctcctgcaggatggcttaaggaccacctggtccttggggtctgggttctccgggtcctgctgttccctgcagccttccttctacccccagagcagcttgggggcatctttagagaaagcggcagtgtcgcacctgccccagcagccacaaaacagaggaaattctgagcacctccgggcgtgagtcaccataccacattcaggaattgccacctctgcccacagaatcacccactcttttctgtttgggaccaaaatagatacctccttcagaagccgctgctttctgtactctcagcaataaaaaaacaaaggctaggataggtgtgtgcctctgaggcgtgagggggggcgcgttttctcccctgggaaggttttcagagagaagttgttgctacagcagtacaggcagctgatgggttgagggtacaggaggaagagggaaagtcagggagattggagacaacctcttgtgtggtaggacttccggctattggtttgttcattcctttgttcattcattcattcagcaaatgttcattgaggaactgctatgtgtcaggcacagggtttgagacacagagatgaataagagcccatccttgacctctgcacagacaattatgacacaggctaagtgctgagatacaagtttaaagaaggagtcgatggaacacacagatcgatgttcattacccctgcaaaacccagcacatctcacatcagggactgcctcattcacatcatgttagatgtgacagagaggacagcagagagcgttgttttgtcatcaactactaaaattattaaaaccaaacaccactaattttgaacttcaggtagacagaggatgtagagttttcctttgctcaagaaattcctttacagagaaaatgggaacatttcaagtgggagtatttcaattcctttaataacaacctgttttctagctcccacattccccaagtattctagaagcacctttcataatggacagctctgaccaactgccccacacacatgcatgtgaaccgttctccaatcctaaaagtctgtgacttctccaaggaaaggaggaaggaatcgtattagtccagtttacattattatatactttgtagcaaagcagcaatgtttccttaaaaaattctatatatatatatatatatatatatatatatatatatatatatatagctgggcatgatggctcacgtctgtaatcccagcactttgggaggctgaggcgggcagatcacctgaggtcaggagttcgagaacagctgaccaacatggtgaaaccccgtctctactaaaaatacaaaagttagccaggtgtggtggcacatgcctgtaatcccagctactcagggaggctgaggcaggagaatcccctgaacctggaggctgaggttgcagtgagccgagattgagccactgcactccagcctgggtgacagagggaaactccgtctcaaaaaaaaaaagaaaaaaaaaaatatatatatatatatttgtgtgtattttctcctcatgaaatgagctccttgaagcaaatcggcccatcttttcagagaaagatcagtttattacgtcaccaagtaaagggcaaaggaatcatttctaaaagtttcgtttgaagtccccggagttaaagttgacgtcagcctcttcctgccctggtgccccgagagtttcccgggagttttggggatgacacccggctgcatgcgtgacatctcgctggctgggggcaggcctggtggcttccccgacaatgaaaccaggcagagcctgcaacccagctgagcaccagtgtggtctctgcttccggtccttgtggtagcacctctgtttacagcctgatttagaacaaaaagaacttttgtaaaggagaaaactccttatattaaatggaaagcaaaacaaacaattaccaaaaaaaaaaaaaagttggaggggtgtttcagaataaaagagccgtctctccagacatctgtctgacgcccaggtggcgctgagaccacagggtgagccttttggctggagatgttgatccctggtttactgcacttcgggctttcactacctttcacccaccggaccatcagtttcactttccctctcccagcgtctctcaagctctgcttctctggccccgttttcaatctagtgcaagaggacctgtagccagggcacccatcctcctcctcctcgtcctgcactgggatcccagctctgagcactcccgggccagggaggccttgctgcgtgctctgcttctgtgatcttacagattcctcatggccaccataggagatggggactgttagcactattcccccaccccaaccaccttttttttgagacagagtctcactctgttgcccagactggagtgcagtggtatgatctcggctcactgcaacctctgcctcccgggttcaagagattctcatgcctcagcctccccagtagctgggattacaggcatgccccatcgccatgcctgactaatttttgtatttttagtagagacaggttagtagagaccatgttggccaggctggtctcaaactcctgacctcaattgatccaccagtctcagcctcccaaagtgctgggattacaggcttgagccaccacgccctgccaccattcccattttacggatgaggaaactgagaccatgaggcagtaattcactctcccaagaaagcaaggagccagtagatctgagcagaacccatgcattcaggccgacacaggaagcaagctgtcaacaggcactgttcatctcctgggcttcctaggcaggccctgaagctctggttttcagtcaccctgttattcatccccaagttaatctcccctgaaagcacctgtcgtgatgccctttcggctgcaagagctccagtcatttccattgcctcaggggcactttgctacctcctctgcctggcacacaacatgctccccagccaagactgttccctcagcacatagcacgccttggccagcaggtctcctcctgtccttcaaagggaacctcctcatttgtgatttcaaagctggactcccaggaacaccctcctcccttactggaacaatcttccccatcttgtctgcctaccggaatttttcccaaccagaaaagcgtcttgagagaatggaaaagtcttatgaatttggaaagttgacagcttgaattcaaatcctagcttgaacttgtgaatttctactttcctttacgaaaacctttgcatgccattctgtgcaggcactagcaaggtggtgggagggagatggatacagtagggtgagtgccgtgtaaagaaaagggagcaaagtctgggactgcagagaaatgccacaaagcacagacagaagagtcccggaggcttcccagagaaagatgacagccaatgggagacctccagggaaagcaggagttaagaaggtagaaatgcattagggaagtgtggcatgagcatgatggtcaatttcaatgtgtccacttgcctgggctaagggatgcccagatagctggctaaacagtctctctgggggtgtctgtgagggtatttccaggagacactagcatttgaattgaatagactgggtaaatttcttgttggtagactgagtaaagaaaatcaccctcaccagtgtggtggggatcatccaaccttagaggaccagaatagaacaagaaggcagaggaaggttgcattctctctgttcaagctgggacatccgtcgtctgctcttggacatttgcactcctggttctccagcttttggactctgggacttacagcagggcccctctgctcctcaggccttcagtcttagactgagccacaccaccagctttcctagttatccagctccagctggcatattgtgggacttctcagcctccataattgagtgagccaactcccattataaatattctcttatttatctacatacatcctattggttttgtttctctagagaaattctgtttccctgaataatacaatgaccaaggcccaagacaaaacacatggtgagctccaagagccacgcagagtcccgcaaggcaggagagctcaggcacatagtggaagcagagattttgaagttgggcatgagctgtgtcttggagtctccccatgtcactgggcttaaactgtgtcctggaaggaacagaacatcccagaggggtctcagtcagggcatggcttgtactttggagagacagcattgggtttatgtgaagaatgaaggaagaagagaaagcactgggtttatgtgaagaatgaagggaagcagaaaggcaaacccatagggcattgagtaacctccatggaagtccatgagggtagggttttaacctcggtgggcctcagcttctgttcgtataaaatgggaataacacagaccctgctgggtgctgtaaggctacataagctagcctgcctagagtgaccagagcacacagtaggtgctcactaaatgtgacttgctgggcttctagtctgcatggccaaaggcccttccctcggacctttccgtgtggatgcctcacaggctgctcagtctacacatccagaactgtcctccctccctggaacctactctttctcctctctttgctatctcaatgaatggcaccccatcctccccatcgcccaggaaatctgggcaaaatcctcatttcttccttgctgtcctccatgcacctaataatccagcctcaatttttggcaattccaacttctaaaatctcttaacgccagcaacccctcttcttgcttacttatcaccacccacctcaggactcccatgacagccttcctgtgatgcatgacgggcacatgacaagggcagttgagggtcaggggccacgggagcaggatgcagccagcacatgagggaggataggcgggaggacaggcagacacttgtgcgtaagagcacgcacttgtcaggctgcctgggtccaagtcctagctccaccactgaggggctgtgtgtctctgggcaagtcactgggcctctctgtgccttagttcctgcctctagagaacggagatgagaagaacacatcacctcataattaattactgcataagtaataattttaattatattgactattatactctattagtgtatgatgtcttttattatatatatttatcatataatatactaattatattaatgagtatactatagtattttatataacataccctaattgcttattatatatctgtataattattttatcatataagataatttcataagctaagatggtattttatatatttcatttattatatatttatatttatatactttattgtatttgaattgtgatgtctaataaaataatagatatgttaattatccttcatattcataataagctccttcattggtgtctgggaagccgagaacatttgtgcgtgtgagctctcctgtgtgttcggcatgcagtgtgttgcgtctcagctgacgtgattgctgtttttggtggcccggaggcacagggtgcatgctacaggcaggaagagctttggagcaggctgactcctgagctctcctctggtgccgtggcttctgaggcccccaggtgacaaccagcctttgccattctagtgtttcctctatgttcatcccgcgttctgagtgtggcacaggccacactcctgaccccaccagcatcaggtgctgtgcacatggtatgaggtcgggatggagtgctgttggcatgggggttgttccttgggctacctgtgtccacatggtctgattaaccccttctgcacatcagcaagggttcagcacctcctcagggttagggcatgcgcagggcatgcagggatttgagggtccttggacaatgcatgttctccatgcaagcatgcagagacatggagagggtctttgtccctttcagtcctaacattctgtggcttcataactacttgtcccacacccgagtaaaaagcaggatcttctcagcactgtgctgaggaagtctttaaaccttccagtaggacatgggatccctgcctgcatcttaagttcccatgtccttaggaaacgtggccaccttggaattcagctctccaagaagcccagtgtgaatgcccattgcaggagcatctgagctcacccccactaaccctgaggtatctgttgaaaagaatagaacccacccactgaaactatcagagatcaaatgttgtgtgttgactaagaatttgtgttaaggcagggatagttgagcaccaatgctttcaaggaactctggagaaatgcaagcctgtatttcctctcagcatggctgcagaagagggccagggcagcagacaggcattttgacccactcacagatgaatacaaagactaaactcagcaaaagccttgaggttgcatttatgtgtctgagaacagtccctggagcacaggcatgggcttttggtaccacgtaacctacaaccgtaagctctctgctctatgctgtccactccatcaatcccacagtgcctgaaatgtcattgtcttacccgatgtctggggtagcatctgtgaacacacggatttgacacttttatgatgctgtttgtctctactgaacccttcttaagcaaaatcacagtagactagcagatcatggtagtatctgaaagcgccaggaccccagaacctcaatcagtgctccccacttcccatggttttctccctgtgtttccacatttggattgtcattgtctgtgaaaaggcatgatccctgtcaacaacacacagtgtatgcaatgtgtgtcttgtgtaaaacggagtgtgaattcttgagagcaggaaggaaaaggggtacaagaggttcccctgcgagatgggtgaggagcagggcagagtgagcctggctgctgggaacccctgaggagagctctggagagggttctggacacgtgggcttggtcagcctgacaattaggatttgtgttaacaggaccggccctcacctgacaccaactggactgaggttcccaggagaaacacttagcatcatgactttggaggttgccatcatttttgatgactttttctttttccttcttttctgtttccctcttgtcaagtttctacctgtaagttatacttacttattttgtgtttctttacagtctcaggggaaattccgttgagttgaaaatttcctcagctcctcgctccagtttctcagaagagtctctctccttgcagaaaagactgtgggtgggagtcaccaatttagcatatttctactaaaaatatgactccatcccaagaaattggttttaaagatttgaggaaaaactgcttttagatttcagagaaagaaaaagagtgtgtttctacttcccccttttaaatctgataacttttattttaatcaggttgacattctgtggtgagcttgtggttaactctttcatgcccggaagcctgttgtcgaccgagaagactcccaggattagaacataaccagcgcccaacatttcatttgcagaagcatctgaggtcccaaaatgtgatggtttagcggcagctgcttgtaggggtatttttggtttcctgcttcttttttcccttctaagtaaagacaaaataactagatccctccaccccaccaccccatcatttcgttgttgtttaacaagtgttgagtaaggcacagttgttctccaaaagggtcttaccctgtgagttactcattttagggttacggaaactctgactatttgacccagtcaaccaggcctcagaaactgtgggtcagataacaaataactcatggtgcttctgtgctaattactgcagagatgtgtccaagtgctcggagatctcctccttgaagccaaggtctcctccttgaaccacaccgccttcttctcctgtcccgagggaatcaggcaacttttctttgatgacagcaacttccttaaatcccccaagccctgagacaggcactttacttctcccacatttccttcaacatttgtgcttgctgaatgaaacaaggaaggtgaatgtttgcttgaatgaaccaatcaatgggtaacagcaccagtgctaatgctaatacactcaactactcattcagaacctaccatggcccaaggcttgtgctctgctcttgggtgctgatccagcaaagagtgggtggagggggagtgggaggtgaagtccctataccaccacttatattttgcactgtcttattttttcctctggtcacatgcatacataaattttatatctctgtaattatgccatttaaaaatcttcctactgaggtagaagttgggactcaacccccgaggcagggctcagacatcggacaaaattgaggactagcaaaaacaggattggggcagaagcagctttccataagacatgctcatgagtgtgccatgtcagtttaccattgccatggcaacacccaggcgttcctgctcctttccatagcagtgaccggatgacccaaaagttactaccccttccctagaaatttctgcaaactgccccttaaactgcatgtaattaaaagcagatataaatatgaatgcaaaactgccctgacctactactctctgcctatgtggtcgccctgctctacagaagcagtcacggagctgtagcacagccggaactataacattgccacttcaataaagctgttttcttttattctaccactggcttgcccctgaattccttcctgggcaaagccaagaacccttgcgggctaagccccacctcggggctcgcttgtcctgcatcactaccaccttctctaggaagatgctctaggcttaatcattgtgttgaattcagctgctgaggactgagaggtgatttggatgattgacttcataaataaaattgggagttagactttccccgctgtggacttgccactgagttgggggagaggggggtttctttctctgataaagttccacatccacagacagaaggaaaaggccctgaactaatcacttcctttggaagaagctttggtaaagaattaacatttgggaggttgtcaagaaaaacctatttgttctataaatatttaaaaattattaaaatttcaaccaatacagaaaaacacaaagattaatataaccaacatgtgcccatcatcaggattcagtaaatgtttacagtttaccttggttgtttcatgtcctttttgtttattttaaatacatgctcttgtcgtgcgtgatggctgatgcctgtaatcccagcaccttgggaggccgaggcaggtagatcacctgaggtcaggagttcaagactagcctggccaacatggtgaaaccccatttctactaaaaatacaaaaattagcctgatgtgatgcaggcgcttgtaatcccagcttcttggggggctgaggcaggagaatcacttaaaccttggaggcagaggttgcagtgagcccagatctcgccattgcactgcagcctgggtgacagagcaagactccatctcaaaaaaaaacaaaacaaacacaaacaaaaacaaataaatacatgctgtagatacagtggagctccctctcggtccaacccaatctcattcttcccctccagtaattgttctcttgaatctgggctgtatctcatgatgcaatatacactactggtttgttttttattttatacataaatgcataatatactgtttctatttgcaactttgcttttttcactcagcagtgtttctgagattcatttttgatgtttattctttttaacaactgtacattattacattgtataataatacagagttcttgataatgccaagtttattaatctaaccttcttttgatggacaattagattgtatctgatttttccctattacaagcaatgctctaataaacagccttgaatgtgtgcacatatgcaagaatttctctaggaatatacctagaagtgagatcactgatcctagaacatggacagcttcaattttactgctatatttaaaatgttctctttgaaatcgctatgctaatttataatcctcatcagcaatttatgaaatttcctgaattcctcacatattcctcatcatcacttaccatagggaaattttaacattttttgccaatctgataatataaaataaaatctcattactatcttaagtttcattgatacctggtgatattgagaatgcttccacatgtttttttggtcatctctgtggcctccttgttcatatcctttgtccctatttttattgggttgttggcctttaacttattgatttgtaagtcttccttatgtattacggatactgagtctttggataagtatagattcttggatcttctaagtagacgttattacttataaatgacaattttattttttgttatccacttcttattcctctaatttcttttgcttgttccattgcattagctggggtgttcaatacagtatagaataaaagcaggaattgtatatgtttccaccattaaatagaaggcttttaaggtatcacgtacatgttattttctgtaagctttcagtgtctactgtctattggttaaataagtttctttttatttctactaccttaaaagttttttttcttttaatcaataatggatattcttttcatcatcattagatgctcttcttcatctattaaaatgattgtgtaggttttcttcctttataccataaaagtatttaagtacattgagagattttctaacgttaaaccattcactattgctgggataaactctgactgatcagaatttttttttttttttttttttttttttgcttaatacattgctagcatcaggtgcaaatgtgttaacattctccagtttgactgtagaattaatttctttttgtaattcttcaccttatcaaccatatgtattgttgagtgtatacatgttcaagattatcataacttccagaataatttttatttgtgaaaatgcctttttgatctagtttctcttatgttattgtagctatggagctttcttatatctggctaccttatcaacaatatgtattgttgagtgtttacagggtcaagattattataacttccacagtgatatttatctgtgaaaatacttttttggtctagtttctcctgttactaaagctatcgagctttcttttggttgctaaatatctgcatataatgtgttttccagccctttagttcaaccttcacatgtcactgtattttaaagacgtctcttgacataacaaaaatagaccttgtgcaggactttgggggaaatttttccccctcaatcagaatacctctgtcttttacaagcaagcttaattgatttatatttattgtactacatttggacttatttatgctattttactttgaacttttattaaccattatttttcttttactgttgtatttatcttttcttgtcttctgttaaattgattgagtttcctttattttctcttttccttctactggtttgtgtattatatgttttaattctacttttagaattaagtcaccattggccgggcgcagtggctcccccctgtaatcccagcattttgggaggccgaggcgggtggatcacgaggtcaggagattgagaccatcctggctaacacagtgaaaccccgtctctactaaaaatacaaaaaaattagctgggcgtgatcgtgggcgcctgcagtcccagctactcgggagactgaggcagaatggcctgaacccgagaggcggagcttgcagtgagccaagattgcaccactgcactccagcctgggagacaaagcgagactccgtctcaaaaaaaaaaaaaaaaaaagaattaactcaccctttaagttctcaaagtactcgtgatgttaaaagtccacagttaattaacatctctcccagttccaggatcttctgttcagaacttagcacatttctggcaactaaggattgacaactgttaaaaaatatcatttcccattatatttttggattggttgttgctgatatataaaaaatgttgaattttataaatgaattttctatctggccaccttatgaaactcttaatagttctaatactttaaccgtcttgggttttctaagtacttaattaaattcctcacatagaatgattatttttatcttctctttttccaacaattgtatgccttatctatgttaccagttttatcagatcactaataacgagggttcttttaaagtcaattggagtgagaaaaacccaaagatgccattaagtccttgagtgtctttggggaagaaaaggtaggtttaggaaaagagagacaaaaggcaaagtgaacaactaagacaataccatgtatcgcaaatttaggtgtgatttaatgatggctaagaaaaaattctaaattatatataaaagtgtattcgtatataaggtagtttaaataaataacaggtaatgtgggcaggcaacaaccatcaaaaatgactggaaatattcaaattcaaccatggtgatttggttggcagcaatcagagaattgactatgcttcagtagattgaaatccgttataatctattaatgtgaatacaggtgacaggaaacaaccgaatacagcattctcataaatagttcttagaatatgaattcaaaagaaactctatttcctcgttgtgacacaatcaagctttaagcaatgaacgctttaattattgtttttcagcttagaaagtaactatatattttatcattgggttctaaaaacaacaccgctcaagaggtcattgtagcaacaatcaaaatttgtggagcattttacagatttcaatgtcacttatgttatttcaactgatcctcatatttccatccttcataccctcacgattcatgcttcagcaaaacattctacctgtagtctcttgtatcttccatatgatgatgctgttttacacttttacacattctctgccagaatggcctgacgtgcctaacctgccagttgaactcccacccacctttcaggcaccttatagttaagagcagccttcattctgttgcctggctcatgggcaggggcaggattcccagcaaggggtactatgtcaagaggcctaaaaggacatatcagcatggtaaaaggaaatggcttggggtgtatgagaagctcctatggttacatgattgggaggaattcttttcatttcgtgttacagacggagcatctgaaatgagaagggaccacagtgagccagtgagtgaaagaggaggaagattctgacacccagagctttaccttcaacatttccttctgtttattccttatctagacttccattttcctaccccatagatacccactctttgcccctaacttgccttcaactcctctactgccttgtaaatgtcccatgtgtgcttgaaaaaagagtgggctctgctattgttggaatcaaatttgttaattgtggttatcacatttgattgttcttactgattttctgtctgtcctatccatcataaaggaagacactgttaaaatttctcattatgatagtagatttctaaatttatccttgttttgtcaatatttgctttgtgtattttgaagttatgttattgggtgcatagaagtacgtaagtgttatgttttcctgattcttgatttgtatattttgaagtgatgtttttgagtgcatacacatatagcatttttatgttttcctggtgaattgaatctttagcaatacgtactgacttctgtatttctattaatgcttctgccttgaagtctgatgttaatataactccttggattcaattgtccattcttttagtttcaaacttttggagcatttatgctttaagcatgtctcttataaacatcatataactgcatatttttaaaaatatatgcagtccaacattctgtaactgcagggttaatctatccacattgataattattactgatatagtttgatgaatttccactgtcttattttgttctttattttttaccttctctttctatgcatttcccccttcttttgatttaagtaagtttttatcctattttattttcttccaatagcttgtaagttattcactttactctgtcattttagatgtaatttttaacatcttaacatgaatccagactttacaaagcctagatttaaccaatatcatagccttcctctcaaataataaataaccttagaacaaattgcctccacaaaccttttctacacagttccctcctcttcctccttgcttctttgtgcgcatttatgtttgctatttgaaagaatttcctgaaagtaaaagtgagattttttagaaggctgacatgagggcagcaatagtagactttcacgtgactcctgtcccaccaccttgagctgtgtggtttagccaacttacttaatctctctgaacctcaatctcttgctttctaaagtggggatgacagtatctaccttccagagccatggtgagcattgaaggtaatatatgcaaagaagcagcacataggcagggctcagacatcatagttattattatatagataaccccaaatggagggcctgggccctctgacttcttcaaagataataatctgaactaaaccacaacatcacacaaacacctcccagcacccagatagtttagacatagctccacctctttgtaagagataaccttcaacagataggtgaaaagcacgctccttcctgaagattatgattctgggtgttggaaaagcactgaactaggagtcagggaacctggtgatctgttgtaatccaaggcttgccacaaacttgtggaatgaccacaggcccagtgttcttatctataaaatgtagaggttggcctaaatgatctttgagctctcttctagttctcatattctatgataccattaaaagggatgttctacatcccttttgcacccaaaccacttactttctatacggcctaaacttctggtttgggtttcccaaggaagcgagagacaaccttcaatattaggcatatctttggagttcttattaaacagtaaacctcatctcactatcaaagatagcctctggctccagcgtcctctttccagtctcccacagagatttcctctgggagtcaacgagcttaaggtgaaatttggctaggggtctgggaggaattcttttcatttcatattacagacagagcatttgaaatgagaaggggccacaggggggcagtgagcggaacaagaggaagattcgggtctctgacacccagaatctatctgattctgacacagaagatgaaccgcgttagagcaagaaccagatccctctttacccagtggcccaagctcttgatgcgtacctgtgtcccttgtaaagctcagtgaaatcatcacctagacatttcctgtgctccgtgcgttattctaatcttcactgggtacaagtagagcttaaagttctgatatatggacaggaaagagaagagggatgaagcctttatccagggctggctgggctaagagtaaaacaacttcacctggattcacccaaggggcagagaatcttatctcagactcggtccacatctttatcagcccccttttccctttatctttcatgttgctcacatgggctccaggggccagatgagttttctcttactttgaacatcagagaaaaaaaataacgacaaaaagttactcaaccgacaaacgtttctcacccacacacctttcctccagtcaatgacgtttccactgcaccctgttagacgctgagtgaggaagcatctgggcacaaaccgctgtggatgcagattgagcagcactcactgtgcactggagggatgggagtcctgtcctcaccaagggggcagatggagagggggcagagagagcagccggggcttcactccctggaaactctcatactccaagtgcggcctggggctctgcagccccagcatcatgtaggagcttgttagaaatagcctcaatgtccacacctgccctgacaaatcccagtctgcaagatcccgggggctctgcacacacgctgctgcgaacaacctcagcatccgtcctgccggctctagagcagccaaccgggatatccttcttcttcagcagtggtgtccgctctctaaaatgactgtcccccacatctctttccagggttggtatttctggttaactcaagggacacaaaaatagctcagggaaaaattaattttcattctactccaattctaataatgaagtggtaaaaattaaagggacagctttcagattatgggagtgcagctgcgggtatgtggcaaaatcgaagaaagagggctcataattccacgtcagggaagagctgctggcctgcccaggctgctgtttatctttactgtgaatggggcctcttttttgtttgtttgttttgttttgttttcacttaacctcagtggcaagaaaaatggggcctcttgccaggaggagcagagagtgacgcggaaggcaaagaccacctcatttcaccaagttcctcgtcttttatttgaaatccaagacatagaagctgcacatttgtccttctgggaagagtgacgagtgactgagagtggagtcgaacactcgaaaggagagagcaggtgcctgggagtcagaaaagctggcttgaattcctaaatctgtcgccgtttgtcctgggtgaggtcattctggtcatctgtggcaggaggactacaaatgcctggcttttccctttctagcgggcacacaaagagacagagaagttgaatctttagcaatccattgaaggggaaaccccacaatgcaaagagaagcattgtcgagggcccttcacctgcaccctctgttctcccagacctgttccatgatgcattccagaggaggtggctctccgtcactgtcacttgcgattgccaaggcgtcagccagacaaggcaaaagctcccaaggggtgttacccttcagctgcatacagaactcctagaggcaacaaatccacaaggaaagatacacccatgatcgtgtatttcagccacaatgatggaggtgaggtggaaaaggacgaggaacaagtgggattctgcccatgtctgtctaatgagcatccacagcaaactccaacggaagatgtgaaacacgctcaacactagaagaactcggtttgactctgtcttggtgtgggtcccaggccaaagccctcggcattttcaggattaatgatcactgctggctgtctctttttccctctgcccacataaaaggcacaaaaactaaagaggaaggccacatcaccgcagagcccgtggttcaggattctcctcctgggagccccgatttcttttcttttctcaccttaacagtgtccagagtacttttattgccagaatagagatatagcctgctcagagcctcatgtgcggcccaccactcaggaacaaagggagagacagatactaagcatgtgtgcaacagagaaaatccagcccacgaaaccgtgtgcaagagcagctccgtcctgcctgaatgtggctttgggaagcccacctagaacttggcctggcgccagtcacccactcagagcctactgccatgaaggcaggccctcactctccatccctgcccacacagggagacccagggcaaacagaaagtcccctagcgggggcccaaggaacccctggctctctcagggtcccattcaagtttctgggctagtcttgcagactaaataccactcagttgcctggtgggagtaggtgctgggcagggtggacaggagccccactgcttctcagccctgtgccaacccctttgtgtgagaccctagtgcagggtggggagccccaatttctaagccttgagtgtttaccaccctacacccccacctccaactcccgaattgatcatctcaaattttcccacagtccataggcaccagacacttcaaataatctcagaaaagaaggtgatgtctacatccagaatcgtgccaatactttaaaattacagggagaaaaatattccccttcccctcttctaaggaaaattctgtctgcctcccaagctcccaggtcccttggtgtgagctgggggagtgcgtagagctaggaattggaaaatattccgggagagaatgatttatgttgagaagacccattgggagaagcaggaagtgggtctggaaagacaggaggaagtgtaaaggcagagaaaagcccttgttagctgaattttgagaagtaatttttggcattgttagtgagtaaaactagagaatgaggacagttgtatgctgtcttaaaaaataaaagaatgataatatagggaaagatgatttcaacattttggagtcatataagtggaatcctcctgttattactgtgcaagacttttagacaaattattttttattctttttttggatgttgttctgttgctgcttttataacactacactgagaagggctaaaaaaaaaatcccaaatttattcctattagattgaaaaagagcaaccctccagcgtacctttccacacactcttctacctcctgctgccttcaggtgatgtttggcacttcctgacaaggcctttcagggaaaaggattatagccaagctctttagtggttactgagctacagacctggaggtgtcaagatcctaaattccaggaaagattctttatgaaaggaaagtctgtgagaataagaagttctggaacttccccttgtccccgcatgacctcttcagacactcgggctaatttatgatgactctgaaaatgcccatgacctcatctagaaaaacgcactctcatggaattcaagagtttctaagggcacaaaatagcttccaagacaatttgtttccttcttttcaaattgatgtgtttagaaatgttcttggcttgtgattgacatctcagattccaaaaacatctgaggtcaatcctggttatttgtgctaatgaataattacaaaagagtagctaaatatgcttctcgctcattttgttgagctaaaattacttataaagaaatgcatagatctgcggcatacaatttgatgagttttgacaaatgtgtacagctgcaaaaacgttttcatcacttctgccttctggtcaatacccacctaccacaagaaaccactgtctgctttctatctctggatataacttttgtctttttgtgaacttcatataaatgaaagcaaagtgtatgcactatttcgtgtttagcttattttgttcaacataacatttttgagatttatcaatattgcctgtatcaatagttcattattttttatttttgaatggtttctatagtatgactatatcataagctacttgtctgttctcccaatgatggatgtttgaattattgagttggttattattaataaagctactatgtactagaatggaaggggcttaataaaagaaagaagttactataaatattttataaaagtctttctgtagacacatcccttcattcctcttagataaatacctagaagtagaattgctgaattgtagggcaggtatatatttaacgtcaataaaaatactttctttttttgttttttttttgttgttgtttgtttgtttctttgtttgtttttgagacagagtctcactctgttgcccaggctggagggcagtggcgtgatctcagctcactgcaacctctgcctccttagtagagaaagggtttcgccatgttgaccgggctggtctcaaactcctgacttaaaatgatccacctgtctcagcctcctaaagtgctgagattacaggcgtgagccaccatgcctggccaaatactttcagatagtgttccaaagtaattacattacttacactgccaccagtaacataagagagttctggtagttctacttcctccccagtatttgacgtatcagtcttttatccatttcctccatttccccaatgggctatctcatcattgttttcaacttgcattttattgatatctgatgttaaatacactttcaagtgtttattgatagtcgtgtatcttctttggggaagtgattgttcaagtctttgcccatttattgggctgtttgccttttactcttgctttgtttttctttatatattctggacacaagtatttgtgacaaatatatatattgcaaatattttctctcagtctatcatttactttttcatttttttctttttttttttttgagatggagtctcgctctgtcacccaggctggagtgcagtgacgcgatctgggctcactgcaagctccacctcccaagttcacgccattctcctgcctcagcctccccagcaggtgggactacaggcgcacaccaccacacccggctaatttttttgtatttttagtagagacagggtttcaccgtgttagccaggatggtctccatctcctgaccttgtgatctgcccgccccggcctcccaaagtgctgggattacaggcgtgagccaccacaccctgcctactttttcattttcttaatgtctctggatgagtagacattctcaatttttttcttttatagtcagtgcttttgcatcctctatgagcaatctttgcctatctccaacttgcaaagtcatttgccttaattttcttctgaaatctttttagttttgccttttatggttacatctataagatatagacctagtacatagatctttatctttatatatataataaaattaattcttgcataagatgtgagtttttttctcatacatttatccatttgctccagaagcatttgtcgaaaagatttttcctttctcattgaatttccttggcacatttatttgtttaaaaaaaaagcagttgaacaaacatgagttgagtccatttcaggactttctgctctgtttcattactgtttgtccttatgctaatactacgctgccttgatttccatagttttatagaaagcctgaatatcagatgtcatgaatcctccaaatgtatacatctttacgattgtcttagatattctaggtcttttgtgtttctaaggagcttttagaaataacttccaaatttgtactaaaaaattgtgttggatttttaaactgtagttgccttgaattaattgatcaatttaaggtgaatagattttttaaatgaatgttacaatctataaagatagtatatttttccatttgcttaattcttttaaaatatgtctcagcaatatttcagagttttcagtttagtggtattacaagtttttggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactcactctgtaacccaggctggggtgctcggctgactgcaacctccacctcccaggctcaagcaattctcctgcctcagcctcccaagtacctgggactacagacatgtgctgccacactcggctgatcttttgtatttttagtatagatgggatgtcaccatgctggccaggctggtctggaactcctgacctcagatgatccgcctgccttgtcgccccaaagtgctgggattacaggcatgagccaccacacccaattttacgggtctgtttctattgagcacttttttgagtaggtcaagtatgtcacattttcctgtttcttcacatgtctagattttcttttaatttgctggatattatgagctatacattataaagggtctagattatcttatggtcctttaaaaggtaatgcattttgctctgccaggcagttaaatgactagcgcatcctcttgtctattaggcttggttttaatctttgtaagggcaggtctattttggttttgaaattcatcctagggatgcctctttctctaaagcaggattggaaaactacaacccacagctcagacacctgtttttataaataaaacttagcataactcttcttctctcagccctcacaatggacaatcagggctaagtttcactgagttctgccctgttcaggttcagaccagctcttggctaagaacctgaggtggacccctatacataattttggggcgaccttcatgcagtgtcctctccagagccccaccccacaaatcccagtcatgtcacgtcaatgaaaccactctgcttgggttccacctgggtgctgccgggaaggaaagcaccccaggaaggaagccagggcaactgtgggcgcctctcacgtgtttccctcctccaaaatcatgtagccctgagctgcctgttgttcagcacctgaaagcacttgctgtatacatttggactggttttacagctgtttcagcagaaacgtaagttttggtcccagttactctgtgatggctggaagcagaagtcttcactggtttttctgattattatccatgtcttgctttagtaacagatttatcttctgatacttaaaatattggttggtgttgatccataataagtgccaacaaatggtaccagtgatatgagaagtacagagagacaaacttttgcaggagttaaaggttaaggtaaacttcagtccagtctctatctgaattaccattctcttcttctggacagtgagaaaaaggaaaggaacagaactaccatctattccatacctgttattttccaggctttcttcaagttaccttagtatattatttgctataatcattaaatcaataaaataataattattacagcacgaagctgagccttagagaagtaaaataataaaactatgtagcttgtaagctgctggagctagaagttagaaacccatctttctccttcccaccatgctgctgctcttgccttatcatgagattaccagcatttattgagcacttatgttgcctgttccactgtaatttctggcccatggagcccatttaaattgcttttgcttagtcccttgttggttagagatgggccaagctgtctgatttctccctatcttcgtttttttttttgagacagagtcttgctgggtttcccaggctggagtgcagtggcgtgatctcggcccactgcaacctctgcctcctgggttcaagtgattctcctgcctcagcctcccaagtaactgggaccacaggcacatgccaccacgcccggctaatttttttgtatttttagtagagactgtggttttcaccatgctggccaggctggttttgaactgctgacctcatgtgatctacccgccttggcctcccaaagtgctggaattacaggcatgagccattgcacccagcctccctaccttcagttcttaggggagacaggagagtcctgagccattggatggggatggtcttccggaggacaaggtgctgggcagagtctaagggcacagagaagcttcactcaacctgaatgaccaatacacaaccggccaacccacagccataagtacagccagcagccctgatcagcctccgtgtgggcttccattgacggagaggccacagactcctgctttcctgcctcttcctgtccctgtcatctccccgtccacttcctttatccagcatgtgatatttccccccaaaatctaatctcttagagcagagaacttgttgcaaagtaggcaatggaattatttttctgattagacctgtgccacttttccttttaatagtttgatgtttgaccactgcttctggtgcctttagtgagataccagagtccatttttcaggctgagggagggtaaggtcttcataatataagaaggtatttggtgaactcagaggtgggcaggtgggtgagaaatacacatttcctatttgccagacattgagtgaagcactttctgtatatttctcaaaaaatggcgcacagtcattaattatagaaagtctaacaactcgtatatccttaaaagtatcttgcacagacatattttgcccctcaattaaatgtacgtaactttgcttcttcctttcttcacattccttgaccctcctctctccatacttgcttgacatgaggcatattcggaataaaaccttgttaatttctactcatctagtttgaaatacattgtgctttggagaggagcttggttgtagttaatttttgagccagctctgatacaaagctttctaaagaacaatggtagcagccttagttgctttctcacaaaaagtagggcataccatcttttaaataaagtgaagaaatatgtgattaagtcattataggattaaatatgtgagtacttgcctggggcctcttgagttcctaataggcttcttttgctttgcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctggtaagtgtcccttctgtgactaccaagaacaaaagaactgcagcaaagagtgagacagagcccagcttttgttcactcagccctatagacacaaatgggccagtccagtctacaggataactaattttagtggttcctgaaaagtcattcactaaacacaattttttttttttttggagacagactctcactctgttgcctaggctggagtgcaatggcacgcgatctcggctcactgcaacttccgcctcctggcttcaagtgattctcctgcctcagcctcctgagtagctgggattacaggcaccctccaccatgcctggctaatttttgcatttttagtagagatggggtttcaccatgttggccaggctggtctcaaactcctgaccttgagtaatctgcccatctcagccacccaaaatgctgggattacaggcatgagtcacagtgcccggccacacaattttatttttatttttgagacagtctcgctctgttgcccaggctggggtgcggtggtacaatctcagatcactgcaacctccacctcctgggttcaagtgaatcttgtgccacagctgcccaagtagctgggactacaggtgtgcaccaccatgcctggctaatttttttatttttagcaaagatggggtttcgccatgttggccaggctggtctcgaactcctggcctcaagtgattctcctgcctgggccttataggcgcacaccaccatgcctggctaatattttgtattttttgttagtgatggggtttccccatgttgtccaggctggtcttaaactcctgggctcaagcagtcctcctgcctcagcctcccaatgtgctggaattataggtgtgagccaccacacctgacctagacaccctcttttatcctgagctggaatactgatcacccccctcactggggcactcagactcaactcctttgccaaactcttcacaatagagagggctgttctagaagtttccttgtcattgtgttaagatggcgtctctaacttcaagcattctgaacagccttagggagcaaaggatcagtgtgttgtggagtgagaccactcctgctgctgtcaaacaacacagagacaattgacagcaagcaaggagtcccttttggtgagagacacacacatgcacacataacatacatgacatacacagacacgtaacatacatggcatacacagacacgtaacatacatgacatgcacagacacgtatacacacgctcaaaaacatgtcgtgggcattgccatatgcacttgaatacccagaggccggtgctgggagggcatactctggtttcgtatttgtaagctcagcagccagacaccaccagacacatcgtgggccctggacaggtgtgcttctcaagtgaatgaatacatgaacagtgttttctatgaagcatttgtgaaattatctgcatcattccatctatattttctagccactcggaacacaacgaaacaagtgacacctcaacctgaagaacagaaagaaaggaaaaccacagaaatgcaaagtccaatgcagccagtggaccaagcgagccttccaggtgagagatgattctgtcctccagctaactcctgctagcgcacccttctcctgcaggcagatgatgtgtacccaaaggaagaaggtctgccctgccttctataaacacatgcatgtggctccgtcctcccaagacatcattgcagacaagaattagtgcagagttgctcagaggctgtttgctcagcaactaaagccaatctgacggcagccaatccaggtctgggcttactccctggtttggtaactggccaaatagaattcaacccaaattcaactcaacttaaaagcgtctgttgggtctgtgtgccaggccctgctgatagaagacacaaacaagagtgtgacaacgatccctgccctcaaggaaacgctctgcgtcttccccttaagcacaagacaacgcaccgcaaaaaaattacttgcttcccagtatttcttccagggcaaggttgtaaaatgtgcatgccacacttgtgagtctcaaaagctccagatgcgtgtgtcctggccagcagtctgtgcatgagtgggcactgtggctgtcccttgtctgccctctgctttcccatgactgaattgggattcagttatggtgtcaagaaaatgggctgggcgcagtggctcacgcctgtaatcccagcactgtgggagtctgaggcaggcagatcacttgaggtcaggagttcgagaccagcctggccaacatggtgaaaccttgtctctacaatcatacaaaaattaagctgggcatggtggtggatgcctgtagtcccagctactcaggaggccaaggcatgagaattgcttgaaatcaggaggtggaggttgcagtgagcagagattgcatcactgcactccagcctgagtgacagaggaagactctgtcccccctcaaaaaaacaaaacaaaaaagaaaaaaaacccacagaacctgctaggaagaattgagctttctaaggtcaggctagccttaggagacttcagagccctttgctgattttacaaccttacaaagaactgtatcagataccatcccatttgagcctggctatacaatgagtcaggaccaggaagggttacttcaacttactgaagaaactgagatgcacaaaagataaaaagatttggttaagctcacatagtagggctggaatcagacctcaggtctcccagattagatgaggaaactttctgctgattacttattttaaaagagtttgaatttacttacagcttccattattttattttttaaaacagactaatctaggggcacagttgcaacatgatgctcttactccttccccttccgactttgtcctggaatggtgtttccaagcacatttgtttgttttgttctactggctcccccatagtcaccctgcacagattattggaaggcttcaaagaggccaatgcttgttgtcctttctcgaaggctggctctgcctgagggatgtttcaaagattgtctcagtttgggtgttttcattggaaagaagcaaacccaattcaaacatgttcagacagttacgaattgtactggctgtcaaacaaccttttatcctgagaccaaaacacaagttcagtcgtgatgttcaaggtgccacatggcaggagccagcctgggacagggccacccagcttcctgctggggaagaggctctggaggatatttacagaggctctgttgggtatgcagggttggggagagtctggaagttcagagcacgtgcgcagtttcacaggctggggttagagggcacatacaattccatatgtccaggttgggggctgtgggtggggaattcagagatttaatcagaacaagacatggtctcaggccacaggtccgtcaggcctgggatgtagttgggtgagtggaaagttctggggatgggaaattttgagacgtcttgaaagggcgcatgtgtgtcaaccttcaggtgtggcttgatcagagatggtgctccatttctctgaggttccctcagcccgtccctcctcctggctttggtgttgtccccaatccttccgacatcatcccaagatgcccagccgctgcccccaagaatgcacttcctcacttgtccagcagaaatccaaggtggtcttcatgctccattggcccaaataggcttgagcctacccttgtgtctcagctgagactgccccgcccactcctgtccactgtcaacacctgcactgtcttccaagaggcagttgtggcgttcctgtctcggggccgcaccaaccagaatgaatcgctcattcctctgtgttcccattgccaacgtctgctatccttcacatgcctttcttacccaatccactgtccaccccttgcaggagtgacagggtcttcgtgccttcctacagggcctagcaaacttccccacgctcagacgttctcaacatatattggttgaatgaaaggatgagcaagcagtcaagagagtaagaaccaaggtccagtccctagcaagaggcaacctggactcactcgcggtgctgtccccaacttgccttcagagcgttccttccatcttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtagggtggctcccttctggggtccacaatgttgctttgctccatcaggctgaccagggtggaatccctgaccactcctgctggacaagagtggtccttggacaagacccttgatctccctgggcttccattttttctcattctgagaaaaaaaaaaaatttaaatagaccagatcagatggactctaagggctccttcaatgaaggtccccctgtgccctgagtggggagaaaggttggagacagaagagaaggaaagccctctcctaagcaccctagatgctgcctcgtagttggtcctaagtccactacttctctaagccaccaaggcctcctctggctccaagggcaagtccagtttcccactcacacatttttcctcttactggtgatcgtgtaaatgcatgatctgaacagccctccgcggtcagcatgttccttccccttgtgccattccccagctgagcttgtaaaaataaacataaaatgtgcagagtcgggacttactcagtgcacatgcgcgcacacacacacacacacacacatactcatgcaaatgctcagcccaccgatgtcgaggtctcctgctgtcttccttctgaaatcttattagtatcacgacaatcaaaagtgacttacatgcaggctgggcacagtggctcacacctgtaatcccagcactctgggaggccaaggcgggcagatcactttaggtcaggagttcgagaccagcctggccaacatggtgaaaccccgtctctactaaaaatacaaaaattatctgggcgtggtggtgggtgcctgtaatcccagctacttgggaggctgaggcaggagaatcacttgaacccaggaggtggagttgcagtgagctgagatcacaccactgcactccagcctgggcaacagcaagactccgtctcaaaaaaaaaaagtgacttacattcaaccacaagtattcctggttttcttgctcactgcacttctcatactccatgtccttctcttgggttccctagggaggctgttttgttcccttagctgcttccctgggccaccctgacagccagggaatgcttgctgcttccttggaagagggtgagaggcagggcagagccagggttgctgacccctcaggagaagtggagagcctggcacagaagcagctgtcccttagtgcatctctgctccatccagtggttcaatggcattcgtattattatgacctgtttccaagtcacagatggaaaccaggactggggagggaggctggggagaaagcattgctcagagttttggggacagctagggtcagagttagaattcagcctcgtctgctctgctgagaccacttcaccgcttcccagtgcccctgctgtggaaccatgtggggtggcatccctggcgaagtgcccacaccaggattcctgcctcctcgggcgtgtctggggccggctgcctggggcaggcggggtgggagtgaggccctgactcctgtgtttagctccaccagcatcacttactctctcccccaggtgaagagaagcctcaggcaagccccgaaggccgtcctgagagtgagacttcctgcctcgtcacaacaacaggtgcgggagaagacaaacgctggaccacagaggcctagtccaaaagggcaggggtgaccaggagccaggctcagggagataggcggaggtgacctgtaggggagaagcccacagcagcctcctctccctctgagcagggacagggcctcagcaacctgcaggccccaaagcaagtgtcagaaagagggaacccaggaccaggaccaagcacggtccccaggcagagatggaacaccttccctcaccaccaccacgtgtctcccaccagcctctgagcttctcattcacagagacaccctgacttcctttagcctcgtgctgtcctaaagtcacggtagcaggagtgtctctctttatctctttttcacagattttcaaatacagacagaaatggctgcaaccatggagacgtccatatttacaacagagtaccaggtagcaggtgagtggggcactggctttgtggacaaaatgtacaccaggctgagatatggacaggttgactggttagtaggttggttagttggttggctggtaggttggttagttggttgattggtaggttgataggtaggttggctagttgattggtaagttggttcgtaggttgggaggttagttggttagttggttggttgcttggttggcaggttggtttgtatgttggtaggttagttgattggttggtaggttggtagattggcaggttggtgggttagttggttagttggttggtaggttggttggcaagttgataggttggttggtgggttggttgataagttgataggttggttggtaagttgataggttggttggtgggttggttgataagttgataggttggttggtaggttggttgttagggtggtagattggcaggttggttggtagttttgttggtagtttggttggttagctggttggttggttagtgagttggttggtagatagattggtagattggttggttggttagtttgttggtaggttagtaggtttgttagttggttagttgattggtaggttggttggttgactgaaaggaccccttccttacactgcagaatgtgtgagtgaaagactaatccagatactgacgtaactcagaattcgcatgaaccagttacaggatgctgtgagcaaagtctcaagtcagccctatcagctcctctcaagctgatctggaagggctgtaccccgggcctctgccaggggtcaagagtgggaggaaggagccacgtagccagtcagagaggacaggcttccagaaacactgccattgtttcctggtaggagggaaaaacagactctgagtctgcatctgcctagaaagtaaacaaatgtcagcctccaaaacctcagcagagcagcatctggaaaacccgacctctttcaggagatgttaatgtgcttctcatcatcttcatatttcaacatttcttttaccaggcgctctcggtgtccttaaacgaggcctggcctctgagcctttctgaggggcttttgtgagagaagggtgcctcctgaggggaagctccctccaccctcaccctgtcctccctgccctgttcctcaagactcctaggaaatcccatggggagggacctacttcctgagacagggaagagaggctgcagcctccgccttgctctttggggatgtcctcagcctgccctgtggccctggctcctgctgcccccatgccaagcccagggccctttgctgaactccctctctctattgacagtggccggctgtgttttcctgctgatcagcgtcctcctcctgagtgggctcacctggcagcggagacagtaagtgtggcatcaccaaggcagcccttggtcagatcaaagtcctgtacccagccccaccctgcctcccccctaccccctccatgctctctctaatcacctgcagttcagggagtggcaaagggagaggccaatccatgcctcggaaagagtcagttaaaaagaattaaagcaccgccgggtgcagtggctcacgctggtaatcacaacactttgggaggccaaggctgagtggatcacctgaggtcaggagtttgagacaagcctggccaacatggcaaaaccccatctctactaaaaatacaaaaaatcagttgggcatggtggcaggtgcctgtaatcccagctacttgggcggctgaggcaggaagattgcttgaacctgggaggcggaggttgcagtgaacagaaatctcaccactgcactccagcctgggtgacagagcaagactctgtctcaaaaaaaaaaaaaaaaaaaaattaaacgaccagggaaatgggaaggcaaaggagcctcacattcattgagcacccactatacaccaggcttgatgcttgttttataaacattattgaaatctaccttctcagaaacctttggaatagctgtggcctagagagatgcaacagcttggagaagatggcacagcagaggccagcactgcaacatgaatctagagcccatgattttcccacccagcccctacctatagaggacccagggcagcatctatgctgagctttgcctatcctgtgctccccaccctcccgtccacagaagctcacaccggcatccccttgaccaggaatgtaaaccatgtgtggtctttttgcattaactcagattttcaaccctgcatgcatcttagaacatccaggagacagtcttctaaaataccagtgagtggcaagatatgagtaaattccacaggaaaaggaaggcagtccaaagggctgtgcttctcctgtggctcagtgttattcatagctgtgacatcttttaagagaggtttacaagagggaaatcctgtcaccaaaaccattgtgacccactttgaatttggggggaatcttcatttgcaacaatagaagaacaaatttgttgcaataggaaatatttttgtagcttatgtaggttgttcagccaaaacagcataataatttaaaaagttaaaagatagcccaggagttgtggctcatgcctgtaatcccagcactttgggaggctgaggcaggtggttacctgaggtcaggagttcaggaccaggctggacaacatggtgaaaccctgtttctactaaaaaatacaaaaataagccaggcgtggtggtgggtgcctgtaatcccagctacttgcgaggctgagacaggagaatcacttgaacccaggaggcggaggttgcagtgagccaagatcgcgccactacactccagcctgggcaacaagagtgaaactctgtctcaaaaaaaaaaaagaaaaaggtaaaagatatcaatgattgggctccagtcagaatgtctgggggtgagcccaagacatcagtacgtatttttaattgagataaaattcatcatttaaccatcataaaatgtacagttcagtggtgtcttagcccattttgtgctactgtaacagaatgcctgagactgggtaacttataaagaacagagatttataaagaacagagatttataacttataaagaacagagatttcttaccattctggaggctgggaagtctgaggtcgaggggcccccatgtatcaagggcgtttgtgctacgtcatcctgtggcagaaggcagaagggcaagagagtgagagacagcaggaggggctgaactcagcttttatcacaaacccactcctgcaataacaacattaatccattcatgaggcagagccctcgcgacctgatcacctcttcaagatctcacctgtcaacattgctggattagggattaagtttccaacacctgagctctgggggatgtattcaaaccacagtaagtggtatttagtatgtttgcaatgttgtacagccatccccactgattccagaatacttccatcattcccaagagaagccccacactgccaagttccccattctccccagccccgggaaaccaccactctatgttccgtctctatggatttgcctattctggacatttcgtgtaaatggaatcacgtggccttttatgtctgggatagtcgtacgttttaaagcccctcagatgtatctaatacatatgcatccaggtttgacaaccctacacccggccattggttttcaaacttgaactagcaccagaatcatctgtaggaacataaagaaacgataaatgtttgagatgatggatatgctaaataccatgatctgatcactgtaccttgtaggtatcaaagcatccctacatacctcataaatatatataactattatgtgtcaacttaaaaacatttgttgaaagaatcatctggaggccttgttaaagcacagattgctgggtcccacctgtggagtttctgacgcagtcgtcttgcttaggtccaggaatctgtatttctatcaggttcccaggtgatactgacgctgccgttccagggagcagactctgaggatcaccgcactaggctaacagcattaagaatcagggaagctggccagactcacgcttgtaatcccagcactttgggaggccgaggcaggcggattacttgaggtcaggagtttgagaccagcctggccaacatggagaaaccctgtctcttctaaaaatacaaaaattagctggctgtcatggtgcgcacctataatcttagctactcgggaggctgatgcaggagaatcgcttgaacccaggaggcagaggctgcagtgagctgagatcgtaccactgcactccaccctgggtgacacagcaagactctgtttaaaaaaaaaaagaaagaaagaaaaaagaaaagaaagaaaaagaaaaagtaaactctagaaactccctctgtctctctcttgattatccagggcctccctgacccctgccagcatccactctggccaaccctgatacaaactccacagtaagaccctgagaaaatacagatccactcccccaaaaccaaagcccttagcccagccagagagaaaaataaaatatctcttcccttcttatatgggtcatcaggtccataacatactcctaattttcctcatgggaattaaaaagtataaattactgcagtgcaaatgataagccccctagggttattgtagcaggaatgattcatatacccggcagtctaccagtttctctaaggggttagctgactcctaaggtgtcattttaggcttccaggaggggaaggatgtgacgtggctgacatgttgtacgtgtactcagtacttgcatcctctccttcctcaggctgaacacctgacaagccttaacaccttgcaaggatttttttcatttgttagtttgaagatcaaaagccttcgggcccagaggacaaagctatttggaagtaggaatggttcagtgtttatgttgtgaaacaaataactgtgtgaacctatgtgagttcccacaaggtctcccagaactacaatctttggggagactcaaacatacatctagaaatgacccctctagtcagtttgtccaaaagccttcctagaatctgatatcaacccatggtgccctcttgtggcaacagaaatgctgcatttgaattaccgaaagatcactgtagcccagccagagagttttggttggggaaatattttttgtttgtttcgggcaatgaccaggagcccgtgatgtgctacagaaggctcacagtggcttgtgagagccagcggttaaattttcgggacttctgcaaactggtttttaagcatagccattatggaaaattaaagtatttaggctgggagcagtagctcctgcctgtaattcctgcacttcgggagactaaggtgagaggctcgcttgagaccagcctgggcaacaaagtgagaccttgtctctacaaaaacattttaaacttagctaggcgaggtggcacatacctgtagtcccagctactggtaagggcgaggtgggagaatcccttgagtccagcagttcaagattgcagtgagctgtgaccatgccactgcactgcagcctgggtgacagattgagacgctgtctcaaaaaaaaaaaaaaaaaattaaaatatttaaatttacaatttaataaattatattaaaaacaaaggcaagaattacttacaactgatcacttcctaattatttgctaccttttactgttatctttgttcgctgggtggtttacatctattgtgtccgcatggtggaaataccgtttgacggtggctaccgcgcatctcttcccaaccgcgtgatcagtgatgtcacattgccagctggaagctgtgtgtggagggaggattgacaccagggaagacaggcaaccgtcatcagagagctgcttgttaaacatcaccagcacacctctgcttggagtcttgtgctatgggaactctgtgcaaagtagggagtaattagaaattcccatgagccaaataagaactgggaaaaggctaagaccgtattgtccaatacagtagccactagccacctgtggatacttaagtgtatttaaactcaaataaattaaatacaattaaaaattcagttcctcggttgcactagccacatttcaagcgttccctagccacaggtgtctgtgttatcggacagcacaactgcaaaagatttccatcatctcagaaagttctatagcacagtgctggctagaaaccaagtgctttactgcatgcacatcatttagcacagttagttgctgtttattattcctgttccacagctattgtctgccatataaaaacttaggccaggcacagtggctcacacctgtaatcccagcactttggaaggccgaggcaggcagatcacaaggtcaggagttcgagaccagcctggccaacatagcaaaaccccatctctactaaaaatacaaaaattagccaggcatggtggcgtgtgcactggtttagagtgaggaccacatttttttggtgccgtgttacacatatgaccgtgactttgttacaccactacaggaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacagggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaacgttttgtgtgtctaacaattcccaggtgctgttgctgctgctactattccaggaacacactttgagaaccattgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaaaaagtcttggtttttattataaatatgataaatattgctagctataatctacataaccaaaaacctttatagttttttggtgctttttttttgtttttttgttttttttttttttgagatggagtgttgctccgttgcccaggctggagtgcagtgcacaatctcggctcactgcagcttctgcctgctgggttcaagtgattctcttgcctcagcctcccaagtagctgggactacaggcacccaccaccaagtccagctaatttttgtatttttagcagagacggggtttcaccatgttggccaggctggtctcgaactcctcacctcaagtgatccacccaactcagcctcccaaagtggtgggattacaggcgtgagccacggcacccagcctggtatcctctatagtttttaatagttttaaataacatgcaaagatcctgtgaaatggccaacaagcacatcaacatcactggtcatttcagaaatgcgaatcaaaaccacaatgagatactacttcatacccattaagatgactttaagaaaaagaataggaatgctcacagatggctggtaggaatgtcaaaatgtgcagccactgtgcaaaacagagtctgttttggcagttcctcaaaaagctaaacataaatttgtcctataacccagcaattgtattcctaggtacacacccaagaaagacaaaaacgtgtctaaatacaaacttgtacacgactctttataacagcattattcatactcaccaagaggtagaaacacccaaatacccaacaacaaagggatggataaaggccgggcatggtggctcatgcctgtaatcccagcactttgggatgccaaggtgggcagatcatttgaggccaggagttggagaccagcctggccaacatggtgaaacctcatctccactgtctctactaaaaatacaaaaaattagctggtcatagtggcgcgcatctataatcccagctgcgtgggaggctgaggcacgagaatcccttgaacctgggaggcagaggttgcagtgagccaagatggtgccactgcactccagcctgggcgacagagggactcttctctccaaaaaaaaaaaaaaaaaagaattgataagcaaatcatggcatatccct

SEQ ID NO: 11808 - DNA, 636591 bp, Human
  misc_feature (1)...(636591): n = A,T,C or G
tgattttcctttttataaatattttttattatttattagattaactaatttgagttgaggccacaacatggttgagtaaaaataatcattttcctttttataaatattcaataaaacttttcctttttataaatattttttattatttattagattaactaatttgagttgaggccacaacgtggttgagtaaaaataatcattctgagaatagcaataggtttagaaggttaatttagggtgcctctctgctattagatgtacctgaaaaacacttctaggcaaaattagaccaaattaaaaacactggggcttcaattataataaactctcaaatataagttttattattgtttattataataataaataatgtataagtgtgcagacatgggcagactacattttgcaaatttccacagtaaggtaaaaggattacaaagctttctggtataatattaacagaactaaaagacatgaataatattaaagaatgggctttggctagtgattttcaatcaattctcttcaaagcaatactctcttaattttactgaaagaaaattcaactttaatataatatttagataaatcaatacatcttaactataaaaaagaaaactatctatataagacaatatgtatttcaacatataaatgcttgggtaaaacttccttaggaggcaaaataaaataaaagtttgcacctattcttagatgaccccagtgtaatcgatgggatgttgatattgtgctggtgactcaagtaccatgggcaaggttgttatcagtgatgtgcttctctgaaagtacatctttacacccattgacaaatgggtgtaaaatccaaaaacacaaagtaaattatcttctcaatgtatatagtagatgcatcctagaaaaaaacaaacaaacaaacaaaaaacacacacaaaaatttgatgtggaaacaaacttaaattaggtttcaaatataaggcaaggttttgttgttttgtttgtttgtttactcactacataaatgaccagtggcccattcagaagtctaaggacaaaatatgttgtaggactgtcctgaccactgagggacagctcacaccctgacccaacagtacactaatgcctgcagtacccaccgttcccggagtaaaccaaaagacatcctgcgactcacaaaatccattatggagttgttttaaaccttatgagaaccactgacctaggccataaaaaacaaatgaaaaaacaacaaaaactaggaatggcagtagttctgttgagttaaagaggagaaagaggagaaaccaggactggaagagatgaaattgtgagtctggaaggaaactattgcaaaggcctttattacctttaagtaaatgtctcctaactgaactgaaagccttcattctaaccattagtttggtcaggaacatttcagggacgccagggtggctgttttattttgcacttcctttactgccctcccagcagcctacctagcagtaagttccccagcctgcagtgtccccagagggcaccttccctcggctagtaacttctcagacactctggccttggggatgtcttggatcttctaggtacacagtggctgcacacagttttgccaggcctttctcaagaggtaaaagttcctagctgtttgcatttcccagaaataatgttttccatgtgtagggattttacagatttcaaagtgctttcatgtcaattactttctttaatttaaaagaagttcagataccaggtcaagctaggaatgatccggtctcagagggaaggagcgctctaggaaaggaggatcctttaatagagggccgtcctggggccgcgtgcccatggaaggcgagagtggaggagtgtcctctttctcccccaccctcaggcggcggcccggccaaagccagagggggctgtctcctcctcttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtagggggaattacctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagcctcttagtgtttatgtatatatagctctcatttctgaaactttggggagtctttgaagagttattttattatcatgaattttacaggaagcacatgtgcagcattgtaagacatactttgtaacacattatttcagcaaacaattctttaagttggaaaacctgtatcaaagtaaaaaaaaaagaaatatttattattcggttttaaatatgaaaatgtttaacctaagagtacaaaatctgtaggttagaagcttttaaaagttttaatgaggctgaatctgcttaagttttgaagtatacttatccttcttccagttaacttctagccaagtcaatagttctgatatttgttcttataatctagcatttttagcagtactattttttaaggagtaaagagatatcccaagctctttctataataataactccctgattaaaattcttggaataaaaatgaccttgcattcactatataacttttttccttctatttttgcttttgcttctctgagaggtaaaatggggccaatatgacttaattaatataatttacgagagtgattttaagagtatctctggccacttatttttaaaaattctacttttaactattaaactttgctcaattacaaggtgtgtttaaacaagacataatactttaataatgttaggcagctgggagaaatgaggggccaggggcaccaatccttatgtccacttggaatggggcagaaactcaaagcatgcagagtaaggatcaagtaaattgttgctaagaattatcctgaacacacacaggatttctcttttttcctctcccttcttatttactctcttttcaaataaggtaatattaactctgatttctatgacccaggcacaagatgaagtgaattcaggaggaagggtttatactaccattctgtcaagataccacttaaatgctacatacaataaggaattttattcaaaatagctacaacatacaatctactataggctgctataatctgcattctagtatatattattgtctttgtcatagaccatttacaatatatctggaggttggctcaaggataaatgacttaaacctgttaatgttgaaagtatgtaaaattcatgaaactttaaaattggatagtgatttatgatttaaaaatgccttatgtacacgatctttattcaccttcagatattattattctcaaaggacaaatttagaacttaggcttccagtagttgtaatttaagtttacataataataactttatttcaacaactaaaacacttccggtattgtttgtgctgaattcccttttttatggttccaaggtttctttccattaattgtttaggccatgttttctttttagtgttgttccattgaagcaagccctctgtgaaaatcacgggatatgagtttgactggagaagggttttcctggctatgatcaacttttctgttttcgattatactagcactgacctttctaggcaagcgctaattgtgtagaagttctatttccccttataattcgataccactttattaagaatttttgacatgaatcaaccatttttagatgttgcagttgagttagaaacataaccagactttttgttttttactttttctttgaaatcttatgtggtttctatagcatactcgattgtagtatgaatagcattgattcagcaagaatgatattccaaggaaattctttagctatatttaaaattgacgaaatagaatgatgcaatcaaaatgattctgcatttcagcaaggcagtgtctaaaatgttttctgatattcttgtgaataatatgtggaaactgaagcataatggcaggtaaattgcaactgattgaaaaatagttcacaaagaatattgcatagtggattaaggtcaatccggaaagaagtctctagcagtgcaacagaggttttcttatactcaactatcttggtaatggcttgatggaaaatgtaaaatccaagcttatcagaactgcatgtggtccaaaattgatagaggtggctaagctggttactaacaagttcagaaattttaaaggtctctatagccttgaccatgaatggcacctacatgaagttgcttttattattcatatccacatgttaaaaaaaaaaagtccatttgtgctcttctggaaattagttacattgtttatatgtttaggaatgaatatgaagacaggaagagaaaggccactctgaattgcagcaagttcgatatgaacatatagtgtaatatggtgacaaaaaaggttggctcacttttacacaaaactcatagaagcacataggtctgttgcttaacacacatttgggtatttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccatagaagaacatgacaaacaaccaggtttgaattttataatatggagaaaatagctcctctcctcacttcctccccatgccattttgagttgttcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgcatttaaatttctgaattcttaaaatgtcaagaaaatgttaaatatataaaaatgtgtttttaaatcccttctgggatttaaaataaaaacatgtttgagacaatcctcacacatttttggcaagaatacttagatatttagcatggattttccacatcatcgtcaattgcacagttctaaaacatcttgtgttataacacgcaagaatactttataaattacctgagaaattttcaggggattcatagtggccataaacctggaattaatttttttaaatatttttctttgctgcatatgttaactttttggcttgtttgccatatactgacctaatcatttagtaaaaatgattcataacagataaaatgcatggcatttcaacatattcaaaatatttatatgaacatattcaacactgaatattatagatgtgatagaattaataaaatttatataaattttatattatgttatatttcacatatcaatgtgtacagatttctggtctatcttaagatttttctaccctaggatttcatgcaaactaatgaactgaatctatatcaagggatgctgggggctgggcaaggtggctcactcctgtaatcgcagcactttgggaggcctaggtgggtggatcaccttaggtcaggagttcaagaccagcctgaccaacataacggaaaccgtgtctctactaaaaatacaaaaattagccaggcgtggtggcatgtgcctgtaatcccagctactcaggaggctgaggcaggagaatcacttgaaccctggaggcagaggttgcagtgagccgagatcgtgtcattgcactccagcctgggcaacagagggagactctatctcaaacaaaacaaaacaaaacaaaacaaaaatttaaaaagatttgcaacttatcatctatccagtttgcagtagggccttatttagcatctagaaaccatgtgaaaaagatcaggaagaaattattgtaaataattattgtaaatggttgcacaagtggtttaacttctaatctagaagattcgggtttaggatttgtttacagttgcaacttgagcctcgatagctaaacaggaatttaggcagaagctccgtttcagtaaatgagaaaacaagacagagtttagagaaagataaaagtagattttccaggcttagtatataccaagcagatagaaataaaactaattctaggctttccccattggtaagactgaatttagaggtcagaagttgtgaaggaaattggtggggttgggcctatatgcattggaatgtggtaaatgaatgaatgtttacagtgagtaaagaagataaaaaaattcctgctcttgtggaactaatatttagttgggatggagatgagcagacaggactatgatgaatatatgatgaagcaacaaaagaacacctatattgtataaaatgtagttgatgaaaaatgtcctggacaaacaaatacaacggggtaaggacagtcaggagttctaggaatggagggaggttgatggctattttgttggtaaaggttggtaaaggttgacctctttgagaggatctcactttggcaaacacttgaagatgacgtgggagtgatttgtgcagttatcagggggaagagtactctctgtacagggagcaggcctatgaggatctaagcttggagcatggtgagaaggctcagaggagaaatgggaaactggaacacatagcattgttgaccttaattttaaagattttgcctttttgtctgagtgagatgaggaggcatcggtgagttttaacagagttaaataaatgaataaaatcacaggtttttttgtctcaaatacgcactaatccatgggactagaccaacagtccaagcatagaattattttagatttatctcttgtcccaaacactccactgatagaacacatttaagtgattctacattcaagagcattccacttcaaccatcttatcatggtgaagctcagatgtgtctttgtaacactcttttcttccctttggcaactcagtgctattccattattcaaaatatatcagtacctcagaaacaatttgtgtgcagggaacttccgcagcttttaaaaattttgctccagtgtagttagaaatatgacagatttttaagggtaattttaaatagtatgcactttaaaacaaaaatgaattattcacaatcccacatggacatataggtactttggagttcccttttttattatctatttcaatctcagacgctaaagtttagacacaattgttgaaaatgacatagtgatgtattgatctgatgatttcttttatgatatgaaatttgaaatgctacctgttttacattcagaaacttattctatgttctgtttccatttttgttactgttttaagaatcacttgtaagctttaacaataacgttttggactatagtaatgcaattttggcctaatttaattctgtcatttagaacaaaaaaggtaaaaaaattggatagcttttccttctctctccctctcttctctttctcccttcctttcttccttcctccctttctttattttccttttcccttagtattcttcctgtgaataaaataaggtaattaaaatagataattctaacaaatataacatttaggaagatagtaaggcaaaactttacttaaatcttccttattaaaagccacaggtaattactatctaaagatagtttgagacatattttcagggtgagttaaagctaaagacatttgcttgtcaaagatgtataatatgggtttaaaaatgtttttctcctaagtaatcttgagtgtggatcttaatatgggaactttatgctatttggattttatttggacacgtgacatttacaaaagatcattgaggattgcctattaatgggttattattcataatatcggcctctgtgacatgcctaatctagttcaaacaacaagttaatctatgcaaattcctgatgatgaaaacctcaggagctatttagtgcctggcacttaggaaatgtaccttgtgcaatgttaagtatgtctctgtatgtgtagtccactcaactgacccccgaactgtgtacctccccaaggctcttcatttagctgcgtcttgagtgccagatggtttagattggtataataatatgtagtgcattgtgagcattaacacatttacttacgtagcagagctgtttagtagattaatataattatcctcagtttgtagaaggaaaatatgcccagcaacttgtcaaggacaaacaaaaattccaatgcttattttagaattagaaattaaattacggtcctgctcttgactttgtagatgctaactatcacctcttttggacttttatatatttatctttcataaaataccctgaggaaaaaaaaatccatttctaagttatgttagtctatcatatccagagattcatttggtattatggaagaacaaaaaataaaatgtgtagtcttgaagggtctttttcatttaaatacacacacacacacacacacacacacatgctgcttattactatgtagacatatacacacatgtattacttaaaactatgcattaattcaaatgcattcatcaaattttagtgtttacattcttggaactttgattactggacactaggctataagaaaatattaattgattctttattggcttttctgaagtaactttacagaagttacttcagcaagctagaaacaacggtatttattatactgtataatgaaccctttaagaatagtcaatgtgtaaatgtcagtgaatgaaaagaacaagaaccaaacagatatacctaagaatcagagcaagattaatctcaaaattccttctgaaaagatgaaaaaccttgacatcttcataaaaacatttaaagactttcatttgaagttgaactcagttaagacaaaagtcttccaatctcccagattttgagagggtgtatttgtgtatgtatgtgattgcagcaccagtgcacatgtaccatttacagcctagcactcacaggacctaatttgtatatttagtatgttttctgtttgatttttgttgtcttaaggtattagattttgtttatcaaaatctttgaataagaaaatctaaaaattgaatttctagaaaactctagttgccttgacaaatgattatggaccaaagaataaattataaatgagacaattataatattccatccagtagctatactgttaaaattccaaggtataatccctttcgagttgcttgtaacttagaaggtcctattctatagaagaaatagagttagtagagtttgctgcatcaaatatattttttcaaatgcctacatattatagttgacacaatttcctggctttattgccttctgtgcaattttcaattattggatgaggctgaaagtttgaaagagaatatgaagcagtgcaattgtcatttcagtgagctacctcatctcattggtttgtcgtggtacatatgtaaaacactgaatataaaacatgaaacatctagtaaggcctcaataaatgttcattttcaaaatgcctcaaaaaatgaattaaacctaacaacctaacatgacattctctggctgaaagaaacactcttctccaacatcatgtggtataccaaattcagttgagactgtttgtgaaggaaggaatttgcttatatacttaaacacacaagtatttgaattctaattagaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagccaagtcaccactttactaagatcaaaagcctgagtcaacggagttaaattttctattcgtaagataggtttaggttagataataaatgtgaaaatacttgccagctaatcagtaaatactagctcttttcttctttattttatgagcataaaactaaaaaaaaagatttgctttgcatatagcatatcctttttgcttaagaacagcaaaatattctaaaaatttctttgaggagaccctaagagactatagatggcaaactatttatctcattgccaagagattgaataattctgtcgaggttacacagcaagtcagtaacagagataagaagaaacacaagttcctataattagctaacagttatgttagtagctctgtgtgagaagtgatttaaaacaggcaacatgatggaaatttttgcaataatttgtagttattcatacttcaaatgtggtacaataaacgttttttctaggaatctcattgttgaatatgtatttattttgttgataaactattttttaaaaacttctttaatacttataatatgtttagataaatatatggcatatagtaagcacttcataaaggttagttattattcttagtctatgaagtatatgttttcattgacatctgcttgggtagagatgacaatgtggcgtgtttgacacacaatgtaagttaatttcagcatggccttcagtggaaagtctaattggattgcagaaaatctctcaatatagattgtctttatttggactctccctaattactatagtaaaaaaaattcttggaatacattatttaatacaactctggatagggaggattcttagtgtgtctacttgtgtattaaatttttagtgtgtctattttgtattaaatctactattaaaaaaaccaccaaaaaacaaaaccaaaaaacctacttcagaaaatcatatagtactctaacaaatctctagagaaaactgcttttctaaacttgggaacgctggattttgaaaatatttcagacaaaacacttcttaaaggcccgtttaccatcaaaaagtttcaatcttgcctaacacataatgtgcaaatattcattttttcattctgatacattagaaaagtcactggatttgtaattggaattccaaaatataaattttccctctagctcttcctaaagagattaccttaaacatggataagtcacttaactattctgaaattcaattttccatctaaaaaatgacaatgtaatgttcgaatctatttcatggggttgttataagggttaaataaggcagaccatacaaataccattattaatactatttgttattataataaatgacagagttggtcttaggcatcattggttatgaagttttgctccaccccctttctttgttttttttccccagtggctcctaaccatttgttattaattaataatgttatgtattaatatacatatatgtattaataatgttgttaataatgttatgtattaatatacttagttctcctgttttcaaggacccatgacacatagctttcaaacatggcacaaattatttgtttagtaaacatatacatactactgcataagaagaaaatatggtatctgaaagtgtacatcagcttcctacaaacaagtagcaaagagtaagtattcagtgaaattataaaactatcataaaaatagcctaagggctctgaaacattctatgtcaagattcctttttatcctcttaaaaataattgaaactttgatttatggtatatctactatttgattgtattaaaattaaaattgggaaatttaaaaatgtttactaattaatttaaaataccagtaataaaacaattacatgttgacaaaaagaacataactttatgaaaaataattttatatccaaaataaaactcttcaatgtctggcttaatagaagagaactggattctcatttctgcctctgcgttcaaattattacatgttattttagtttaaattattttggtttaagcatattaagaaatatataacaacaaacatagataagctattggaaaaaagaggagtctgtcagtgccttttaagatagctgtaaatattctttgattctataccaaaactcagtaagtggtagttttcaaaagattggctgcagtgtggtatctgaaactgcatcaacgatatttttgtacgcttttatattaaaatctacggatctatcttacacctggaaagaattttacccatgtgtgatgttatagtatcattcatagatcatttggaagatactgatttactagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagtttctgtagttattgacaaattttgttatttttcttgaaatagttactttattcattcttaagaaaatgtttatcaaacaaatgagtcttaaaaaccatagttagatcctttttgtagtacatagggtattccacgaaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactagttgtttttttcttctgggagtgtgtggtggtgaaaactaaactgaccactagcatggtttagtacccctgccttgatttgtgctaatgtaccatcagtgtttcccaccactattgcttttgcaccatcagtgcacatgtcaacacaatgaaaaggcagataataattaaatcttgttactaaaaggatttttgaacttgtgtacctatggataatgtattgtggactcccagggattcacagatctttctttgagctctacagggttggactacagttaagttcctcactgcctgcctcttcaccaattctacaaaatctatagccatatgaaggtaaattttgcaatcagaaaaagccaaaaccacttcagtttttacctcaggtctagtctaggagagtgataccatttctttttaagggggaagaaatccagaaaagcttcttctgtggaaaaagcaggaagtgttaaaaccagccagacatacatatagaaatcaaaatctctgccatatcatctgcccttcttaatttcctttcacttgcccaaactatagtagagatagtgtacttacccacagttggacatatgatgttattcctaatagacttaaaaagtgaactcatggcggggcgcggtggctcacgcctgtaatcccagcactttgggaggccggggcgggtggatcacgaggtcaggagatcgagaccatcctggctaacatggtgaaaccctgtctctactaaaaaaaaaaaaaaaaaaaaaagcaaaaattagccgggcgtggtggcgggcgcttgtagtgccaggtactctggaggctgaggcaggagaatggcgtgaatccgggaggaggagcttgcagtgagccgagattgcgccactgcactccagcttgggcaacagagcgagactccgtgaactcatgagcaaggtttagtacaaaggaaacatactaatatctgtaattctgaatattagcagaagagatttttattccttgctgagctcctgaactcacatcaggaggggtcctttgttcttttcatagaaagaattcctgttggaagcactggatatcgtatttctcaaaatatggaatttccttcatttatttctagcctttgaagttttgtgatttctaaagcatttaaaaggttttgtaatgttgagaacctaaaacgtgattcttttctctgtgcccatctcataccattgtatgtgtgtcatatgatggatctggtttctttttcttatttgttgggagatgtccagagactcaaggatctatcctttgaccaaatttttcactcttcaagggcctcatactgctctgatttcagatgtatagatatattgcttatcaaacactgatgggtctgaacatgagtggtagtaagatatttccagattaagtagacaaattgtgcagaactttttagtatcactatttaaatgactaaatttttgaggtttatgtgtatccagcccaatatgtcctctccttatctagtataatttatctttaaaaattagactggcttggcatatgtcagattttgtatttaacagactttttatatatttctttgttaggaggtgttcaatgttagacaaagtgaacagattactttggaatccatgtcctggtcctgctgaataacatgtcctcaccctccttccatttttttttttttctgccatacacattccagtaacactgaaagagttaattgatgtgtcccatctttattgcttttgtaaatagctatagatacactttatatgtagataatggtatgttttaaaattctgcaaaaatagcttttcaattctctttattctctttctcaagctttgataaaatatttttcattcaacttttagggactgattttctccatagagttcctgatgtggtgctactggagtgatgctgagaaaacattattctaaatgttttttagaaacattttttagaaaacatcattcacccagaatctgaaattttatctttatttatttattcctttggataaaacattgccctcacaggctattcttttctaaaatgtttgctgtgctgttattattcactttaatggaaattaatttatctgctgacctcctttttgacagtttaggactgtattaagttttcagatctgctcggtgagaaatagtgaaataaaactagttaacatctatggaatacctaactatgggccagcactgctgtaagcatgtctcatgccttaatttatcaaaggtagatgctattaatctcatttaacagaagagaaaactgaaatgcaaaatgttaagtaactttccaaaagtaaaacaaccagtgaactggtagagaccaagatttggacctaggtagttctactttgtggcccattcacctacccatggcagcgtgtgacctcaaccctgaaagagtacaaattagtaagtaaagggcttcctttagtgacatacttcagaggtgattttatttcccttttttgtgagatttcctatgaaaagattaacaatttaaacaatatttgccatttagattcagcactatgtcctgatatatcagaagagtctatgaactttttttttttaaagactccttggagatagcaatgaatgaattcttaactgtgtcaggcatgcctgaattttttgagtcatataagagtttgtagcactcctagaattgttaacttaattggtaagaatgtgctttttttctctttgttgttgtatgaagtgttaaaccaaaaataatcaaggcccagggcttttcctggtccattaatggatatatgacaagtgatggcaaaaggatagttacagttattaacttaatcattaattggctcagggtatccccaaaaccgcagttggaactgaagtgctacaaaaatgaccattttgttgttatagcttttcttcacataaggaaataaataagcaaaaagagggagtgtcttatctatttgttgatcaaagatcttgtaattctgcttatggtaactcccagagtagagaatatcatccagttggccccctttatgaacttggattgcaatggaagtcctatcggccagtttactagttaacaggagctgtagtactagagctatgactgcatcagaagtccagcagtgtgggcacaaagcagcgcagcacttttgaagttagacatcgagagtttgagtcctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcatagggtagtcaaagttgccactatcctggttatggatggtaatagaactgcctatttatttgatgtcttcacttagttgtctcctaggtccttcacagcgaacatttgccaggattgaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattccataaatatccacatctttttgtccctattgccttctagaccacagcactctttttttgcctatgcaacttcagcagcctcccagctgctctcccttcttttctcttttccattttacaatcaattttccatgcaataggcaaagtgaactctgaaaatagtaaatcagattagatctttcctctgcttaaaacctttcaatgcatttctattataagaataaattctaaattcattagattttaagtctattcatgacagctcttgtatttttctctgatttcaaattattctctttttctgttatttaccagcaacagtaaagactttttttccgtctcaaggcctttgtccttgctgttcctctgtccagagcattgttccattagatccctgatggctgtctccttctcaatattccaatctcatgtcaaatgtcacctcttacagaggcctttccagaggaccactttaaattagcttctgtcaggcactcatctccctgttgtaatttctttgaacaattaaatgtttatcttgaatacccttgtttatttacttttcttctttgttgtttgtctccccagactgttggaatataaattttgttataaaatggccttcatctccagagctgaggagatacataaatattttttattttgaattaacacatggctgtgttcaggctcttctgaatgtaattccatggaggaggtcaaaattggattcctgtatgtagtgaatctgtcccgtttatgattttcagttatataattagttagaagaccaatccaatcatatttcagataaacctcaagagcaattgctatggcagagaactagaagggtatttaatcaactagttccttttccaagatctttagctctttaacagttataaattaataaagtatgttatataatgctaggactttttgtctttcattgtttctgttgctttatctccagcttctagtctgacatatggtaggcactcaaaaattggatgaagaagcagctctttttggacagaccaagagtgttgccttttaaaacattttatgtgtactttttccccctgatccttttatagtatgaatgaatgtttgtataagacataaatttctacaaatactgaaacacagtatggacagatatgagttattattattaatatcacctagataatagataaaatattttagaaagtgaggctaccttaaattatcttgcttcttgagttttttttttcccctctaaggatattccagtaagagttgagcagtatttaagctttggataaggaatgcatatttcttggcttagtcagaacttttctggatggaaggtctttttggatgagaattatactacataagattaaaatgcccatttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacgcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgatagaaaaatagaaaaggaagagctaacttttaggaaggaacacttacttcccacttacagttattgaaaaaactatgaagatggttaacatcatgatactgtcggatgtaggcagttacaatttctactcaacgatagaaaaaagaactaaagagaatttaccaggacatgaaagaaaggtgtaagatcatggattcctgaaacaggatgttccaattaaatatttaaatttaagtgaggattgtaggagtttaacagctatttaaaatacgccctgctgctttccttcctaggttctccacaccttcaaagctcatcacttggataagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctctacaaaaataaaatgaaaaaattagctgcgtgtggtggcacatgccagtggtcccagctactcaggaggctgagatgggaagattacttgaacccgggaggtcgaggctgcagtgacccatgatcacaccactgcactttagcctgggcaacagagcaagaccttatctaggaacaataaaaaattcattattcattatttgatccaaaacaaaaacatgttatagactatctatagattcaattttcaaaaatcctatgcttctcatctctaaatattgttataatactgcaattttcaaattagctttcacctttaagaaatgctactttccatattggaatgaataattaatatagaaccaaaatgcatgtctgggatttagaaaatcttgggattctgtttccatccttgcttattttttattaagctaagtcattcattttaagaaatgatcccctttaccccaactatagaggtatatactaccttatatactaccatacttaaaaggttagtgaagaggcatagaaagagtagtgaaacagtgaaaccttctagatgccagatgctatacaaatgtgaagcatatgacaccagcatggtgaaaaaggaagctaattaagaccatcagatagtatttgattttatctctccatagaaatcatgataactatgttacatagttactgaaatttagacattaagtttgtggaatctctctgacagttatattagctaatcactaaacagaaattttaaaagaagtatttaatattaattctcaagtcttaggagaatatttagctaataattctacagttgactgcagagtttattcattatttaattcataatgtcttttcaatcactttactgtttcttgattcatgaagaatacatgccaagtgtattagtctgttctcacactgctgtaaagaactggccaagactgggcaatttacaaagaggtttaattgactcagttccacctggctggggaggcctcaggaaacttacaatcatgacagaagggaaagcaaacacattcttcttcatgatgtcaggaaggagaagtgcagagcgaagtgggggaaaagccccttataaaaccatcagacctcatgagactactcactatcctgagaacagcatgggggaatcactctcatgatctaatcaccttccaggaggtccctcccccaacacatggggattacaatttggattacaattcaagatgagattttgtgaggacactgagccagaccatatcactaagagaataaaaatggacacagaatgccactttcctattccctttaaatatttccagttgaaagtatttccatgacctagtgagttcttagagaattcaatcactattgatgtcccaactggtataataaaagaagaaaacacataattttgagacaaattccacctttctcacactctcagcatataaacacataatcgaagcaagaaaaatgagaaaaaatcaaatatataatatgatgaagaattttacactattcattatgacatgtggggccaaagtgacaaaagtaattggacaaaggtagactcagcaatgaggacttggaagaaatgagctttcagtcccattttaaagtagaagagaaggtagggtatcaaaagtagggtgcgctacgcaaagtggagggtgtttttgttgttgttgtttttagagacagggtctccctctgtcacccatctttgcccactgcagccttgaactactgggctcaagtgatcctcctgcctcagtctccctcagtgctgggattacaaatgtgagctacccaacacccaatgttttcttgattgtaaaagaaaattgatggtttctcatgttcaccagagggaaacatccattcattttatcaatgtgtttaaaataattcttactccttctttcactttaaagtgtttaactcatttttgcattctattcataaatatgaccagtcacaacttagaatatgtatactgtattatttcatattaacacacacattttgttcttctataatagatttgtgtatggtttcatatattagagtgttaaatattgaatttattgtaatttacttagtgaaatactgatgttaacatctagtatgtttatttgagggatataggaggcttacagtgaaatcatcctttcaccaagatttctttgtaagacactgttactggaattgtgctttgtgcattacatttcattgacgtaattttaaacttccattctacttcactacaaatggaatttcattatatctgactccacaataagtgggttccagaatcgttgacatttagtagaattacagatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcatttacaaatatttcttagggtattggctactgttggtttgaaatgagatacaacttatggattataaatatgtttgtgcaaattttctctagcagtaattctaaaacctttgtggacattaagctgtaattgtagctttctcttgcaagcttctttatcctctgctttattattcccttgtaggaaattaagtattttatataataatgcttagaacatctttctcttttaaagagggaaattaagataaagagcttggcaaatataggatctttcctggattgtatgtttctgagatttggtgacagagcgtctgctgtggaggatggggaaggacggatctgggctgaagaagtagacagagacagtggactttggttttaagaggcctgctgctgggatcttctcacccatccctagcagagctcagaagtaggcatccagctgcaggtaattgtgttttgggctcaaaggagcccttagagtgccagacctaaagaggcaactcccgataagagtttcaatagttttatccattctagaaccgccatttccttaagagtctgaggcccagggaccaacgcccaggacatatatacactttgataggaggaacatttcaaattcatccaggtcaagatcactcactaggtcttgtgcacctcctccgcctcttttctgtctggagttagtaaccacctcaaaagacagctttctgactcgtcattataccacctacagtcttacttttagcttggtttgagggtgtcctgttcattacttacagaaacagatttggagtgtgaatgcccttaacaccagttttaataagcatttttaattctacaataatgtgattcagagaatttttttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctcagcctcctgagtagctgggattacaggcgagcgccaccatgcctggctaatttattcttgtatttttagtagagatggggtttcactatgttggccaggctggtctcgaactcatgaccttgtgatctgcctgccttggcctcccaaagttctgggattacaggtgtgaaccacagtgcccagccttcctgctgagtttcttagcattattgccaggtcggaacttaggcatagtaacatgaaacatgttctgcatctgaaggccagaatataataagcattgttaatttagttaaaggaaaaggctgctgttgaaggttagacttcttgtgtatgtgtgggagataacagaataacgtctcttttccaagatgcatatggttttcttttgcttatgtgccaattttaatcaatggagaaattaatatgttaaatgaaataattaaccattttataattttagtcggatattggttgaccagtacttatatgatggtataaagttctagaaactggataactttaaaaatctttccatataatgcattatattctgggtcatagtttcctatattataactgctaaacaacataaaccaattttattttcaaaatcaatctttggggtaacttctacttagagccctgacctaataaatgatgtacgtgtttatttctgacacgtattttgataatcatttagattagtcttatttatgtggatatgtgtaataaaatttctttggaaaatatggtttattgagtttaaacctcttacctccatttcactttcctaaattttaactatttttttctgttccattgcaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtataatttcttttttgtttgtttttttcgtttttttattttttatttttatttttttcttttattattatactttaagttttagggtacatgtgcacattgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgatctcattgttcaattcccacctatgattgagaacatgcggtgtttggttttttattcttgtgatagtttgctgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtccattttggcttttgttgccattgcttttggtgttttagacatgaagtccttacccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagtttccccagcaccatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaatgcttgtgatttttgcacattgattttgtatcctgagactttgctgaagttgcttatcagcttaaggagattttggactgagacaatggggttttctagatatacaatcatgtcgtctgcaaagagggacaatttgacttcctcttttcctaattgaataccctttatttccttctcctgcctaattgccctggccagaacttccaacactatattgaataggagtggtgagagagggcatccctgtcttgtgccagttttcaaagggaatgcttccagtttttgccaattcagtatgatattcgctgtgggtttgtcatagatagctcttattattttgaaatatgtcccatcaatacctaatttattgagagtttttagcatgaagtgtggttgaattttgtcaacggccttttctgcatctattgagataatcatgtggtttttgtctttggccctgtttatatgctggattacatttactgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgtcacaatttcagatcctgttatttgtctattcagagattcaacttcttcctggtttagtcttgggagagtgtatgtgtcgaggaatttatccatttcttctagattttctagtttatttgcgtagaggtgtttatagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctgtctcttgtgggcatttagtgctataaatttccctctacacactgctttgaatgtgtcccagagattctggtatgttgtgtctttgttcttgtcggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctatcaggtccgcttggtgcagagctgagttcaattcctgggtatccttgttgactttctgtctcgttgatctgtctagtgttgacagtggggtattaaagtctcccattattaatgtgtgggagtctaagtctctttgtaggtcactcaggacttgctttatgaatctgggtgctcctgtgttgggtgcgtatatatttaggttagttagctcttcttgttgaattgatccctttaccattatgtaatggccttctttgtctcttttgatctttgttggtttaaaatctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagtctcgatggtctttacattttggcatgattttgcagtggcttgtactggttgttcctttccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatctgctgttagtctgatgggcttcccttccagggtaacccgtgctttctctctggctgcccttaacattttttccttcatttcaactttggtgaatctgacaattatgtgtcttggagttgcttttctcgagaagtatctttgtggccttctctgtatttcctgaatctgaacgttggcctgccttgctagattggggaagttctcctggataatatcctgcagagtgttttccaacttggtttcattctccccgtcactttcaggtacaccaatcagacgtggatttggtcttttcacatagtcccatatttcttggaggctttgctcatttctttttattcttttttctctaaacttcccttcttgcttcatttcattcatttcgtcttccattgctgataccctttcttccagttgatcgcatcggctcctgaggcttctgcattcttcacgtagttctcgagccttggttttcagctccatcagctcctttaagcatttctctgtattggttattctagttatacattcttctaaatttttttcaaagttttcaacttctttgcctttggtttgaatgtcctcccgtagctcagagtaatttgatcatctgaagccttcttctctcagctcgtcaaagtcgttctccgtctagcttcgttctgttgttggtgaggaactgcgttcctttggaggaggagaggcgctctgctttttagagtttccagtttttctgttctgttttttccccatctttgtggttttatctacttttggtctttgatgatggtgatgtacagatgggttcttggtgtggatgtcctttctgtttattagttttccttctaacagacaggaccctcaactgcaggtctgttggagtaccctgccatgtgaggtgtcagtgtgcccctgctggggggtgcctcccagttaggctgctcgggggtcaggggtcagggacccacttgaggaggcagtctgcccgttcttagatctccagctgcgtactgggagaaccactgctctcttcaaagctgtcagacagggacatttaagtctgcagaggttactgctgtctttttgtttgtctgtgccctgcccccagaggtggagcctacaaaggcaggcaggcctccttgagctgtggtgggctacacccagttcgagcttcccggctgctttgtttacctaatcaagcctgggcaatggcagacgcccctcccccagcctcgctgccgccttgcagtttgatctcagactgctgtgctagcaatcagtgagactccgtgggcgtagtaccttcccagccaggtgcaggatataatctcgtggttcgccgttttttaagcccgtcggaaaggcgcagtattcgggtgggagtgaccagattttccaggtgccgcccatcacccctttctttgactaggaaagggaactcccctgaccccttgcgcttcccgagtgaggcaatgcctcaccctgcttcggctcacgcacggtgcgcgcacccactgacctgcgcccactgtctggcattccttagtgagatgaacccggtacctcagatggaaaagcagaaatcacctgtcttctgcgtcgctcacgctgggagctgtagaccggagctgttcctattcggccatcttggctcctcccctaaaggtataatttctataaaataaagtttttttacacataagaaatgtatgtgacatttgacaaatatatatatacccatataaccgtcagcccaacaacaacaaaaaatagaacatttctcctttcccagaaggccctcactgtttttttgctgtcttcttccacagccctgaaactcttatctgattagtttcatctgtcttagaatttcctttatatgaaacaccaactaagtacttttttctgtctgccttctttcacccagtctactgtctgtaaaaatcattcatgtttttgcatccatcaatattttgctccttttaatcgctaacattttccgttgaatgaatgtacctccatttttattttattggcctgttgatgacattaagactgtttccagtttttaattatcatgaataaagttgctatatacaagtcatgtacaagcttttttatggacatatgttttcatttgtcatgtttatctgggagtaaaattcctgggttgcatggaaaaaatgttcgtttaattttataatagacaaattgttttctaaatgaaggcatgatcttagtctagtaatgtttatttacttctatcaacatatgtgtttggtaagttaattttttggataatgaatgataccgtaatggatatttttttctcactacttcttcctttctccctctttttacacaattaaaaaactaaagataaaagttggctctatagggaaaggttttattttttacatttctggcaaatttgagatttctataaaattcttcataggtatataaaacagagtaagtatattttgtttaacttttaaagcagggtattattcatttgttagttgtttaaaatctactataattatgggtaaggcagtgatacaaaaggaagaaaagaaaaatcccaatttattcattaaataagaatgtgtcaatgcattttgaatgagaagtcattttaaactccaaatacaaagatgagcaagacgattttttaacctcaggaatggcatagtagggaaaaaagtaagtgtatgtatatcattagattcatacagtcaggctgaatgtggaaagggctttaagaaagttattaaaattgtttttacattctggggaagtagaaacatttccatctaacaggaacagggcagtttcacagaggagttggaatttggactgagttttgaacagaagagaatttcgatgggcagatcaggaaaagagcagttcaggaggagggaatggtggactgtggagcatgggcgaccagaaaggcagattaagttaaaacagggttgacaaattgggagaacacaggattaagggactggaatttaagtttagatttgctttaataaagaaaaatgttactttgtgatgagagaaaataagctaaaaattaaaaatttaaaaaccaatccactctgagagattaattaaagtgaagatggggtctgctaatgtgttactgaagtgaactgcagagtacagtcactggcattgatgagtctagatgctgtgagaaagatcattagcgcattgacaattctaagtagctggagaccttttaaactttcaacttccatatttttagtaatttttcaaatgtgattaatttagcccatgaaaacacaccccatcattgatataaccaatcattataattatttattcgactggtgtactttgtctctaaatgacacatttctatgaaaaaaagatcagtttcactaactcctcaggcttctggctgtgacttttcataaatgtctgtatgaacgtaagctataactttgcttcattgttgtttagatgacattaataattggttttacttactgactatgggcattttaatacaagattccattttaaaagtgtgtacttgtagcttattgcaacacagtgaccaaagacaccatattcttacttctggaatcaatttgtgggcattgttaacagtatcttcacaactgcactagtcaagcaatcagagctaagctttcaaagcagattagaggaagcttattagcaataaaatatagtcaaaatataccaggcataatcatatttttatgtagtggaattacctcagcacatggagaatctaaattaaatgagtttataattgaggtttgtgtgcaagggaaaagaaaattcgtctgttatggaaacgctctatattttttacattatagccaaagtcttagttaccttttgagggtatctgtaggtgccattaaattcagctatcctcttctgctgtgggtataagcacatggcaaacccaggcaaaaattagaaaaataaaaaggattgtagagaaatggagatataaaaaattaataagagaagaggcaagctaactcccttatccatttttttcctcaaggttattaacagaaattatttccaacataaatgtccataaataattttgaaaatctagaaagaaattgcatttctactttaaaaatagctttctatggctgaaggtttgcttcagttgttttactgtcacaactcccaaaaaccagctggttctgggatgtcgtaacaatttgatacttcaaaccaatggtttgtgctcattggctccctggtgcaaacagggagataaatgctacttaaatagtaggtgaatgtaattttgcactttagaaaatgtctgcatgtttattagagaagtgaatgctgaaatcagcgaacaaaatgtaaagtgagcaactaagaaatacttataagagctcacttgtattatttaactgtgtaatcctctatctcatatatatgtaatactttcttcaagttcattatagctcccgggcccagtacatcctagtccagttccaaccatgtctaattttaaaatagctatgctcacttcaaacgaagatgttgctatagctttattttattttataggcttcaattttaaagttgtatcacctatagataacaaagacagctttcatggacacctcaatttagaagagtcttataggcactttgtgagataaactgtaagtgtatgtgctaatcagataattcttttactagagactttaggtgaagatagcaaatcttctaaaacagactgataattaaactgggttgatcattattgggttcattattatcaaattgaaatatgctttattttgtaatgtttaaaatgtgttcttaaattcagtagaatattaatattatattatacttttccatttttaaatcatattaaaaatagcaaaaatattacttcttcaaaaatgctttatacttcatgtatattactgattttaagtaaaagtacaattaagacaattagccagacctatttatgagtagctctaattggagcagcttgttgctggaccctattcagtggtagagataaggttgagatggctgaatagttcatctaatttgaaatactttggtgtcacatggaccttttcctgaataccatggctatgtactcactatttggccaaatgctgaaaatgaacatatatttgcctccgtcaaaatgttttgtaaatgttcactcagacattgacataaacaaggcagaaaggttaatggataaaaaattctttttctttaaaaaaatacatacacatacgaattttctctcttttagttgctaacctgctttttagattagtccatggttatcttggaagaggtgtgggagaacaaggtgagagctaaggaaggaattctatgcaaagcgtttctgattctcttagtattttgtggaacagcatgagacatgtcttccagttgtgtaggataagtacagcccactgaacactgcttaccagcagtttaccacaagccagttataacatcaaaaacatcggaaccctttcttttcttctatatttgaataatgataaatgccttcatgctgtgtgagcactattgaagtgtgtttctctgcaggtaaacttggcagtgtcttatataactacactcgatgggagtattacttaaacagtgtgaaatacattgtctgataaaaattgtatcacaatttggaatgacgtttatgcaagtggatagtctgccagttattttatagtctaaaaaaatgaacctgtaaggctacagtataaaatccaagtctttatagttgtatatttgtagtgaaaacaaccgtgggggaataatataagcttaatcatttggtgattagtctaccaactattaatgatgagagataacctatctgttctttatttctaaaataagatgtgtaatacagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaacaaaaaaaacaaaaacaaaaacaaaaaaactatttggcaaattgggatatgagaattgaggccaaaacttttagtccttgccaattttttttaaaacttcaattatcttgattcatattcccatttgttgggttggtaggcactccaaaataaatataataatcagagagaacaccaactgtaggtactagttttagcaactgaaacaactggcgttaaaatcactgagcttctgttacatgaatacctgagtattatgtggctacttctgaaatggagtatgcagtgctcttataattgggcatttcagttgaacactgcttcagtaaagtaactggcatttcaagtcttccttctgtagtgattgctttgtctttattcaatgattgcttttttaagttagaatctggttgcatagtgctccatggttctttcctatgcagtggtgtttctcagtgttgatgtggagaagccaggagacatcctacaactctgagaagcatttgatgttggcagcagtggctgtgaggttagcccatgaacttagggctagaggtgagtcttaaccttccaattcagcatcttttccatctgaacattcaagtcaaatgggaaacctgttggccctccagctggatctttccactgttttaactggaatgaattggataagttataaggcagatggtaagattggatctgatgggatggagtttggtgaagtggaaacttttaagcattaggtttgagatagctagggagtgttgacctctctttccccctgacattatcctcacatttgtttttattccaccatatctaccttgatccacctgattcttttcatttttttctttcattctctttgtgctggctttctttccttttttaaaatcccatggtatctcatcatctcttcttgtcctcccattctacaaatagaacatgaaattgaagccttttttaaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgacctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttcttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattataggcatgagccactgcacctggcttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacattactttaaatttcctaaatttataattcaatttagtaaagtaggacttctgaaatggatttttagatatattggggaaaaacaattcaggatctaaggtaaactttttaggatgtatatatatttgcatgccattcatggttgtgtttatctgaaaacctaatacatttttatcataaaaatctacataattctaaatcatctcaagtgaaattagaattaatataaagaaataaacaaatattggaagttaaaattttcagatttattaggtgttaaactgaatttttcgtcttctactcctatcctcccgtaaacactatctagaaaattgtcacccaacctattgtagaactaaaaacctagtggtcttcctcatcttcattgtcttcattatttccactacacgaaacattcccttgtaacaaatataatattcacagcattgtgcaaaaaatgtacattttaaatttctagtataaaatttgatttgtgactctgagcccccagtttccttagggcaaacaatatgggtgctttcagttaattttagtccaatccagtaatttttcagttacttttccatttaaaacaagtagttcgaggttcagccttctgatcattttcctgatatggaatctgggagcagcagggaacataagtaatgtcacggtgtcaggattgggaggtgtgcattttggatcctgattaaatgtatcaacgtaggtaatatattgtgattgtttcaaatagtggagatcaggaatccttcctggtacaaattcagttccccacagtaacctcaaaattgacttcaaacctactgacttcaaatctgactcatgatgtttctcctctcccatcacttttcactgtgttctgctgatctccatactgtttcctcaatgatgggcccaaaaaatgctggaagttttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctcactagtcatcaacatcattatcatcattgtcatcatcatgtaacaattatataatggttaatattggccacaaatcaatcctagttccttaaaatctattagttgagccttatgaaactgccctttttgtcggttcaaatggtgagtagaagcaatttcatatggttcaacttattattacttcaatttccttacaggcttacagccaacacagtgattcaggccaccatcatctcacaactagaaatcatcactgtggccttctaatggatattcttgcttgcaatttagccctcccccatttgtttgttgtacttcagctaggttaagctttataaaacacaatagtattgagctattcctctctctaaaatgctgtcatggcatctgattgaccttagtataaaatccaagctctgttaatgtgatttataagtcatgtagccgtacatcccagttagtctctgacagccctggtttacaactgctgccccagcctaattaatagtggtgttccctttattctcagaagtggactggtttagatgatgaattacatgaccaccttatttataatgtacctcatgctctgccctgtgcagttctctccagcctcatctctcaccactttttaaatcataaaaatgagctgtatccattctgaattcctttggatttatggaatatatcactgtctctttcagttcaaagcctgtgcccataatgttgtcactgcctaaaatatctctctgttaacctgactaatgcataccaattttcatgctcatttttcttttcttttttttttttttgacggagtcctgctctgtcacccaggctggagtgcagtgctgcgatctcagctcactgcaacctccacctcccgggttcaagcgattctccttcctcagcctctagagtagctgggactacaggcgtgtgccaccacgcccagctaatttttgtatttttagtagagacaggatttcaccatgttggccatgttggtctcgatctctcgacctcgcaattcgcccgcctcaggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatatatatattatatatacatgtgtgtatatatatgcatatatatgcacacatgtatatgagagtatgtgtgtgcacatgttgaacaaattcatgagacaaaatacaactttaggttgcttttggactttgacatctgctcttgactttttatgttgagaaagggatgttgagagtatgaagcactatagcaagggagaagaaaagaaagagagaccagaaaagggctgattattgaatatcaagaaaggaacacatagaaaacaagtaagaggctttgaactgacaatttggatggacaactacattccatttctgatcatcgatcctgtctttgcactattgcttgcacttatcttagcaggggcacttaaaaagcctgaaacgcgtatcttgcctgcaatgtacaaacttatcagaacatctcatatagtaacataattttcagtataagtatagataggaattacgtttaaatttgagtaagtattggactaagattatctctccttttttaaaagttggtaagttatgttaaacaaaaacaaaacaatttctaaaatgatgactaaaagtaagggttgtttaaatccattttataagatttacttccagaagatgaaagtgggaagctgaagtggcatatcatttctaagctatttttgtaggttgaattgcatccttcaaaaagaaatgttgaagtcttaaccccaggtaactatgaatgtgaccttatttgcaaatagggtctttgcaaatataattaagttaaggtgatgtcatactggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccaatttcatccatggccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcccttgggtatatactcagtaatgggatggctgggtcaaatggtacttctagttctagatccctgaggaatcgccacactgacttccacaatggttgaactagtttacagtcccaccaacagtgtaaaagtgttcctatttctccacatcctctccagcccctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttgttgatggggttgtttgtttttttcttgtaaatttgtttgagttcattgtagattctggatattagccctttgtcagatgagcaggttgcgaaaattttctcccattttgtcggttgcctgttcactctgctggtagtttcttttgctgtgcagaagctctttagtttaattagatcccatttgtccattttggcttttgttgccattgcttttggtgttttagacatgaagtctttgcccatgcctatgtcctgaatggtaatgcctaggttttcttctagtgtttttatggttttaggtctaacgtttaattctttaatccatcttgaattgatttttgtataaggtgtaaggaagggatccagtttcagctttctacatatggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaactctgtgaagaaagtcattggtagcttgatgggaatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttagaatgtctgttgttttaagtcacctagtttgtggtcatttattatggcagtcctagaaaactaagatacctaaattaggaaacaaatataactatattaaaaggggatagtatatccaatatatttaatacagaaaggatgaagatatagatagtagaatgatcagaggaataataatttttttcccactgttctcaatatcactgctaattcctataagaacacaattactcaatcactaatctgctgtagtagtctgattgatgctaagccatgctgcaggaatgaataaacccccaaatcttaaaatcttagcattatagaggtttatttctcaatgatgcaatgacaaatacaggtccatctggtgactcagggtcccagttgtcctccgcttatgatgtttccaactcaggaaatgccttttatggttgctatggcagaggaagagaggagtggggagctggcacctaggtcttcagtgcttcagctaggaagtcatagtcatgactctgctccacatttttacaatctaagaatagtcagatgcccctcttaactgcaaggggctgagaagtgtagggaacacaagaatattttttgagagctactatctctgcttacatataatggcagaagaaatatcctcctaaatctattaaaatcatactatgctctcaaagattctagctgctcccttaatttgatattttatccctgctataatttttacaagcttcttttcatatatatatacacacacacacatatgtatttatgtgtgatgtatgtatacatagctattacccaagtctttccattaacatggtgttatatttgtccttaccagaactactgactgctaacaacataaaactcttttccatccaaaatcattcctatttaaacatttattagtgttcaattctaataccattcaactgctcataaaggagaaagaggaagagaaggaagaggaggagaaattttccaggtaagtttatagagtaaaggaaacaacctgccattttgattgttttgagtatcaattaaattatcagttaataattcaagaaaatatatcccaggaaaaaaaaatcccctgtataataaactaaagcttttttaacatccttcttaatccctcatatgaaaaatttatactcccctcttagatattaataaaagctcaatgtacaggtagctagggtgccccccgtcttccctgctggatttgtaggtcctgctcatgcagaggggttatttcccagcatgtggatgctctatttgactccactgtaggccaaccaccccttctcatcaatcatgttgcaattattttttacacaattacgtcttcttttagagaagagaattatttaaccagaaataacatcaacaagccttttacagaatatacatgcttaagtttcacaccatattgttgagatattttaagtgtttaaaaaatagtatgtgaatatatttcggttgtaaaaaattcaaaggaagctttatacccattaggatggctgccataattttaaaaatggaaggtagaaattggtgaggatgtgaaggaattagaagccttatgcattgttgatgggaatataaaatggtgtgacaatcatggaaaacagtatggagggtcctcaaaacattacaaatagaattacaataggatccaacaattccacttctgggaatatgccccaaataattaaaagcagggtcctgaaaagatatttatacatctctgtcatagtagcattatttacaatggccaaaaggtgggagaaacctggctgttgacagacgaatagataaataaaatgttgtgcatgtatacgatggaacattattccgtctgtaaaagagaggaaattctgacacatgctaccatatgaatggaccttgaggacattctgctaagtgaaatataccagtcacaaaaagacaaatgctgttatgattctacttacctagagtagtcagaatcatagagacagaaagtataatggtgattactagcggctgcagggagagaggaatagggagttattatttaatgagtaccgagtttcagttttgcaagatgaaaagcattctggatgtgaatggtgttgatggttgcacaacaatgtgaaggtactaatactactgaactgtatacttaaaaatggttacaatgatgaattttatgttatgtgtattttacaatactttaaaataattcaaaagtaacatcctcactcccagtgctctatacagagaaaaccaatgtctttattctttagttctgcgtttacatagacacaaattctcacatagcaatatatggtttattctttgattcatttttttttcacataaatgctatcttaatgcatatcttgttctgcatgttcaacaatgtctcagtcttgccatgagaaacggagcagggaaacttcctgggcctaaactgaataggccattttattctcttctctgccacattctttgtggttctgtctccactggactgggactctccattggtcctttaccaatgagccattctattctcatgaaatattcatgagaatgtttcaccagatctaggatttctacatattacttctaacatttccatatttctttgcctaaaattttccattctatttgaaagttgtgtgccttttttctttttctttttatcacctacatggggaggtagagtgttggctttcaaaggtgaaattgcatctttccacaactctgagttttctgagttttgagtctgttcttgacttcttttaaaaaaaaactctttggtcatggtggcaatagaggttagagtatgaataccaactcctctcgtttaggcctctgttctttagatatggtcattttaccgcttcaaggatcagaacatatcatatcccaaatttataatccccagaggtaactcagatatgtataattctttaataacaatctgatttgttctcaatatttaaagtgaacccaagatgaagagttggaaaggaaatttttaaaactctaatgctttagtaggctctcaaactgctgacagctcaagtgttctgtctctttggcaacatataaaaatccagaataacagttaaatattccacagctaactattatttaatactaatattatgtcttggttaatggaagacaccatagaccacattttgaatatttgtgcttctttttaatattggtaatcctccttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaaggtatagttttgggtataaaccattgagcaagcacaaaacagtgaagctgagagctgcagaacatagagatctggtggattctaaaggactgagaatgatcgatggctactgaaatgaagtgtgaaatggtatccatagctgatatttgtctttaactgataaaatggctaaagcatttcctggtcaacacaccactctccctcctctcttctcattcctctagaacagtggccttcaaactcttttcttgataacaaatgcacttaaattggagaatatctctctttctaacacacacataacaaaaatgtcatgagatgtcttaaatacttagacattttacattcagtgtactccaatatttctattttatattcttttttaaatactggttttgacctattaaatggacttcaagaaatttttcagtctcatctaggcacacagatttaaatattacttctatgttagtgacctcttctgtgagtaagctccgtctctaactttctatctcctttggatatccttattcgcatattccttccagaacgtacaacttaacgtggcttaaacttaacagctaaacattctccctctgaagtatcccattctttccacagtcctcacccacctccatcaagttattttcctcctgtttccaaatttctgctgagggtcccatcagtcttccaggtgtaaaccattagattcctactagatccctatctttcttcccgttactatatcagtgagcaaggtcttgattctatttcgttttttgtcacaattaattattattaatagaaaataaacacttattccagtttcaaagttgttataattgaagttgctaattttaaaaaatgaattttaaataatcacttaataatccttctttgactaagacaatgaaatgtggctttaaaaaaagtaatcagcaccatttgcttataggtctttcagaatttgttcttaaagtttctggaactttcctctctgtaaagtacaggaaatactgagctacactggaaagcctctctgggacaggcaatggggagttaagcagtcatcataaaggaatcaatgtacattcagcatagtgacttggactacacaacaattccttctcctctacggtagctcaagagagacatgcttctaagcacagaggtatgagaagtctcagactgttatttgctgttagaattggtctccccatctaataacagtaaatctctggcacagatgctattggtccttaatgtcctgtgattttaggaaatagtttggatttagtttaatttattcagaaatcaaacatgtttaattaggttcactgctctggcagagtaagggtatgctggtttagtatctttataatatatatataatgagtaggtaaatcatagtcttaaatcatacttagaatactatattatttaaaccaatatctatttcaacaaaatgtttataaataaaaacagctgatgaaactaaatccaaaggtatgacaaagacgactcagctctatgttgcttaaagaactttaaaaagcatgtgcccataaagccgttcaaggagagggaaggaggtccccttctccttattcttacgatagaattcctattggggctgtgccagaaatgagcacttctaagtatttcagagaagtccaaagtgttaaaaagtcttttatgcaaaagaacgtctttctgaatcagtgaatagtaatgctcatcagaattttctaataacacaaaaacaaagccaagtccatacatttgatcagttgtcaaagtaatgggaggtggactattatgtcaaccttagtcagagctcctgctggcttctttgtatacactgttcaccaatttgagtaaagtggactttgtgagagaatagtgtttgatggccaggacctcttttgggcatttcttcctaagtggaatacacaacagataagggagtagaggaggtaatacagggaagctactcattccagctcagaaggagcagaaggagttagatgaagcccatatatgcattcaagaagccaatggtatcctctagctgtggatagtggctaatgtggtcatccagaatccacactgtggaccgcagcagcgttttcccgtacagatccaaaaactctggatagggatttacaggatccaatggccggtagataaaatgaatggggatagttacagaggcaagagctcccacccagcgccttctgagcttcttcctctgattgatgtactgtaagagaccgtcaatggctaagttcccgtcattgatgcggatccctgcccacatgtcccacagctcactctcacagagccaagtacacggcccaaagactggggtgagacctcgagagaatacaaagaagttcatcagtcatgtgaggatgagtgatagcacacctccatctttgagtagcttttggagaaggagtggacggtgagtctcaggaaagatacctccatttgacagacagactctttatggtatgccgaccagatcgattctgcttgtacctgtagagaaactcctgagcgacaattatctccatagtcatgagacttgatcctgcagttctggagccccagatgccgcaaaagcgcttccacgatgctgacctgctcaaatatggaatagtgatgcggtctcggtttgtcactgaagccaacgccaagaaatcaagggcaatcacccgatgaaacctcaaggtcagaccttcccaattcttgtaccaatcgtagctggatattggaaaacgtgtaaaaccacaactgtctcctgacttccaaccacacccacagagtcttggtagaagatacgcagtcccttgtaagtgaaaaacttgcctgaagacttccacgagtgaagatcaggtgacagctgagtgtatgggatgtgcaggtacgcagcaagcaggagcgcggcccacagccccacctggacccaccactccctcatcctgcggaggcgatctttgcgcacggcggcgttatcccacgctgccagcctcggcgttgcagagcacggggcgccgtggcgcccgcagccctgcagggccggccggcagcggggtctcaatcagcagcccacagcccgcacagggcggcgccgcgcccggcagctacagccactctgacgtgcacggcggcactgcgtttgctaggcgcgactgccacaagggaagtgcccgggtgtgctggttgccgtggcctctatttctaaagtatttcttatattttcctatttcttttcattcctactgcttacaccctcattgactgaactattgcaaccgcctcttgaggtgactgaaatattcatagatattgcagttattctccttttgggcatatagtaggattacatttgctcacccctgaaattaggcatagacaccgtcaatgaaatgtgaacagaactgacatgctttactcttagattgaatacgagttttacaagccagtgcataattcgccatgctatagagacagatgatcttccagatggatgcctgagtgtagaatatatagatcagttccccccacccttcacacatgggcccaaaatgtacacggagcaggagcaagaaatacacgtccttgctatctttgttagtttaatccacagagactttggagtctgcagttatacagcatcctagcctgtcctgactgatatgatcccttaactgatttttctactcaaagtctcttctccctccgattattctacatcactatcatattaatctttctgaaatagaactctaattatataaattccttatgaaaatctttgaatatttccctgttatcttcactggctttcaagaccatcacagtgtgcatctcaacttccttttaaaacacccacggtttccctacgtgtacacacacactttctaacacgttcgcttttctgttcctatgattctaagatgctctctgctagtcctgtctaagtgctacctattcttaagtaacagttcaaatgccagtatctctatgaggctttttctggatctctgcaaaaaaaaagggacaagaaacaccttcctcccaaaggaacaaagaatggcaattacttataagtaagccagattttagcaattggaccatttttgtcttaaatataactaacctgtctctatagcttacaaggtattcataaattcttcaaacaaaagaaatttatcataaaggatacaggtaaaagttctgtgaaattgtttaaaaaataactaaataaatgaattcccaaatgattttgagtctttattgtagttcttatcactctttgcagtggccatttctagcacttttcaggcaataaatggtcttctttcacttccatattattgaaaattcttttgcataatgcctagcaaatatcttaatgttgaatatctgaatgaatgaatgaatgaatgaacgaatgaaattaaggttgcattttattttaaaactaccgtttttttcttcagaaatcacaacgaggcaaatgttgccaataaaatagttattaagttaaaaaacataaatatctgagaaatgaactgagaaaaggagaaatccttacaggacatgaatggtacaggagaatagtacatatcaaagggtgaactctgggtcacagcttgtgggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagaattgttacttttaaactcttactttccacggggactgttattgtaaaatctgttcttattcttttaatttaactccattattttgttttaaatgtaatgattgttcattatatttttctccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaacagtcaagagaacaagactgagtcattcttcatcacacattgcaagggctatgtctcctctgttgtgaggagaatattgccctgcagcaatattctcacaagtggagctctgggtcattgactgcacttttgctaataagaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaagtttcactgtacaccctaaaaaaaaggagaaattgatatggaacatgaatagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgacgatttaatatacatatacattgtgaaatgattaccacaaccaaattaattaatatgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtgtttgtttttctatgtgtggcttatctcacctagcacaatgcccttcaggcttatacatgtcattgcaaatagcaggatttccttctcttttatggctgaataatattcctctatctccctctctccctctctttctgtgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttggaagaatctctatgcttaatgctgttttccatagtggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaatatacctgttggccatttgtatgtctctttttggaaacatgtctattttttagatatgtttaggtcctttgtccattttgaaattggcttattttgtgttttcttgctattgagttgtatgaattccttatatattttgaatattaactcctgatcatatatatggtttgccaatatattatcccataccacaacttgcctttttattttgttgattgtatcctctgctgtagaagtttttagtttgctgcagttacacttctttgtttttgctttcattgcctgtgcttcgggtgtcgtaccccaaaaatcatgaccaagactgatggcaaggagccttttctttatatttattttagaagctttatggtttcaggtcatacatttcagtcttgaatccattttcagttgatttttgtatatggaataagataaacatccaaaatcattcttttgcatgtggatatctagtttccccaatacagtttattgaaaagactatttgttccccattgtgtagttttaatggcctagtcaaagattagttggccatatatttgtgggtttatttctgggctattccgtttcattggtctatatgtctgtttttatagcactatcacactgttttgattaccatggctttgtatatagtttgaaatcaggacccatggtgcttctggctttgtccttctttcttaagattgctttggatattttgggtcatttgtgatttcatatgaattttaattattaaaattctcattcttttttttagaactgttttttctacattttctttctttttttctttcttttttttctgaggtggaatttccctcttttcgctcaaggtggagtgcaatggtgcaatctcagctcactgcaacctccgtctcctgggttcaagtgattctcctgcctcagcctcctgagtagctgagattacaggtgcacaccaccatgcccagccaattttattttttgtatttcttagtagagatggggttttgctatgttggacaggctggtctcaaactcctgacctcaggtaatctgcccacctcagcctcccaaagtgctgggattacaggcataagccactacacccggccattttttctacattttctaaaaaattgccattgaaatgttgagtgactgcattgactctgtagatcattttgggtaatgtggacattttaacaatattagttcttccaattcatgaacacagaaagtctttccatttatttgtgttgtcttccatttctttcttcaatgtcttatagttttcagtgtacagatctttcacctccttggttaaatttattcgtatatatttcattatttttgacgctattgctttggtttcttattattattatactttgagttctagggtacttgtgcacaatgtgcaggtttgttacataggtatacatgtgccatgttggtttgccgcacccgtcaactcatcatttacattaggtatttatcctaatgctatccctcccccagccccacaccccccccaacagaccccaatgtgtaatgttcccctccctgtgtccatgtgttctcattgttcaactcccacttatgagtgagaacacacactgtttggttttctgtccttgtgatattttgctgagaatgttggtttccagcttcatccatgtccctgcaaaggacataaactcatcttttttatgactctgtagtattccatggtgtatatgtgccacattttctttatccagtctattattgatggacatttgggttggttccaagtctttgctattgtgaatagtgctgcagtaaacatacatgtacatgtgtctttatagtagcatgatttataatcctttgggtacttaattcttttttggataatttgttgttaatatagatgcacgactgattttcatatgttgatttcatatcctgcaactttattgaatttctttattagcttctaatagcactttagatggagtttagggtttccttcatataagatcatgtcatctgcaaacagagacaatttaccttcttcctttccaatttagatgaatgttatatctttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgaagaaggtaccttgcttccccttggccttctgccacggttgtaagcttcctgaggtctccccagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttaatttatgttaggcacagcaagagattaacaacaatagagcaattataacaatatactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgatacagtttggataccctagaaaaaggaatggttcatctcctgggtgggaggaaacaggacagtgtaagatttaatcctgctactcaaaatgcacaattcaaaacttatgaattgtttttctgaaattttccacttaatattttcagaccatgattgagtacaggtaactgaaaccatggaaagtgaaacaaagcataagtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtgtctatgatccttttttatttctgttgcaatgtctcctctttaatttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatataggcatttatcaatgtaaacttctctcttagaacgtcttttgctgcatcccagaagttttggtgtgttgtattgttattttcatttgtctcaagatacttttgatttctctttggatttcttctttgacccattggtcattttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgtataactaatgttttatgaggtccttagagtgctagacactgtttgcatgaattattttatatgatctcaccacaaccttataaaaaagtttttattgtccgatgttttagacggcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctcagaggatgtccttcggagaagtattctttctcttacttatgttttgttaatttttgcttggttttgattgtagacatcagtttgtaatcagaaatgaagggaaggtcctgggagtaccaacatttaagagtgaccaaaagaatggaagccagcaaaagggatagaattctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctccaacttttcatttctcttcaattccaactcagtttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaatttataacatatataccttcacttgacttggagtttcataaggaatgcaacagcttccaattcatttactttctttttgcttaacaaagtatctgacacgtagtacaaaagttaaatattataaataaaagattaattgcacagatatttttaaaggagacagaaaagatttgaatatccaggaattccacccaacgatgaaagacctataggcggttacaagtaggtaagcagagtccaaaatgtagggtcattttcaatggcagagaggaataggagagtcaataagaagcaaatgctcaaggagcttgagtagagactggaataggcatctctttattatcttattggctgatttatacttcttgtaaaataattagcttaagctaattatctaagaaacaagaatctctcctaggcagattcagttgcctttcctggttctccctgagtgctctgagtaagccccaccattgccttctagaaaaactttctttcttctttcttgcccactcccatctgatcccttcacggcatccagaatgatgatccaaaagtttgggtccaaatgtgatgcaaaagtttacagtggtctaccatggttcctttacaaaaaaagaccaaaaatgttctgccattcttgctcatcatgattttgcctcagtttttcaagttatgttttgttcataatggattttttttgtttgttttctgaatgtgttctgttccttctactgccttaaaaagccctcatcactgagtcttcctactacttccctcacctccacttaccctactgaattttcaaactgcaagtcaaatattacttccttaggggaatctcatcagactgtctccctagaccaccacaccccacccaacaactagatcacatccctttattaggggtactatgttttcagtataattgcaattataattattgacccattgaatgagttgattcatgtcccttccttctttattataagctttaagagggcaaaaactatttctgtttttcttaccatctttccctctttagtgcttccacattgtctggtacattgcagacatctaataaatatttgtcggaaggaataaatattagtgagagaataaatgggtaatgcattcatgagtgaataaagattatatcatatttttgtggtaaatattttgtttaccttcaatgactgaaacaaagagttccatatcctgaaatatgacctgaaagccatggaatgaaaggtttgataaagctggacgtggtagctcacacctgtgatcccagcatttctagagacccagggtgagagaatcgcttgagctcagaagttcaaggccagcctgggtagcacaataccttgtctctacaaaaaaagaaacaaaattagttgagcatggtagtacacacctgtagtcccacctactccaaaggctgaagtgggaggattgcatgagcccaggagttccaggctgcagcgtgctgagatcatgccactgtgctccaggctgggtgacagagcaagagcctgtcccccccaaaatttttttaaataagaaagttttaataagcagaatattagtttaattatgaatgagaagagatgtatagcatttgtaggggtacagaaccatgtattccataaaggaagaagttaagagcaatgatgtggaataagcatggggcttttaagaacttgtctgaaaagaggatattctttggtcaatagttgaaaaaataaaataaggcttgctggagtggagcaagtcaatggaaagccttcacagttaggtggagcatttacactaaatgactttatttcgaacattcaacaaacactgactgattgtctattggttacccgccatataatgttaggtgctggggaaatagaagtaagtagaatgaggtgggggaggttcactgtggctcttggaaaggaaaatacataatcaaagtttgtgttagaagggtcaatctgaaggcttttgaaaaatggatctgggatagggaggatgtttgttgaatgaatgaatcaatcaatccaattaattcaataaactaatcatgattttagtgagtattctatgaaccctcacttagtttgattaccttgactgtgacatttaactttgtatttcactacttctttgcttctcttacattcagttaaaaatatttttaaaatacaattttcaaggttcagaaacaaaaaaaataaatgacattctggaaaaaatagatgtgctcagaactaaaaaataaaaataatggagatggtaaatatataagtgagaaatatgatgatgattttcattaacaagatacaccattaaatatattctcacgtgatccaaagtaatttcgttctctgtgcccagcgagttggtatctactgatggtggtttttcaaatgcaccgtgcagttagacgtcatcactgagacctcaataatagacctccatcactgagaagttcagaggtagaagatgcagggggacaatgttggcctgcattaatcttagcttgaaaagaggatctttagataacactatctaaatttagctgtgttcaaaatgctccaccacagaagagcagcaaaaagcaatctcattaaaacaagctcagaaaacaattccaagatatatgagtaaaagcaaactaaacaacggaagcacaaatagtatgaccttctcttgacttctacttgcacagctctacttattcaagctctgtttcggacattaagcttttttcatagccataactttcgtgttttttccatcatcctgtctattatatttccccttttatcttttattgagttcttttaggagaaacttgaaaaaaaaatctctataaatggaggttttttactcaagagcttttaaaataacagtacatcaccagatcatttttaaaaagtgttctattgtagttaagtgaatatttattgaaatttttctcgtcttcccattgaagactacagaaatctctttcttccagttgagctcaaaaggaaaagcaaaaaaagatggacagaagccagaaatgctgaataaattagtatcctttttatttactttttaaaaactatgaattggctcatttaaatagattctaaaagtatttgtatgtgggtctgaacactgttgtcatggagattaaaacatttttgttgttgttgtgtacagtggagatggcagttttcttctagttgatgcttctgtagaataaaaaaaaaagtttagctgagaaaggtaggtcttaatggaattgttaatatgtagtcttattttggatgacattttaaaatcacttacgtatttaatctgtggattgtagagcatgctgggaagttatcaattccattggtacctgcctcagttgcagttcagccttaagtacttaccaaagggagctcatttggggtggcaggggtaaccgaaaagtgtgggagctgaggtattgtttgagagcctgtgggcagtgtgactgctccaatcgtagtttcagtgaggaagagcaccatctgtgcaagattttctcagatgtcctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacacagagagagagagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggcgtaagccaccttgcctgaccatcgtccatatatttttgaaaatgacctaggaacaatgagactttttgaagttttttccgtttgctaacttatcagagaaaactagtggaaataatatcaaaaagaaatcatcaaatgctacccatggataatgtacaagaaaactcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatacaattaattgtgatatactgtctactggagatttgttctccaaaacctgacaatctaatactttgtaggaactaatgtgtataatcttagggggcttagtggacagaaagttcattagccgttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacctcaggtgccagacttcagaggcatatagaaaaacaattactttttgcattagtccattcttgcattgctaaaatcctaaagactggataatttctaaagaaaagatgattaaggcgggatgcagtggctcacgcctgtaatcccaggattttgggaggccgaggtgagcagaccacgatgtcaggagttcaagaccagcctggccaacatggtgaaacctcgtctctgctaaaagtagaaaaaaaaaaaaaagaagaaagaaagaaaagacgattaagtggttctagattctacaggctgtacaggaagcacaacagcatctgcctctggggaggcctcaggaagcttccaatcatggcagaaggttaaggaggagcaggcatgccacactgcataaacaggagcaagagagagtgggaaggtgctacatactttaaaatgacctcatgagaactcactgtcatgaggacagttccaagggggatggtgctaaaccacttatgagaaatcagcccctattctccaatcatctcccaccaggcccctcccctaacattggagattacatttcaatacgagatttgggtaggatcacacatcctatatcacttttggagaaagaatggaggtagctctgaaggtttgttacatcacagcatttgaggaatggctggggtgatggcaaatatcatacagaagagcaggcgtagacaagatataccagttgttttcaaatatctgagaaaatatcagtaagaagaagtatagtcatgagtgtgcctcacttgcctaaacattttgattaaaaatgcattttagtagatttaattatgcctttttcctctggtgaccatctgttaaaaatttttaaaaccttgacctatgaaaaaatttgtcagtaagatgcatttgttgtaccaaacttctcagttctggactttttaatcagtgtagttgccatcggactcacccaccagcttgcctgctaatccatctgatctgtgtcactcaaatacagcaggcagtgaagaacagctgctttttcttatttcattctccttctatctgtcataaaatccaggtaccaataactagggataagtgttttaccaagagcagttatttcaatagcttgaacttaaataccagattaattttcacagaataaaaataatgtttagtataagttttaataatggcatgtagatgaaatatttggacttggtgacttttaagttgtggttgctttttaaatgacttctctgtttgaggactttgtgtatacacatttcctatcacatttgtggtaggaagattctaagatgaccctcaagattcacaacctctggggtacacatcctatatgatcccctcctgttgagtgtgattggagcctgtgaatatgatgggacatcattcccatgattaggtaacattttacaacaaagtagaagatataattcggatataactcaggtggctaaattagttttcttcaagctactcaaaaggaagattattctgagggcacccaacttaatcaagtgaactcctaaaagagtgtctagttctcagagagcttttcctgctcttgaagaagcaaataatcatgtgagaaggccacacagcaagaggcttaggaggcctctagaagctgagagcagcactggattgataatcagcaagaaagcacagctgagctaacatggagactgcagcctctctaggtcgacaggaactgattatcaatgaatgttgttttaagtcactacgtttgtgataatttattatacagtaataaaaaccaaatacaaaagattaaaaagaaatctaagttgaagatatcttaaaccgaattgcatttaatacacctaacctactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctgcccagcatcacagagagaaatgtgcttcatatcactagcctggaaaaatatcaaaattcaaaatttgaagtatgatttatattgactatgtattgctttggcactatcacaaaatcgaaaaataccaagttcaaccgtcataaattgatgactatctgtaccaccaaatagcccattactcaaatcctcaactttttctcttcaatgtatgtgacctctatttatatagtcaatacttcttgatttgaaaaaggattggatgataatagaagtgaaaagtttgaatgattatactcatttttctttttctttatctataaaccagcgcccagttggaacatttccatattttagttctaaggttgtaaattgctgaaagtttaggttttcttattgatgattctctgctaacatttgataagtaggtcccattgaatatcacaattaatctatttaagaaggttgagagatatactgttaaaccaaagggaaaatggtaaatgaaattacaatttatatttttcccctaattcatgggcattgaatattaacttagtggtctgcacttgtagcttgttaattgtttgacatctagctgaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgaagtattttaactaccaggtttgcacgttgacttctttatgcttcatttggattttctgaggctttaacgttttccgtttttaagactaagctcaagggtcaactctttcatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattacttttataacctgagagataaacattattgaaaaagaagatcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagggagacgataaatagctcagcaaggtttttagggaagcagaaatgactcagatttgaaatataggtgacagaattagccctaaggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctataaacctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaacattagtgtgaaattaggacatttgggaaatgtgattgatatgatttgcatgtttgcccccttcaaatcgcatgttgaaatggtattcccagtattggacgtggggactggtgggaggtgattggatcatggggacagatccctcatgaatggtgtagcaccattcccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaaacagtgcaaaaaatggcttaacactgtgatatttggtattttctagtccattagtgcacatccccccgatgtaggataaatatggtatgaatatttgaatatttttatgagtaataattaagcttattgaattatcacaactccagtgagataagtctaattttaatatcattagaaaggtgaagaagacaagaccagcgagggctactaatttctcaaggacacgctcatcctcatgtgagagctggaactcaaaaccagaccttgactttgtcaaaatgcacttttggttcccaatctgatattaggtgcagattcttctcttctttaaccaagggccaaataatacagccacccaccccaccctgccccagctctccttttagaaccaaactgttgctctctcactttagtgaggtggaaggaagactatttcaaattgactgatgaattaaccctatcgaaggtcagaaaaatgttagataacttaagggggaaaaaaagaaaataaatatcaaaatgtggaaatgtttgaaaaagaaagacaagaaggataggggaaaatagagaagaatagagagagaaaggaagaaagaaaggaggagagaagggaaggaaggagaatgtttgatgagcttatgaaggatgtctctttgcaactgagtgtgaatttagatgggattacataacatgaaacaaaatgaaaagaagaaaaaacagatacattcagtgatttaaaaatggggtaattctttctgtttttatttcacaagtcttttgtaacttattttagagttttaaaactttgtatacatatttaaaatgttcaattttcactaaaacaatcacatttttaaacataagggcatatatttggtgtgacaacctaacatttgccaccaagtgttaaagatgaaccagttttaattttaactagacgatttgaaacttttttgatatacttgagaatttgggactaccaaaaaacccctaaatatgatcctttatattttttattacttctaaaatattttgattctaaacaaatatatgtaaatactatgtggagaatttagatactaaaaatttaagtcaaatattgtttaagtacttacaatatgcccgggactgtacatgatgctaaaagtagccagatgcaatggttactgacttcgagtggcatctttttgaaacagagggcagaaatgaataaatctgagataacatgatgtgagcttgttccatactggagaatggggcactcagagaaaagagtgtgtgcaactgcaggtggggagaagctttgggtttggcactccaggaagatatgttcaaagcagaagggtaaagggcactgattgttcaagaaaagtgagtagtctggaaagggtcattatttcagaagcaacataccaagaaggaggcaggaaaagagaagacaaaacagcagcatggaagatgggtgaggagccaggccacgtgggtagaacttgagtatcataatatttctccatctaaattctactaggactagaagtcttatggacattttatttactctacaaagtgcccacgtcagtgacagataaagagtcaacatctgggagtagcttaggtgggttccacatggcccaggattgaacctctttctctcccttcttagctgtttgacctcagtcaagttatgtcacctctcatgcctctgttttcttgtctgtaaattgggaataataaggtaataataagtattgtgaggattatatatacatgtatataataatacatcatatataacattaatatttattaacacacatatataatctgcacatatgtttattatgtatgcccatatatatattacattatatattcatgtatacatatacatgtaaggtgcttaacagagtccctggtaccaaataagcactgaatcaacattaactattattatttggtttatctgaaacattcaaatggtatagcactaaggccatgtaaaaatatcatgtatttcaattattgaaactttttcacatttttgggtatccaggatagagaaggggaggaaggatctagtcacataatatttgagagtcagcaaattctttcaacaataatgtgattgtatttgtctgtgtgaggtttctatgatggtcattttcatggagccagtcaagcattgactttgaaattaggcagatatgaatttgaaaagtagttttccctccactagccgtttgaccttgtacaagtgactttaactcattttttattattaaaaaaatagggattttttctttgtaagatttttcaagaggattcaatgtggtaacaggtataagtgcctgttagagggcctgtcatagataaatcctcaatgaagggtaactgttactaaaaggaagatataaggagagatatgacactacttccaaataaaaaccctggttcaatattggagcatggggaccccctttaagagaagcatcctcccagcataatgtccaaaatgaaaatatttcatttgtaagcataagaaaggggtcattttaagtgaaatgaccgacttatcaagccagtccactgaactgtagcttggagtctgagttacaaagtaatctatagtgatctgagggagtaatacaaactccaagttaatgactgtagaataaattctactgatatttgcagtctagtgtcatcaaggctaattctcctttaaagaggcaaaagcttcttattgtccccaaaactgttgatatagtatgtaactcagcatgtcacagaaatgttgtttatccactttggctattttgtttaaaaaaaacttttctaccctttttatttatttatttttaaatttctatatttcataagtaaaccaagcctcaacactcggcatttcaggccaggtatggtggctcacacaggtgtgtggtaatcacagcactttgggaggcttgtgcaggaggatcgcttgaggccaggagttcgaggctaacctgtgcaacatggggagaccctgcctctagagaaaatgaaaaataattaggcaggcatagtggcacatgtctgtagtccctgatactcgagaggctgaggtgggagaattgcttgagtccaggagtttgaggctgcagtgagccatgatcttgccactgtgctccagcctgggcaatggagcaagaccctgtcttgaaaaaagaaaacaaaaacaaaccatttcaaattcaaacatatttttctgaattaaaaaagaaaaaatactctctttaagtatatgaaaaagcaaatatctttcctagagtatattacattttaacagctcttgaaaattcagttaagtggtctagtgcttgtggtaatctggatgttagctaacaagaataaaaattaattccatacgttatcaacagcaaagaattttggagcagctaccataaataagaaactgctttagatgctggagatctaaatttggtaagatataatttcagccctcaaggatctagtttgttaagaaacataggcatcataacaaataaatgttcttgaattcaaaaaaaattaaagcttgattgttcagaaagcaatttcatctatatttaggagatgtttacaggtgttatattttataatgcagatctgagttcactttttgtacaagtagaagagtcacacttttatattaatagtgataatattattaacactgttggatttcttccatgtactgtcctagatattttacttattcctagaattttatagaataggtcattttgcttatgttagccttcagttgcaggtgatagaaatccaaattgagcatctattgacacctctattgatctgtccagggaagtacagaggagacctgccttagccatctgttgaccagaggaccaatcacatcaacaggactctcccctctctcttctaagctttcctctttgttgtctttattttcactagggttttctctgtaaggtgcctaaaatggctactagtagctacaggtttaggacctggtccttagcagtttaaatcggaggaggaaaaatacctcctgttcttaaagtccctattaatctctgttggccttgcatgggtgatgggcccaaccatgtaggaacacagggcagcttaggtcacatttccataaatatcagagaagtggtattgcctgatatgtatttcatagctagcaaatgacaactggaattgaagtccatgcttcttccgagtgatcactgtccctctaattgagtacctttcaattgaacctgtttcctggcgttactttaattttgtgtgaaaaactatcttcttgattttaagtaaaagcaatgaaaaaaggccctctaacattttctgctcacaaaaaaattagctttacagatagtagacttcatcagtagatacagtctttaaggaagaaaaacatagtttgtataaaatattactataccctttactatgtaatgtctcctggattctataataattggtgggctgtgtggtctgcttgccatcttccaagatgtgccccttattgaaaaaacaaaaacaaaacctatgtctgtagtatgtatatttgtgcatttaaatgtttgtgcccatggacttgtgtgtgtgtgtgtgtgtgtgtgtgtgaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttactgatagagtcctttaaatgttgagttcaagctaatttttcttaatcttcaaaaagtttagggatcaaattgtatcctgcagatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaagaaaggaaacataaactccataatgctgtctgatattattcttgaagatggctatcattttagctgttataaaacaggaaggaacatcatggagcattgattataatatctatagtcccactagcacaccattaaataaagtgaaggtatgaatatttaaattagaatttgttttttatactatattatgtcaggaagaaattgcaagctctggaaattctttgtgtcttaggaaaatgagattctattttttatagctctttaaaaaaaatacctgcatcagcagacaattggtaacagtcatcatatttggtgttatttagcatttctcaaaaacatggcagttgtttttatgtgggtgtggcatgttggcatttttacattatcgattccttgattcaatttctactctgtgctgacctgtcatatgggataaatctaactacagcaaagctctgttattcttcagtatagtacaacagataagtaagccagatataatacatttgggtgaaaaaactacaaaatcatagagggggatctttttaagagcttttaaaacaatcttttggtttaaggcagagaagtattctacaatgaaacactagattgcataagataagcctgtgcctgttccaacttaattttctttgttactctaagaactccccatatatatgtaaatttcagcagtgttaatgggctttctttggtatgtcagaagaagaatgtaatttgtgaactagataaatctataaggcacaggtgtgagcaaaaaaaaaaataataagaatcactcctcacaaggaaatactaaataacaattattattgagatgtttcatgcattttttttatccatagtagtaagtactactatctctataaagaggaaaaattcaatccaacagtcattaaagttgttctattaaatgtagtgataaatcttcagtttgtatttttaatataagatctgagggataatcaaagcaaaggcttatgtggatagggcatttattacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagcctacatggccattggaaatgaattatacagagatgaaaagttttcgttatagattccctcgttgaaactcaaaaacagaaggcaaaatatgtaaaagaactcaaaactgagaatatttttaaaaatagaataaaatgtcatagaaaaaaatcacatttaagagtttctttcttctattacttttaccattgcagttatgggcgtttggatacagtttgggtttaataaaacccccaagtttggtttttattaaaataagtcaatctatcattggtcaatacatcacatttatctctcttttctagtagtgtcaaatctgaggagcaaatatatagctactatacaaaaatcaaagatttaaaagttttagcattgcattgagctattaatcattgtaaaaacattttaaatgcctccattttttagatgatagctacacattaaagatggggtgtaggtagggtggttgatcagtgtatctaaatagactatagtatgcaaaaacattcagtaaaaaatgttccttgagcaagaagaaaaaataaagacagctgatcaaaacacatgaatttatatgactcagtaattcttacattatcataaatttcgctaccacttttatgaaagcaattcacacaattcacaatgtgaggagcaattaccatcaaagatacataataatatgccatgtggtatatggagccacaggatgaagatggcaggttttcttgggccatcaattttactcaagggcattttaaaataatattttaatattaaaggaagcatatgatactgtagaataaaatttatttgaatttttaaaatctccaacctgactcttctgtgaaatttcagagctgtggctgttaaattggaactatgccaccagaccctggggtatgtctatttattcttctctgcctttagggaatttttttaaaaagttcaagaagccgtgagcataatgcagccttcatagttattctgtttgtagattggtagtaaatttttgatacttattatgaatccaagagtggaggtgaaacatagcactggatatttttatatgtgttggtctatgtcaatcaaataggagagataaaatgatagtcttgttagtgaaagaaaatagggacaattaatgtataataaacttaaagttacatgatatgacagcatagaattaaaaatatgtctgtctagtaatttttttctccttcgcaattattgctttcttcataggcttttcctattgttctctgtcaagacactgcagtctgttttaatcattatcatctactgcttctattttacttgttatgtcatacaaattcatgtttggttctccactaatactgtttcaagaggtcacgaagaaggtatttttttttaaaggaacaccaaaatcgaatgatggtatgatggattttatgtgtgactgagcttgtgtggagtgaagaaaaattcaaaataaattcctctctgagacacactgcatggaaatatcaaagcagtgcaattctttcataaattaaaggttatactctcattctgttttgggtccatccagaagatgataatgtttcgagagcagcagtttctcaggacactcttctgtgtttcactatggtaccaagaaatttgccagggaaagaaatgatttgcctttattctgtcaatattatcaaattaagaatgtttttccaaaaattcttttaaattattgagtgtttattatgagtatttatgatgtgcaaggtgctaggctaattgctggttgtatataaaggtatttggactccagtactattctatttttattttgtagtctgtgtgaatttataaaccactaaatcttacaggtttaatactcaaaactcctcttgtcttcaatatacctaccatagactgtaagggattatttcgagtagtcagttggggtttgatatggtgttaattctttatgcatttacatcattctatcaatttcaagtgtgttcttttattctttttcttttttctttaatttttccaggctgaaatagttatcttttaaagtctgttctacagcagctgctccaccccagtcattgcctttagctttctctagattgccattaggccttcttgaagtcgtgcttattacagatatgtgaggagtgctttttttagggggggaaggggagaaacagatgtagaataatccttttttgttgttgtttttaacacccttttctatgatggccagtgtttcactgatcttgttggctgtctccgtggctggatgagttgtctcgaagagcagtttacactcagtagtgaccaggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagcaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttattttaaaggcagtaaaataatctaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttatattttaaaggagattaaatatattttcactgaatttaattgtatctaagtaatacctttcgaagagtcaaataatacagaaaagctcataacaaaaagttgcaattcttccatccctccttcactctcagagacatgactgatctatctcagctgtttcttctagcatttacccccggatttaaaaataatatatttaaacaactataacttaatttaaacattttagacattatctcttcctttcctagtatggaagacaaagattgagcactctcatctgaccctcacacatttctgcctacatcctgcaacatatacttaaaataaatatttaatgctaacattgttaaaaccatataaatattactcacagctgagctctgtggtgcactgtgtctctcttttcttttttgtacatcgttgcctggcattaataattgctttgttttgaaaaattagtcttagtttactacatacattttactaattttaaactacactttctgacagaattattaaactcccttcagtatgtttcatcacatttggaaatctattaattgatgatttttgttattatttgtgtttcattgttaagaaaaccatcctgatgcttttctctcccacatttttgtagcttccttagaaagagtgaagaaaaggtaaatgtttttaataaattatgtgtctgaagatgccttaattcccccctcttttagatatcagctggctctagaattctaggtagaaagcatctcttctcagaattttgaagatattgcttcatggctctcaattcttcactcaccttactctatgaaccccagggtctttacatcccttgaggactgaagtgtgtttccacttcaggtgctttgcactggctggtcttctatctggaatgcttctccccaagatatcttctggctaactctcttttcttcttagaaaactgctaagatttaccattcccaatgagccgcctcttgtccttttatttatttttgcaaactgcccctgcccactgccattcctggtctccctaaacaagtcttagtatttcttccctttctcttttcatgttgaaatacactatatagtttacttatgtattaggtaaactttttattgcctctctctgtactccccaagctacttcttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacatatttatgacttaactcttattttagaagatttgtaggttataatagcatttaagtgtgtgtgttcatggtcaggtttaaccaaagtcctaggcctgagtatttcaatgtgaagaacaaacagaatatgatattactttcatacctctatttttgatagtctgtgattctgagccctatctatgctttcagtcaaattaccaatggtatgaaactctttaattttgtgtgtctcacgtttagagggtggcttaagaggttctttaactgcatgactattgtgaggaggatacttatgagttgttcttcatttccatggggacaaggacaatgaaaatacagtataatacattcagagtgttattagaagttaggtagtaccttttaattgttaaacaataaagtaataacattgctcattaggcatgtgcttatgaagacaaaaaggcctgatttactgatttagtgatttagtccaaggctttgacatccatatgatgtggacctctgggtactaaagaagtctataaatcccaatcacaactgtgattaattacaaatatcttatgcatgtatttctttagctaaagacagaggtagaatcaaataaaaattactccaagtttactggctctatttctcttcatttgaaaacagaattttctcaaaaggcaaaggaaaagtttgtcatccacatctcttattaatgaaagtgtaacaatcatatactcacatttctccttctgaataaaacaaactactgatgagagataaagataattatttttagtacctctgttgtcttttaaatattccttttttggaaaagcaaaacaagacatgattatattgggagaagaatggtgacccaagaactagatggccttcttctggtacggttctttcactatctggtgtatctctgaagtgtgatcaaaggtaactgatcataactagataatcgttaaagcccctatcctccctccctttctgtatttttacctttcttcccttattgatactaagaccttgatactaagttgttcacaactggcccacattctaggttgaaatgatggtgcatgttggagacaaatgtacaaataaataccatatggttatattactactgtgaaaatgtatgtagaaaatgctggggtaatatggactattttcttaataatctaatttcttacctagtagacagtcaacatttccaatcatggaaatgaactagtgtccacataactgaaatccttcacatctggctatctttaggccctaaattatgtgaaattcactgagtattttccacagagtgctttgtttactgttgtaaaatcttaaatcaaaatgttacatcaaaggaagagttgcatcaaaagaacctcagcaaaacctcaaaacaaccaaacactccacttgtctgtttaaattattagcaaaagcagctctgttatcccagcttctaagctaaccagactcatcattttggcctttcatgtatgcttttcctatggccaaaacgtccacaaattactaataaatgctgacaaggagagaggttaaaaccaggaagccatgccttttagctgacaaaacattcattgaaatgctatctgggtgaagcactgagaaattaatcgtctgaatagtctaaattatagtacatgaagaatgcaacttgctagggagacataccttcagcattattcgaggttaatttaaaccaacatgtaaatgtttgtatgcttcatgtgtggtatcccaaaaggttgtgttttctcttttgatctttgaatatgctgatcgcctttcatgaacagtggcattcaatgcactttgaaaaaaacacagtctttttctttgaaggtaagttgtaagaaagagaaatcattaaagcctggagtgcagaattgttgtcgactgaaatggtatcaagtgagttgaatgcctcatattttaaaaatgggcatgatctctattattactaacaaaaaaatctgcattttatgtgatatctgacatgggaaagggatgcttgatgagtagccaatgatgttgaactggctgtattttccgactgacttgtttttcttatgaaggcagcattttagtaaaattgtgtttgtctttctttctgataggctctaattgaagtttgaaggttcattacacaatgcctgggaatatgttgtcaaatacaattcacctctcccacagtgaatattggcatgattttataggacagggtactctagagctcagctgtcataatatttggctccaatttcattcataatggacagaatatctacaatgttttgaatccctactttcaaatgtcagcacactggaacaaatattaaagaatgggtttgaatctaagtagatgagtatttccttgaagcaacatgttatagcctaaatgttgtttccttcaattatgtttaaacaatgtaaccttaaatgtttcacagatgtatcacttgaaatccaaaacacatactactcatcaaagtcatctttatttaagcttaggaagaaaaatagaaatctgaaatgtttgctcttagtccacacacacttctcatctggcaggacatttctgaatttatttgggaaattgaatatatgtcaggtaggtttgggttgctgggtaaatgagtgtacttcagtgtcaggactgtttttattaacagattttataaactggcttggtagtttccagttctgtggcaagaacaatctatcataataaacctgtaacataaaagtacagaatacattcctgtttcaagagtctgtaagaggagtcccctcatgaacagtttatatgagaggattataaaatgaagttcagcagtagcacaagcaactgcagtgaatggtgtgttgttaaggttctttaaatcatgaaaaaaatatactttcaaggatttattaatcttactccaaatatatatattttggtaaatagcaattggaaagaagggtttgtatttcttagaagcactgagctgaccaatatattggaaaactaagtaaagcaggccagtgatctctattctgagtgaaatattttgctctgtttgacatctgggtgcaatgatggctatgtcagtgtcactttatttttctcttgtgcaagtttgataaaactctttaaatactaatgtgtattttagaaaacacaaattctgttatattccaggaggaaggaaattgccttaggatatgaatcagatttgataacatgaactatcttatttaattattctaaattgaaaacatcatgaaagataattgggatttttccatttttattttactcttgtttcttgcttatttgaatcattcgttttattcttctttctacttaggctaagctctcaaaaggaaaggagatgtaattcaatgtatgtaagtttctaagtgtaggtatttttcaacaaacacataaacaatcatcgatgacattattacttatgtcacataaaaactgtgtttaaacagattaaaaatattttctggagagttttatttattttacaatgtttacaagtgaattgtcaagatgtctcccaatattatttcctttccagacagcaatctttaaatcctgcttgagtcatcttttattccagttttcctttttttgagtgtaaaggcaataaattataacaataaaagacttatactctttgtcccatagtttctcttttctgttgaaatatagcttgctctttggaatattaacatgtaaaccagaggtttttttttttttttttttttttttgaacaatctgactattctaaaacactttttaggatatcactaattgtcaataaggaattgagatccacagataaacttatcaggaacagaaaattgttttgaatacatttttaatatttaaatagtcacagatcaaaactaaatttttttttaaagattctgttgaataggtaggacttcacattggattcaacctggtatttaaaatgcaaatactttttgatttctctttttgctaagtaatattctaagagattagccatacattttaaaatgttgtgactgtttttgtgtttcatgtttgtataaatgtagagattagacacttgtttaagatccttaaagatctgaggtaaattatttttgggaaatacaaatttctttctgtaatttctaccttctgtgaacaacttcttgaagactgttctgttgctcttggtttatacgcaggtcccttaaaataacaaaataaaaaataagaaacaatacataaggacaaagactggaaataaaagaaaaataatttaaactcaagggattttcttgggtaaggcctcagagaatgttccagctgttcttaagaaagacattgtatataaaggccacatttagctgaatagactgaaaaattcttattattttgagaaatgattcaattgttgtctcaatgctaaatattcataaaaactatccattcattaatcctttttaaactgaagtaattagaaaaagcaggtcaatgtgcaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatttgaggctttataactgaaattggatatggttcaaacgttcaacagatataaacatattttaattaagaataaatatttttataagattgctgaaatgacttctctcaaaaatttatgccggaacatcaacaaataaatttgcattacaaaatagaaaattcaattgtggaaaatcatattctaacttattctgatgaagtagttcccttgtcaggaagctttttcttaaagtgtgttttatgatttgtgatagaattaccatcactaagtcgatcattgcccattggttagtctacatgtactgccttttagtgacatgagttcaattctaattaagaatgagaatagcctataactatgaacacagatagctacatgtgtctctagtgagaggtactagtcctctttgacatttctcttaaagcggaatttatttggggtagtgatggttttactggtagccataggggaagataagaaaagggggccaagatattcatttctactgctggcatgtggaatgctcttttcctgctccatgccagtctctcacttgatttagaaagatttgtgcgtccttagctttgaccatcaagaagagtccatctcctttgccttcctgtgcctggtacctgaaagacctagtgaagactgaaagaaaagtttttattttcttacatagtgaaagcactttgaagcattttgttacacatatctataatttaacatgataattatattgatcatttacaattctacacattattttagcaagtaatgaacgttcttaagtgcctagtgttgtcataggtataaatcaagtaggatacctgccctcaagaaagtgtataattttatgcgtagagataagagatgagtactttcgcagaaacaaatgaataattatataccaacatggagaacttaagctcataggtgaatgtgggaatatggaggagaatgaaaatcattgccaggtgagtgatcaaagagtgcattctagaaaaggtggtacctgtacaggggtttggaggatgcattggtattaaataagagagaaattagagggaagacacatcttccaggcagagtgtctagaagcagagccagcagcagatttttagtgtaagcaatttattgaaaaagtcctctcagaagatatctatgagatggtaagaaaagctgaaaaaggtaggggagaaagtggacaaagatgtgatctctaaagttgagcctcagactgatacatggcatggtctggagggaaaattgcaccacagaaagaggtaccccttaaggaacaggatgccaggattttacccctcatatctgtcagttatcggctacaagtccaaggggcagggggaagtgcaagtgatgtatcttgctggaagtctcagggtcaggaggctctcattcaaagaggcaggtctctggaatgatgcagctgcaagccattagcagccaacccttgcctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacagtttattaattaagaacactagatttcaagttaaacagacctgaccttaaaccttgaccttgttctttgctgtataaatggttttgtatgagttacttaaccacactgagcctcaaattcccatcagttatatgtggattataatgtctgcctcatgcttgttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgatgggactagagtcaggatgaggtggatgaaatgccaggtactttcatctgtatgacttgagagtgtatgcatcaaattttgcaccctcgagcacctctctcacctccacattgaaaaaaatacatgccagattaaaaaaaatgaaattggaaaggatggtttgtagaactgttagagcatccataaaactcattacaaagtaaaatatattagtaataaaatgattttagtaatacctcgggaaccactctaattccaaatcatctctctgtctcttgtaatggctttccaatattctttgaaaaatattgaggttattttagttatgatattggtactttgatttggtttaaatatccttttattcttgagatatacaatttcaactgaatggcaactatgacagagttgaaaatgtacagaaaaataaattatagattagacaacgtattaatttaaaagcagttgcaagcaagttactatattgcaatgaaaaaaaagttcctaaaattggtaattcaactattgctgtcctaatagctgaagtcatttttatgtatggcaatcctaaatcaaagccatcataagatgctgcagacctcttaatagcttggctccagtgataatgagcccaggacattagagctcatttgagagcaggattcataattttttttactgtgcaattttcctacctctggctttgtctcaaagacatagccacacatggagaaggacactgataataagagagtttgacattctttataatttttcttttgccaggatccttataatccttgaatcaaaatgattgaagcagttatttttaaaaatagaagctagatttaaaatgtattattttgtgcctcttttgacattattttgtttagagcacctttaaaaactctactggtgattaaaatattgaaactataacagtatttttggcatgatttttaaatacttctttcagctatatacttctctaacttattggcttattatttgatttaattgtccttaggcagtgttaattatgagagtttgccgagtttcttcttgggaatttgagaataaaggatgcgggaaagaggaggtgggtggaggatggatataaactgttttttcaatgtactgaaggcatttcagattaccagaagaatcacagagacaagggaccatttagccatagggttaaacctgtcactttacctaccccacaaataagtaactatggcaactcactgaaagtgcttagctaccatgggagtggatggagttcgtgctttgtggggacaatgctgtgggacctctatgcccccatccataagggaccctgggaattgccttctagcagagaggccaactcacatttcaaataagtatttttccctcctcaactgcttttctaagctttgcacattaacactgacctagtgcaccatttaaaagtcctaaatatatcacacagtcgccagcccaatcaaggtgagtggtcagacaccagcatgctgtgcacagtatgctagttggccttagagtaatacagggtacaccatttatgtccagttaaccaggtgaccctctagttgctttattaagcacaggcttgactgtcaaacaggtcacaaggaggacaaaaagtgtccttgcatcgtatgaaaagagttgcttgaaatcacagaataccctctattaattgctaaaatccaatttccacctgaagacatgcctccatgactcgtgagaaaaatcaattatttaggtaaataggatctgcaactcaaacactcagacctattagagtatctagcagcatgccaggagatagactgagctgcaagataaatatggaaccatcttgtggaatataaatttcagttaaaggttttaaggagtatataataaggaaagcattgttttatattaaaatgtattcaattatattatgggatggaactgaaagttcacatgcagttttcagatgtgtcccccaaagttaatatatttcctgggtactcattcacactcttctgccaatagtattaatgctttgggaaatgtttgagaagtgttgttccagtggaaatgagcctgtgggttcactgattcatttatccattcattcatttattccttcatacagtatatagctttcaagccacttttatggactattttattaactttgaatatcaaaaccaataaaatagactttgtgtctgctttgtgacacaatttaatgagtaacaattttttttttttttttgagaaggagtctcactctgttgcccaggctggagtgcagtggcacgatcttggttcactgcaagctccgcctcacgggttcacgccattctcctgcctcggcctccggagtagctgggactacaggcgcccaccaccatgcccagctaatttttttgtatttttagtagagacgaggtttcactgtgttagccaggatggtcttgatctcctgacctcgtgatccgcctgcctctgcctcccaaagtgctgggattacaggcctgagccatcgcgcctggccatgagtaacaatttttaaaataaaaataaatagcaaatgatgagtaaagtacaacaataaatcaaacaaaatgctattaggaccatatggcagaaaaacaacagaatcttagaagagttagggaagacttcccaaaggaagtggcaattaacctgagatttttaaagatgagcaggagaatttcaggcaaataaaacttgcagtggggttgggagtaggtggatggaccatgatattccaggtgaataattgagcactttagcttgggaggagggccctaaatgagaaagtatatgacctatttcaggaactgaaagaaatttggaatgcttggaatataaagtgtggggcaaatgatggaggacaaagaggcagcagggataatatagtttggctgtgtctccacccagatctcatcttgaattgcagttcccacaattcccaagggtcatgggagggacctggagggaggcaattcaatcataggggcaggtctttcccatgcttttctcgtgatagtgaataagtctcacgagatctgatgattttataaaggagagttcccctgcacatgccctcttgcctgccaccatgtaagacgtgactttgctcttcaagtactttctgccatgattgtgaggcctccccagccatgtggaattgtgagtcaattaaacctctttcctttataaattaccctgtcttgggtatttctttattagcagcatgagaatggattaatacaaggcattagagggaaagagtggggagaggtaaagttgaaagacaagcaagaagcagatcatgaaacgctttgtgagccttgttagtgagtttcagggaaatccctctaactgcaatgtggaaaatgaattggaaaagtcagaagaggaaaattcattaaaaggatgtgaagtaattaaagggatttaggataatggcctgaactaagaaagtggcagtgggaatgaataatatgaatggactgacaggattttttttgtattttgactcagcaggtgttggtagcattagatatagagagtggggaggaagaaggctctaggcatgatgctcagattgctgatttggttaaaggaagcagagaaagatacatctggagaggaaacaagaatccccactttttgttttgttttttccagttcctgatagatagccatgctcaagtgtcccagtggcagttgagtatttagagtcaaagctcaggggagaactctagctggtgataatgatttgggaattttggcataaaaatactcatttgaacccagggaaatgggaggtaacatccaggataagcttgtagaaggaagagactgtgtagtaggaacacagggaaagatatcaacaccagagaggaagagatgctttgcttgagggtgtactctacatttaaatttttctctttgagagaagaatcatgacaataagaaatttgatttattccatatttcagattgttttgaaagtggtatgtcactaatgaaaggagtgtgaagtgaatactgttgacattcctgaggaaatgtatctggggggccttaaaatctgtaaatatcataaatatcatacgaatcctaagaaattctgggatttaagggatgagtgggagacttaggttcttggttctgtgttgtaagtcattctccaagtgtagcaggaccatagcactgatgaaaatgatttatacagtagtcttatgatccaatgcccatgtatgaacaaaggttactgttcctgtcttctaaattggggttcccagtgtaatacaggaagactaccgtgtgctagtaaacagaaagcacaatccacatttgaccatattttcctcgttggatgtgtttatggatatattttattctgcttttatctttctgagattaatgccttatctggccttttttcctatgagtacctttggttataaagaacttcgcattgctacattatcaattttcagcctctcttcttttttatttttaatttctttgccacctcttcttaatacataatgctctttcttccttcgttcctccccctctctgtttcttccttcctcctttctttcttgctttcttctttcttttctttattctttcttttttttttttttcaaggtcttgacgtgttgcccaggctggagtgcagtagtgaaatcatggctcactgcagcctcaacctcctgggctcaagcaatccttccacctccgcacccccaagcagctgggactacaggcaagggccaccatgcccaactaatttatttttgtttttcatagagatgaggtctcactatgttgcccaggctgctctcaaactcctgggccaagtgatccttctgcctcagcctttcaaagtgctgggattacagacatgagccacctcacccaaacttttctttttttttgagagattcttaaactagattgtacttacgataaatgttgactgattcattaccttcaacagtgctttcagcctctgatggttcagagaaatgattgtgtatactttatatttcacctgaatcaggtttcggttgagacaataattttctgagtatgtctccacttcacaaaattaatttattttcaacttttctctagttttaccactcttttgataaataatcttacagtggaggaagacttattgaaacaatttcatcacttttttttctcttgtttgcctcagagtatggttgattcattctctccctaggttggagccattgcagaatcaatattttacttttaactgactccaaaatatatacattctagctaagtactttcagcactatgagttgtccttcttttaaagagaaatttttttaaaatgatatcattaaaaacaagccattccatgatttattgtataagagaagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttctttcttttttttttttttgagagcatggtgtggtctcggctcactgcaacattcgcctcccgggttcaagcgattcacttgcctcagcctcctgagtagctgggattacaggcgcctgccaccaagctgggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgcttgcttctctgaggaagtgactcttggaagaattagtaagagctaggtgggcaaattcgggtaagacagaaggttgagaaagatgttttcagagaaggctccacaggaacatagttcctctcctgctgtattatggagagaacatggagccttcagagatataaaaatgtcattgtggctggaatgcaaagatgaagggaaagagtttgaattgaggaagggatcagagcatgcaaggatttaaagattactttaagaatttggtgcattatactcattaaatgatgtttgccacttgggtcaacaaacattctgtaaaggcttagatagtaagtattataaatattgcaggtgatatggtctctgttgcaattactcaactctgctgttgtaagggagaagcagatataaacaatatgtatgtgtgagtagatgtttccataaagctttatttacagaaacaagccatgacagtatctggcatatctcctgatcagataaatcctcatgttgctgccttatttcccaatgtctccgtttgaactagtgcagggatattttggagactttagcaatgcctagtcagcaagcatcagtgtactttagacattgaaaatcgggttaggaaaaaaaaaatatggactgctttgattttcctttgaagtaatgtcacaagaagaaaacagcaagctggttcatttgccaaggaaggaagagcatgaaagacaaaatgaaatgccagtaactaggtactagaggaaaggagtgctaagaaaatgttcaaaagggatcttgaaaagcaaagatcacttggtagatgaacttgttcaaagtgttcgctaactcacctcttgcaagaacaaactatcttgcaaggctctactgcaacatgtctgatacacagcacctgcagtcaacagactctgtagtnnnnnnnnnnnnnnnnnnnntttgtgctcaagctatagaagttaatggactgtcataacattgttcagatgaaacccagcaaagcttaacagactaaggtggattttgcctccccttttaatccagtgctaatttctttgagtaatctcagaaaacttttttatgctaaagtgattcatttataaagttcttgtcaaaacaaccagtgtatttaaaatattttggaattataatacaggacacaaatgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacacttggtgtgcattttagaatatcttgctggttcccagtaaatatgtcaactttttgcactatatgccgcttgaaatgtcaatactgcacaaatacgcgtagtctgctgacagtaacctgccaggttctagacttccatattgattactgttagcaaaatgtgtaggtgaaatttttgtagggtacgcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacatctataaataaataagcttatttttccatggtgtcagagagataatgagactttcatataaaactatttttgccagctgaaatatcatgattgttattctaatatttcctccacaaagacttagtgaactgcatgtccattttagaaagttggagtagatattttaattttttcttgcttcttgagaactactatcaacaataaaaaaagctttgattttaacgtgtatatcttaagatttcttttgatcaatactaatgaaaataaacctgaaaagcgaatcattggacaaatgtgagatttttcctttaatttatacattaattgatgtaagatagtatttagaaagtttcaatcctttccagttacaattgtaattgtcacttacctcaaactaaacaaacggactctttcccatatttttctacttggtgaaggacattctaatcatctagatgcctaagtcagaaacctaggcatcatcccttcattctttctgttcctcacagtcacacttaattaattgaacgattttcggtccctacatacttcctgatttcctcccctgtgccctactgcttctctccctaactcagataatgatttctcgactatcctattttaagatcaggctattttgtctccttgcaatgatctctctataacctagtaatatcaagccctaatgaaaagtctttggtcggcttctgtcacccaggataaacgtgaaactcctgagagttggatctacttcctttcagcatctcacccttgcctgcacttctagcctccactctcaaaactctttcacacaccatttgaacctgagacattaaaaatgccttccagggcttggtgcagtggcacacacctgtaatcccagcactttgggaggccaaggccagcagatcacttgagctcaggagttcgagaccagcctgggcaatatgcgaaaccccatctctaccaaaaaaaaaaaaaaaaaaaaattgctgggcttggtggttgagcctgtcgtcccagctactcaggaggctgaggtgggaggatcccttgagttcagaagttcaaggctgcagtgagcagagattgagccactgcactccagcataggtgacagagccagagcctgtctcaaaaagaaaataataataataatactgccttccagttcctccaaaataacatgtctttccttggtaaatactcttcttactgctttcagcagacattcaacccacaggtcccaggtcgttgactcattctcatctcttaattgctagccaggcctttgggaagccgttctctagttcctactcagttaggcacccaacctctctgctctcatagcacataggctgtccctctaacatagcatgagtcacacgctttccaaactggtgtttacctgcttgtcttctttactgcattgctccttgaggtagcaaggatgtcttctttattagcttttttatactgagaaaattttaaaatacaggaaaagaaacatgataaaatatatacccacattcctaactcatagaaataactgttgacattttgtcatgttttcttttcttactagagaaagaaaatgagataaaactaacctgcatttctatcctacttttctgcctgtcttagaggcaaacaccaacacaggtttgttgtcaatttccttcccattaaaaatacttttacatacctactgtgtatctatagccaacagatcttatatttatgtggtgtttgcgtttttccaattttagaaatggtttcctacctttcttaacctacgacttctgacaattttatttcaaaattatgccaatatgtatagatctcaaaaacataacattgagtgaatatgccaataggtagaatgtcatgtaaagtttaatttttgtcaattttatgagtgaaaattgtatatcactgttgtttttatttacctttttttaccagtttttttccagttttgttttattattattttattttattttattatactttaagttttagggtacatgtgcacaatgtgcaggttagttacatatgtatacatgtgcctgctggtgtgctgcacccattaactcgtcatttagcattaggtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcatagtattccatggtgtatatgtgccacattttcttaatccagtctatcattgttgtacatttgggttggttccaagtctttgctattgtgaatagtgccgcaataaacatacgtgtgcatgtgtctttatagcagcatgatttatagtcctttgggtacatacccagtaatgggatggctgggtcaaagggtatttctagttctagatccctgaggaatcgccacactgacttccacaatggttgaactagtttacagtcccaccaacagtgtaaaagtgttcctatttctccatatcctctccagcccctgttgtttcctgactttttaatgattgccattctaactggtgtgagatggtatctcattgtggttttgatttgcatttctctgatggccagtgatggtgagcattttttcatgtgttttttggctgcataaatgtcttctttgatgaataatgagatttaactttttcccattgaccattcacatgttcccaactctgaatttctagtaaattcatgtttttccagagaatgaaagagtgaatggccactgtcttgaggaaatgggagtattctagatgcatagtcaggcagtgtgattagtatagtgcaagaatggtaggaaaggatggagaggacaatgggaaaacaccttgctaaaaagtttggattttgtcttctagtgatagaaatgtactgatggtccctgacatgggtaacagctgctttagagctgaatttcaagaatcagcttgtgaacaatgctttggagattaagacagtaggaaggagaagatttgaagcagtaaagtgatttagaaaactatttcaatggaccagacaagaaatggtaatggcctgaaatgagtggagggagtggaaatgaagtcacatggctgcagttgccatttattggagaaactgaatttcagggatttggatcaggtcaaggtatgttatgcacataaaccaaatattaatgatatttatttagtgtgcaccagtgatatttgttttttccttcgctaaactgaagattaaggcaatcagaacctagtaaacattgctgaattcaccattgtatcccccagtgctaatacacaaaaagtatacaatgaattctactacctacctttcgcagtgtggctatccttgcaaatttcaccctttcccttcctttcagtcattcttgtttccccatgctccatagatcatttagccaccacatctttttgtgttattttgttttctgcaatgatgctggtataattcagaactactagcaaaatctcatctctagcttcatgtgatattttcctgcttataaactacccatattcttgctgtgctatagtcaatatgtgtaactcttctgaggcctcctcattcattgcagatgtttgcaaacttacctctcttcttaagggcccattcgtatgtacttaaataggaagatcatcagagacaagtatccacatgtgaactcccttagctactgttcttttctctaaatttctctttttctctgttcaaaaaatttccaactttcaactttgtggacacttctggaaaaaaagaaagtcgtgtcttaccaattttgcagaattgaattacaagtttctcatactaagacatttttctatggaagaaacaaggttcttttgtagagatgagaatttaaatgattttttttttttttgcaatgggaagagagatttctcactagtcttactggttttcatctgactttatagtttaaaattgatagccattttgatggcaacacacatggtttagttaaattttactccgtcctcagttttcctgagggagtatcagctactgtgttttctttacaaaacaacataaattccatgtatccaccctgggaatcacttcactgcgttgaatctggataggaaataaagattcatgaatatttcacaatttactaggaaccatcactttcttgctcttccgtgtggattttctactaattagttacttggtatgtctaagatacgttatttttattatacaaagactgtatcactttttattcctttgatataaatcataatacagtgtctgataagtacagctttttaaaaactcttttcatagactgtcttattctttttagatttatgcccatgatgtgcatggtcctgaatgtggaatgggtctctctgaagaaaagtgggtcagatggttgcttgtgcatattggaaagaaactgatagcttcctggtctcttttgaagggtgctgttgtaaaatacagattagtcaaggtttacagtgctgttactagcctgaacacttcaaaccaccatgcagtttaaaactattcagtgcttatggcaaaattcaggtcttttgatgttggggcaggagtagacattttattggaatgtaaggcaaaaatagagatgaaaacattgaatcatttttggtggggggattgacttaccttaataataattttttatacctttaaatccagaaatgtcaagaaaatgacacacaagaacaaaacaaaagaaaaattcagtttagagcctgcttaaaaatctgacattgatcttccaatgccttaaaaatgtttttattatgaaaaaatttgaacatataaaaaatggaagatatggtataaggaaccctcaagtacacattacttgcttcaataattatcacccatcaactaattttttttttcatctgtaaccctaccaactgttctcctttcccactggaatattttgaagcaaatcatcatatcatataatctgtaatctgcaaatatttaagtatgcatatctaaaagttagaattctttttaaaatcataatctcagtataatgacacactaaaaaatgaacaataattatttcatcccatcaaatattgacaagctattattcttttactatatattggctagaattttatgtaaagaaaagcttttcaccattgactcttatttacctacaggtagaattcaaacaggaaagcagatcaaatacttgattctttctttttatttcccagtttttagaaaaaatgagttggtttactagtatcctttaatgataaccagtttgctttttgtatctctatgaactcatagattttaaatatatttgatatgtttcgattcattgcagttatgattcttttcaataatcaaattgtctcatctttggttggtaagagtgtcttcaacttggctttctagtcctttaaactcagttttccttaatgattctcatgcttttcagtgttaagatgtggtaggattgttttgcatatttcctgtcctggttttagaaacagtcatttcttggaggagccctggttccttatagtgaaaaagggtatttcaagaccacaggtcggtagggctgttcactgttaatatgtaggttgtttctaggtcttttcagtggatcaggtgggaaatatatatttcaaatagagaaaatacattatagtttattctgacatgcccatttaggaatatgaggcttatagttaaattcattaatttcatatttgtatcttttttctcatccactgaaagttttgattcctaataacttatttgctctatcatagctctctatatatcatttcataataataatagaaatattatcatatacaacatagtggctgaaatgactttgaaagatttcttagccacgattttatatttataaagcatcccactaggcatctacaatcaaattacctttttttaaaaaaaaatcacttgaaaaaattattttatggttaagccaccaaacaacttcatttgcttcatttgactttttgcctgaaagtattttaaatatttgttttataatgatgtaaaaacttttacatagtttcaaggtcaaatttgcaaaataagttatattcagagactagactctctagatccattcatcctgttttcttcctcactaatgtgtaaccattttatttagggttatctttccatttgttagaaatattatatatataaatagtttgtttaaacagtccgcttaagaatatttttctagtcttttgctgctacaaataatcttgcaatcagttgttttgtgcacgtgtcttttgctttttgtcattgcatctttaggatagtttgtttttttttttttggttttttttttttttttgaggcagagtctctctctgtcacccaggctggagtgcagtggcaggatctcagctcactgtaaactcttgcttcccaggttcaagtgagtcttctgcttcagcctccctagtagctaagactacaggcgtgtgccccacacctggcttttctttttttcgcatttttggtagagacgggtttcaccattttggcgaggctggtctcaaagtcctgaccttgggatccaaccgcctcggcctcccaaactgctgggattacagttgtgagctaccgtgccctgccaggatagatttctaaaagtgtgattactcagtcaaaaggtaaaagtagataaatttattagatgttgtcaaattcttctttgggagtaatgccattttccaatcctaagatcagcatgtgagaatgtgttctgtttccataggttctccaacaaattatattgccaaactttatgttccaaagctttgtggggatatgtctggtagttgattggggcagagaaaatgagaaaaacttagtatgaagaaaagagtcttaggcttgaaattaagacacaggtttaattcttgaccattgctgatcacttgtttcaccttagacaagtcagccaacttttttcatctgctccacagatctgtggtaaggattaaatgagatgacatccatgaaacatatgacagaataccttgccatagtggctactcagcatgtaagttttttgtttgtttctttgagacagagtctccctctgtcgccaggctggagtgcagtggcgagatctctgctcactgcaacctctgcctgctggattcaagtgattctcctcccaaatagctgggattacaggcatccggcaccaggcccagctaattttttgtatttttagtagagacggggtttcaccatgttggccaggctggtctcgaactcctgacctcgggtaatctgctcgtcttggcctcccaaagtgctgggattataggcatgaaccactgtgcccggcctagcatgtagtttttaaaaggcaaagcaattgaaatttgtaaagcatttggatatctacaaaagttatttgacgagaacatacaaggggacatctcttatggactggtaattttaggattgtccacttgatgttaactaaatatccttcctaatgccaaaccaacacatggggtaagaataagtgatgctggactaaaaaaaaaatttgatttctctatcaaatgtacttttaggtaaaaaaaaatatgcaaagtataaaatatttgtatgggcaaatgttttactaagggtgtttgggttattttctattgaacaaaacctgctaaaccagcataagatgcactgaactaaagtgcagcagagatgctactgtcagcaagagaaggattcaaagagaggaagcccaatccgagcattacctggacaattaaacagtcagttattgggattttcacaattcttagcttttttaactttcacaattcttagcttttttaactttgagttttaaaaatcatgatggagagaaatttagttcttaacttttattttctgggcttgatgaagattgaatttcatcagagatgagctaaacaaattaaaactgaagcatttaatttagaaaactcaaatttcttcagcctaaaattgttcatttaaacaagtttgttagattctcaaattaataggatactgaataaatatgaaattattctttcctggaaagttaaatggaaaaacaggacagaatcgctattttataactaatacatattaagtcaagaaatagtaaaggattatttgtcttcaagaaaacatcctgtaaagaatggcaatgttggtggtatatagatgtaaaatgcttaaaaagaatgattatctagaagatgttatacatgttataattatctttaagtctgccttctctaattctgtaagttaaacacaaatattgatactttaatttttaaaatatttttaaaagtagctgaaaatggggctccatccttcaaagttctaacaatacaatttatagtaaagaatatgtatgagaaacatttgttcttagaagttcagaaaaatcaaatatataatatgaagatagaataatgtagagaagttaaagaggagaaaggggtgactgattctgaatcaagtgagttttagcttcttttaagtgaaatcatgcatgctcctcacatatgctaatgtataaaacatcaatttatagaatagtatttgaattacctgcctaggctttgcaagcctagacctttgaatttgcattcaaattcttgatgtacattttctagctgggggactagaaagcaagacactttcctttcagtaccttgggctccccatctattaagtggagatcattaaaatctgccttgcaccgctgtcctaaggatttgagataaagcatacaaagggcttggcacatagtaggtgctcctaaatggtaactttattcttcacatcaggctttgcttatacttataaaagccagttttgtagataatttgctgaatagaactaagaatagttataaatattgggttagtttatttgagctgctatgataacataccataaactggatggattataagcaaagataatttatttctcacagtctggaggctgggaagtccaagaccacagcagtggcaaattcagtgtccagtgagtacctgctttcctgtttatagacagcacgttttttttctgtagcctcgcatgatgaaagggagcaagagggacctctttcagacgctggtcacctccctaaagccccacctcctgatatcctcacattggagattaggtttcaacatatgaattttagggggacacaaacattcataacataggaaaatacatattattttaaaatgctttcttattctttattatgaccactattaaaaccaaacagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactttcattgtgtgggtgtgtgtgtgtgctgtttgaaacaaaatgaactaaaaatgtttttaattgagctgcaagtgaagacttgtcaatacataaattatacagtattatatatctctatatatgcataaagaggatattttaatcagcacatgtccctgtatttaaaagttaaaagaaccgctctacagagctaagaatacaggtattttaattttttaaatgattataacgggggaaattccactgttgtttctttagtgtttgatgagggattgtaatctaatcagtttaaacgactataaacacagcgatgatcatttaagttggatttttattcgaaaagtaagttcttggaatttagggtattgcacaatctgtcccatacaggggaaaaaaaaatcacctacttgtgatttttactaatttttttccgtgagaatagaatcctgctgggaagcttattttattctcttagatttgcttcctcctttttttccccctccggagaacgatgactggtttacaaatagcaatttatatcaactgacacagtcctttttccttatactgttgatctcagaactgttctgcagtcctgaagtatgaaacactattgccattttttggtacagccagtgctctaaaaaatgtaaatggatgaaagcgattcaatctattatggaagcagaaacatcttcctatttgctttacaaatttttccgagtaaaatgcagtcaggtttgtaacattgcataaaaacttgttttagaattctttacactaaattaaagatgataaagcaatctgcttttcatactaaacagtgaagtgaaaagcattattttaaagaaatatttctgttttgttggtgtacgaaattctgtaatagtggctaacttctttaggaacctttttaggtgaaacttatgattgactatgaaatctattctaggacaaaataaaatgagaatagaattatatgtctaattaaatgatatatctaggcaaactaaccattcaagttttaatttttatgaaaactttctatgtgcccctgacatctgtacatgtgtttaatttccagtgagctcaaaatacttcaagtgatctcatttgagtattaactagggaaatacattcacagtctagcaattttcttttatgtctacattattttaaatcatagcatagattttccactgtgctttatgaccagaacacatttatttgcaaagtattttcacttaccttatattgtagtatgtagtataggacaattgatacggtcaactgtttaaaacgtcagatgcaatgatagagccttagcatttatagatgtagcattcacagttgcaactctttcagtttcagacatttgtgaggaatctcataggtgtgtaatatggtttgaaatttgtgaggacagcaattcgtgctctgactctagtcattggcggccagtgagcaagcgcaactgatcacccagtatcaacttcacaatgtggtttccactaatcggcaccttatattaatttttatgaaataataaaaaccttatttcatagcaggagcgggtacccaaaaagtagttaaatggctaatcctttatagtttttatgtttttggaaatttgtgatctcaagactatccctcaagaatgtcaaggttttgctgaagttaaagacatttgttattctgtggtcagattatttcagtagttgagatgtagtctcacattaagggagaaatctgcaaactagaaatggtttgcaaatggcaaggcaaagcattcaaataactgttacatgtgataaaaatctcttttgggtttcaggatgacaaggtacagggcccagggactggcatttaaagagaactcctatacacacacttaaattcaacaaaaaagtctgtattctataatatccaattaccttaattgtgtagtggggaaaatgaagagttgaatttctggttagctagactagggtaggaagacaccagctctttgtttgttttgtgctttgacatttcaattttcccgcttggctttgtccttctgtcttcccttgacattgatgattttgttgtaggtacgtcacctccttgaatctactgatatgaagagaaagctataactaaagttaagacaatgttaaagtaaggtccaattctcagttatctacagggctatccaaaagaaaaatggaaatttcatttaaaatagctgcatcttttaagtaggaatattttgggctattatatgccagactcatcactggtgctatttaatttctcctcccatcaatgagagctctccctgagacacattgtgagatctttctgaggatgaaatcacttaaccccagcaacgccactgattattttcagctacaacaaccacacttctatgcacacacatcaatcacgccaaaaaacattctgactaaaaagctcaaaagaaaataattaagcattctcttttccatatgaagatattactgaccagcagaaagtggaaaaatgtatacataatgtttatagatactgacttaacaatgagtgaacagttgcgtctcacaaatttcagcagcgttgtcttgacagtggatcatggtgcttctgtgttgctaggcaacccgaggggatggaaaatttaaactcaaatttacttatgtatgttagattttagacatattatattgagagtgtattacacatgtcattacaggctagttgtacatttctattctgtcttttatgtgagtttctcagtatatacatgaaagacactctgcctgtatccttgctcctctatttttgaaaattaacatagtcctaatatgcatttttatggtcgacagtcgtggtatatgagagaaaatatgtagcctttgatgtaaaaagattgtttttaaaaaaacataaactttacaatatatgcttgtgtgtgtcagtcagagggggaggtggagagaggcagtgtttctgaaacaagagatctatgaaagaagggaacagtctgttagttccacctggttcttctcatttaattactataattaatatatgcagaagaaaaattaatagggttcttaaatccagggagatattaaatgtcaaaaatgtggatatttgaattaaagactaatcaacttgaacaatacattataatgttaaagaactggtagcatattaatttcaagtgagagttttaaacttgataactgcagtggttttgtgaatccaattttaagagttaaatgttgtgtcaatgccatgaatcagagaatagatatttataacaaaagatctgtatgaaatgatgcataatagatggtgatggctgaagctgctgaaaattgatggtctaaatcaaaaggatggattaggaatctttgcggaattattacagacctgtagttttgtgagaaaagcagagaatgtcaaggtcttttacttcaaggaggatttgaagtatttgggggtatacattattgcattagcttagtcagtttacagctagctagacagtgcaaacttgtgaaggaggatgttttcagtatatcacactaggatcatggcaccagtcctgaagaaatagggggaacttttgatctccatcataccatatacacacctatgtgtgggaatgctaatgggatagaatctgatacagttagggtctgaaacactacgagttcttatggtactttgattcaatatttagttgagtaattcttgttcacttatttgtattatcctcattagattgaacctgtataggtttatctttgaaactaaagattaaattgaatttaagttctactgtattttttatcaagattatttttaaaatagcttgtatcacaggaatcctgagtacatacctaatactatcctctactgtatagaaatttagtaataatgaaaaagtatactcctggatttggttttctgggcagagaaaattaaaaactttaagcaggtatcatgtagaataacatactcaacagatattattttgtgggtgacaatttttatagacattatatgtcagatgaaatagctaattaacattaattctattatatttaacataacaccctatatacctcggtgaataaagaagatttctaaaggatgagtttaagaggtattgataaggaccagatatttagtaaagaaatcccatgattccctagatttgtgactcttcagtgacacatttaattagttaatgctttgtgaatcccagaattctttgtatatactgtgatataccatatttttgtcatagtaacaacaatttaattctgattctcctatagatgaatctctgcgttctatctttcatgctactttgaattcggtttttaaaactgaatttaaatatcacagtacttatcatatgatattcaacaacctgactgttttccattttattttattttatcaacttttattttagaatcagggagtacatgtgcaggtatatatcacacaagatatattgtgtgatgctgaggtttggagtacaaatgaatctgtcattcaggtagtgggtatagtacctgataggcagttttgttttgagacaaagtctcactctgtaacccaggctggagtgcagtggcacgatctcggctcactgcaacctccacctcctgggttcaagcacttctcctgcttcagcctccatagtagctgggattacaggtgcctgccaccacgcctggataacttttttgtatttttagtagagacagggtttcgccgtgttggccgggctggtcttgaactcctgacctcaggtgatccgcctgccttggccttccaaagtgctgggattacaggcatgaaccaccgcacctggccccagtaggtggtttaaaccctttctccttctctctctcccctctgttgtattgcccagtgtctgttgttcccacttttatgaccttatatttttcttctttaaatcagtaattttttatgttgttaaaatcaatttttgcagagattagaatgtatttggcctaatttctcattcttaagtaaaacaaaataaggacataatttatagacttgacatatactgattttttggtatagatcactaaataagtactgaacttttttctttaggacgtttagagtttttgacaggtatatagtcaagccctgctctcttttacttcctttttattctctctgatgatttgtatatgaattcattctttattgatagtatcaacatgacaaaacatacaaggcctttgtcctaatggatcttataaatctaatgcaggaggcagacagtaactaaacaatataattgtatatgcggtaagtgctatgaaggaattaaacaaggtgacacaacagaaagtagttgtgtcgggcaattttagataaaatggcgagtgaatgctgtgcatggaggtgacatcttgccagagacaggagaatgagaaagagtttggcatgtgaagatcggggaaatgagcacatggggcagagggagggaaatgtgaaaaggcatgatggtggggagtgtttgaggggtgagagaaactatcatcagagtaacaggcaacctacagaatgggagaaaatttttgcaatctatccatctgacaaagggctaatacccagaatctacaaggaacataaacaaattcacaagaaaaagcaaccccatcgaaaagtgggcaaaggatatgaacagacacttctcaaaagaagacatttatgtggccaacaaacatatgaaaaaaagctcaccatcactggtaattagagaaatgcaaatcaaaacgacaatgagataccaactcatgccagttagaatggcgatcattaaaatgtcaggaaacaacagatgctggagaggatgtggagaaataggaatgcttttacactgttagtgtgaatgtaaattagttcagacattctggaagacagtgtggtgattcctcaaggatctagaaccggaaataccatttgacccagccatcccattactgggtatttatccaaaggattataaatcattctactataaagacacatgcacacgtatgtttactgcagcactattcacaatagcaaagacttggaaccaacccaaatgcctatcaatgatagactggataaagaaaatgtggcacatatacaccatggaacactaggcagccgtgaaaaaggatgagttcatgtcctttgcagggacatggatgaagctggaaaccatcattgctcagcaaactaacagaggaacagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaaacattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctggggaaactggctagccatatgtagaaagctgaaactggatcccttccttacaccttatacaaaaatcaattcaagatggattaaagatttaaatgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccacaatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatgtacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataataaaaaaaaaaaaaaaaaaaaagaagtatgatgacaaatggtcattttccttaaaataaaatcatatatcactacttactgacttgcacctatatgtacttctgggaaatttagccagcatgtatttccacaatacagggatagtttttgttctgtggactgctaaatgatcacagcctaatgtattgccttctcagtaaacacacgttgacttaaatcagttgggtaaattgtaaactcaattccttactttgactttagtttgcaaattaagaatagtgtacttttcttattttcaggccttatttataattcctaatgctatacactattatgttacagcttgcacttgtattttgacactttctaattattgtcaaattataaatactactaattaatatatccttgattcttcataatattctattaaccagcacttaacacctttttcataaaacacttttcaggatatatatatagttagggcttgttgacactatttcatcttgatttcaatttatgcaatccgaattttcaagtaaaacctcatggaattatcagattcatcactaactttcaaaacttttataacacatctgctgagttttcagacattcattctggaaagaaaaaacatgctggaaagaaaaattttacttactctaatgtgttttattttaaataaaaagtcctataggttatgattttactgtcctctttttttttctgaaaaacattaaggtttctttcccaaagcttattagttaattgtcagtttttatgtaagcccatgaggttagacctatataaggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctcatcagggtttttattataaaataatatcaaagaaaacctgctttttaaaaaaatatcttgatacttgtattttaccaaattcatgggtatagataactttttgatttctcattactttcaagtatcttcttcatgtaaaattttaatcaaatttcagatcccatgcttaacacataaaaattaataaattgatgttgagggactatcacattattttatactgaaaagttgttcaattattctaaagttctatatattaatccaaagccgtctctacttgggggaaaaatgtgtgtgtgtgtgtgtatgtgtgtgtataattttttggatctatctatctatgaggatgactgccttattacaagtttcagtacaatttatatatatggattatatctacatatatattttttggttatatatatttttatatatataaacgcttggccattttgtctatttacctatctacctataaacttcagcattttttgtttgggtaattaatattttgaagttttctctcttgttttccttcttgtttggaatgatctgtttgagactgtgtttttaacaaaagtatatgtaagtttgatatacttaaccttatttttcgctaaacaacaacaagaaagaccccctaattttgaaaagtgtccatcaatatcactgtttggcagtttatcataaagattcaatcagtatacagtaaatctataattgaataaataatgttagaagcaaatatcacaggctaggatcagcttaagaaatctccaaaatgtgagcctacataattgagaccaagtgacatttcatttggtgttaacatatactatgtaaaaatggtattatattttcagtgttttaatggaaattttaacatgctttctgatagtttaatatcttttaacttgtgccaatagattgttttagcaagaaatgagtgataatcttaattttattttcttttacccgattcaaacattcttgccttgatcttagaggctggagaataggcagcatgacctctcatctcttccgttctttcctcagccttagtgaagggtgtcccattcacccatttatccacaccatgagccatactgtggatcatccactcagccaccaactcctgcaggtgctgcctctttccaattttacagccactgccttcattcagaatctaaatatttctgcccttgatttctgaactgcctctgcagttagtcttctgctgccctctcctcattcctttcatctgtcattcctgcttaatactctcctagggctctccatcgtgtccagtataaaatcgtactgaaacttgtaatcaggaagacatcccctttgtaatcagatctccatcaccagtccaacttggtctttgacctcttctcactgacattttatgctcctgtcatgctggactctgcagttgctgggcagtgtacccgcatgctttcctgcaggctatcccatctgactctcttctcctaaacctcaccatatttgcatgggtaacatgtcctcaccttttaagaatttcctgaagctctccctgacatcctgattcctgaacaaccacccctttgtgctcacaaaggtctttgtagttacattatttatcatacagtgtttccactgaaagtttaagtgcctgttccccatcgtggctcctgagtagctatgcagagggcgtaggggaagcaatctggtgaaactgggccaaggagacttgtctctaagctacattggcagagcaatgttttacttagattatatctatttaagatggatttagggaggctcagggagattattggagagaggggaaatatgagagaccctaagcacctcttggcagcactgctgtgtttcctctactgtggagtgagctcctggaaaacagggactctgtctgtcatctgtgtgtttcctgagcaccacatagtgtgtgccagatagattgtatgcctgctacatagtaggctcttaataaataagaagtgaattgaggattctagatgctattcatcttcccatattaaattgctttcaaaatgtaaatcctctgtggcactgaagtctatttaaaatatgctcttctgccaaataaaatgtctcctccaggtgatttgaggaagacatgtgggctcaaataagattaaaccaaaccattgtcatgtacatgtaaatattgcatgagtaactagtcttacattttcttcactaatggggatttattctaaggaacttttttgttcagtattttctgatgaaggaatagtcagaaatatcaaaatccttcttactccattttaggctgccatttttttcctaagagctgttatacattgagcatacctaaattgcctttctgaaatacaggaacacactgtattgtcagtaaaatggtctgtgttgattagtttgtctttggggtgtacttgattcatcagatgatggagatcctgctggcgtttcatgcaacctgctatggtatgtgggctttattggcttcccagcagcgacactgacacaaattgtcagattttatgggcagttttaaacctaatgaaatacatccttgagaagcttccttcaccattttagtagctgtacaatttgaaagaaaaaagtcaatgtacaccacacagggtagttcactattgaaatcatggaggacaatgacaacacgcttattttgctcttgaacatgctgtcattaactgcacaatgggatactgatgctgcctcagaggctggtattaatctttgtgccaaaccttgcagaaactctgtgtgcatttactgacgtaagcattgctctccatctctttgatcttaagattactcctttggggatagaaggtaatataaggctgctgaacttaaaaaaaaaatgctcaaagtgagtgaaggtaagagatgttcattttcttccagtactgaaaattaagagtacagacccacatgctattatacaagagaaagtagtcctatgactgctggataatttacatacattatctaatttatcataaccctgggagagtggaaatattgctattcttattttactagtgagagactaagtgatttgctggtttttgatcccgggtctacatgaatacaaagctacatctttaattagttctctatagggtctcaaagcagtcattttactaaatttttgatctttattaaacatagatgcaaaagtaataataatatttccacaaataaagggatgttaaccaaaattaacgttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttagggaccacaaatacatattgtacccaggatgtagtgtacttactgcagtgtggtctatgatttttcttggcatgcataattcaaagacccagatagaaatgactgattttagcacttctaacaataaaacaaaagctcttctacaagagaatatcttcattcatgttaaacatatcaatatctcaagtaagtatgatgaattttgagatagggatcatgccattggggtctcatctggtggtcatggggaaatggtcctctttcttggatatctttggagagtatactatttgactctttagtcaaactgaggatcagtattttaaaagtctataaaatacttaagccatcttgtagaaataaatagtcttcccacccagaccataatctccgaaataattattaggaattttctttttctttcaaacactttggaattataatttagattctttaaaaactgagttttatgactgttttttcaaaaaagcttcaaaattttggcaaatgttgcatttttttttccaattaggataagtaattcaaaaagtcacaacatgcttcagccaaaaatccattgtgaaaatagaaattagaaatgatctttcaaaaaattaagaaatcattttttgaaaaagtgtggagtcattaattaagtgtttgaccttttgtgccttctcaaatgtccattttcaaaaagacagatgcagttagaaggaaaagactatgaatgtaggttcagggccagaggacaaaaactgttgaaattgccttgatatagattcatagattgcaaatgagcactttttaaaatttaaacccttgaatatggtatctcaggcacagagtgagttctttatatatacaaaatgtgattcttaccgcctaccagctgtcttccgatttcaccagatgaccttccctataagtttgacacgtaactcataaaatgcatggctctggagaacaattatcatgacgggagtatgctttcttgattatatggcaggatcctctttcccacctctgcttttgaaggatattaaaggtgagattaaaaatgctccagttgttctgcttgtctgattgtaacagtgaaggagacaaaattgattctagcttatggctcagtgtttcaatgttattctgcagcacttgtttgccagcagctgttagggattattgcaggtttctttgtcaggaacagtgtggcaacaataataaatcagatttagactggctactgaaggggtttgtttaaaagatttaaaaatctcttcagagtcaaagatgttaattctacctggtgaaccagaatgatcctgcatatatcttgggacagacttatattttctaaatctgggtaatgatcatacatgcactgaaaagaagaccatcttctcccagaaatatacaacactgaaagattctctaccaaacatgcatgaaaagatagcaaaggtacaatatttctttaatttgtttctttcctctttcgtttaggtgaaatagaggatacagctctgatcattagaatttcatatggcaaacgctcacacacatagtggatttgaggaaatcaattttcactaatctagaaaattctctcctcaagagaaaagggatttaaaaactttcatgatgtatttaaattcaacatatcttttgcctactttaaatagggaaaaggtgactctaaggtcataacgtgaaattgactttacccttcctggtatagaatggcatttcacattgagaaaaactagggagaagcactgaagaattaatgggcagtggggagagaaatgtagttcattactttattatttgtcgtggtaacacatactttatacaatctatcactcctacttgtccaaatatgtgtttctcctgaggtaaaatttcaaaaattctagatgatgttttggaggttctgtagagaaggtgaatggtatagagctaaagcaaatcttgtatgatttttttatttaatatgtttacttcctatacctatgtctttactgtgtatacatatacacccatatccctatatattcgcgtgttcacttttgatttcaaattttatttgtgaaaaaagcagatttattcttttttttctttgagatggagtctcgctctgtcaccccctggctggagtgcagtggcttgatcttggctcactgcaacctcagcctcccaggttcaagtaattctcctgcctcagcctcccgagtagctgggactagatttattcttaatcccatttatccatgtggagaatatgtcaccctgctcatttcactttgcaaaccgacttactattctttgtacctctctccttctctttttgctctgtcactaatagagctttcagctactaagacacacaggagtgctttctagagagtaactgaaattaaccacatacatcattttggtggcaaacctcacagccaccagtcatttatagtaccaagtccctgctctttgggtaacagtggataagaaatgctacacaagctccttatgtggagaaaagactgttctcctatttggaagccttgtgcccatatccatgccctttgcacatttatcaaataaccgtgacttgtcctttatgttttttcaagcatttgtatcattaggcaaggctctgcctaatggaagagatttactcttactctgtgcccaggtggctcgtccatctctgggtattttcaagcattggaggtggcaatagtgtgcttagcctcaagactgagcaaagaaatgaactttccagagattactcttaaaatatcccattctgagagcacatgtttctcttagtactgtttactccggactttcagggtcagtaggcaagcttttcaacaaatttggtttcttttaaaaactatttttggtagttttgttaaatgtgtctggtaattcattttaagtggaaaagggatggagataaagggtaggtagaattgtaaatgtcctaagcctcttttatcatcctatgtttttgataagttttatctggtaacagacaaacattgtagaagcaagaaggggtttaatgttgttaaataaagaaaatgtattaaaagagaaaaacgaggcactgggctcttctactcttgtttatattcttcacccttgtgttccttctactcaggactccattgtaaatgctcaggattaatttttttgtcatttgatgcagttctatactgtaccttgtctttctgcaaagcaaagataatattgtagtttaaaacttggctatccaccaccatgagggaatatgcttctcttatttttctgcagaaacatttaaaatttcttcagctatattttgtacttacctgaattttaaaaatagaatatagataatacatttccctatttttgtgactcactcactgttattaatagttatttttctaatttgaatattatgctttgttaagttatttagaaccacttaccccatctgtaaataaccccgaactcctatactgtcatcacctttgtttcttctaacatgttgtaatgtaaaatcaaaattattaagttataattatttatgatataagaagtattctgtggataaagtatacatttattttggatatttagaataatttttgtttgtttttggcataattcctttttcttgactatttacaggaaatagctagttataggttttacctaagtctcattcaagctaatggattatgcaaataaagtttgctcactgaaggacaagaatattctgtatcttttttctggttcttcaaggtgatagttcataaagaatatgttccattgacaaagttagttatgttttttagcttattaaactaatttaaggacaaagaagagaaaataattttcaaacccactgtgcttggccctcactaattatgtttttgcctgtgagatacggattttggaggctgtatttgcaataagtgacacatacacaatttataaatgataaaatataaaatatttgtcttaaatagggagatgctgtaatgtctctttcccctcttcaacgtatcatattacagtgattcctcaatgagcagctgaatttccacctgttcttgacgtattacctatcaccatcaggctatgttatgaaactcacttttagagataaagcaaattgtccaaatgtcaccaattattgaatctaaatgtgggcatacaggttttatttgaagcagtctttcagcttttctatatgattacatttttatttaaaaattttgaataggctgggtgtggtggctcacgcctgtaatcccagcactttgggaggctgaggcgggcggatcacgaggtcaggagatcgagaccatcctggctaccacggtgaaaccccgtctctactaaaaatccaaaaaaaattagcccggcgtggtggcgggcgcctgtagtcccagctactcgggaggctgaggcaggagaatggcgggaacccgggaggcggagcctgcagggagccgagatcgcgccactgcagtccggcctgggcgaaagagagagactccatctcaaaaaaaaaaaaattttttttgaataaatagaataatgtgatagcaaatggctagacagctattaaggtggtcaaggaaaacccactaaaagaaaccagcatagtattttgtatgagcatagaaggtgtgggttagagaaatccaatgtctctattttagaaagaaatgtcatcaaggtggacagggaccagaacatgtagcactttgtaagccacgaaaggcattttcattttattcttgtagattttaagtagagatgcagctttcttctcacatattttagaaatatttatttggttaccatatagagccagttctcatatagagaatttattctctatatgagaatagagaataaatttggtgcaagaaataaatatcgggtgcaagatctaaaataggaagacaggttatgaggctgttggatccccattataatggcagcttggatgagataggtttcatgaaaatgggaaaaagcagacatgtgtgggatgttttaggcagctggaatcaatagtacttattaatggcccagaggtctgggtagtaaaggaaagaggagaaactttagataaggcagttagagaaggaaaatcaaggatagattctagatttttgtcttgagcaactgcatggatggtgatgtcattgaatgtgatggaatagatcgggaggggtgcaagatttttcatggagggaaggccagagaagaaacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgtacacaagtatttgttgagtaccagaaatagcatttagttatttcaagctttagtttttcatcatcctattctccagatttcagcagcatcagaagccatataaacactgccttcggatggcccttagatggccaccaagatcccctagttacattttctgtgtacaaagcagaagaaagatgtccttcattctgtacacagtgtgctacactgtggtttagtttattataaagagcataataaaagaaaaannnnnnnnnnnnnnnnnnnntagacatgtattcaaacctcagctcccccaataattagatatttgaacatggtggaaatagtgaacctatcatctttaaaacaaaggatataaaatctaatagagtggataacatgattataataaagatataaagattataaaatattaaaagttcaatattgtcattagactctaatcaataatgagtatatcacgtattatattttgacatgaagaactatctagccttagagctttgaaatataactaagaaatctattaaaataaattaaatagaatatattccaaagtaactaatgttttcccatattaactcagaataactttgtctgaaattaaactgaatatatatcatttataaatacaagcatagagtttaaattcaggtaatcttatttggatgtacaaaccgtgaatagagacattaaggaaaagtagtcataattaattatatcgaatcttcagagttcacaccattcctcttcctaaaaacacatacaggtttaggctgatcaagatatcaatgtctgctctgagatcatcaaagtaatgcgtccattctaagaagcactagtggcatatatgatcacggtagaagagcaagaaaaggagccctcacttagaaccccataagacaggaaagatacagcatcaacctgtcctctccagtttatctgtgttatggattgtaagagtgttttgaaataatattttacttagtaaagtaatatccacaagcatttcaccatgaaaaacattaaacattttaagtatataatatgaaatataccatctctgatgattatttttattgaccatattcttgccaactctaaggtactctaacactagaattttaaacttgttatatttgttactttggtacgaatgtcaaagaaaggtattacctgtaagtattagagcattcctcattgttcctaaacaaagaatttctttttatgtagtctgcactaggaattggaaatgatgcacataaaatacagctttttaatctgtgagattgtttatgcatcttaggtttgcttagttttgcaaatgcgtgcatttaaaatcaccatttgtattttgaactcttctggcttttaactgtagtggaaatttggattgaagacaatggaaaccgtgaggtacaatatataaacttgcatccaaccgagaaaaaccactactcttatctgcacttcaatcagcaggaggttctttttcagtttgtttagaaaaagtagggcctgtcatctgcatggcatacaatctttacaaagaaattttcttttgccctttgtgttttaactactgagtgctgcagaaacttctgtctaactgcaaaacagtttaaggtatcatctatgacaatgttaaaagtaaaacccaatcaaagtttatattatcatgcataatagaccaagcaccattatctgaataccaaacggggccaaataattctctatgattcagatgagacataaaagtgctttaaaaacaagtatgtggtaaaaatcactttggaaaacctttggcattatctaatgaaattaatatgtgcctactctatgatgttgcaattcaacttgtaagcatatactcaagagaaataggtgcacatgtgtacaaagacatattcaagaatgctcataacagcactattaataatatctaaagctggaaataaccaaatgacatcgctattggcatgaataaatatttcatagtatcataataataggaatactataaagcagtaaaaatgaacaaacaactgttatacccaacagcacgggtgaacccttaaacataatcttaaggaaaagaaattagacataaaagagtatacagtgcctgattccattcatataacattcaaaaatagatgcaattcaactttcatgctagatagaagtcaggatactagttatctttggaaagggtagagatagggaggattcttagtatgggcaatattctctttagatctatatgatggttacataggtttttatatgtaggttattaaaataatatactgataatatgatcatacattgaggtttttatttattacaataagttgagattattcaaaggtacatttgttcatttttctatacatatatacattatatattacatatacatatatataccaatttttaaaatgttctaagagaaagaaaagctcaataaataaaaacaccccatttccttgtcactagagatgaattactattatgttcaaatcgtatatacagcatattttttatatatgtatctaaaatatgctgaataagcaaatcaacaactacatctagacttctgcatcgcaaaccagaactacatttaaatgcattttatctcacacttaaagaattaaaataaaactcttttctgaacaatcttccaatatattgaccataagtaaatgtaatatgagtcaattattttaaccgttttgtaactcaatgtctgttggatttatcttgatttttataaagttcagcaattcaatttccacattttcttttgtttctatttttgtgaggcactatagtttttatgtaataaatgttactgatatggcctcctacttagaaaatgttattcatgagagtatattgattttagcaaaatttacatatttacatatgtacatccacaggtttgcatatgtaaaaatatagattatttacttactattgaaaaagtgtattatggaagataaaaggttttcatctctgtcatacgacaggtgaactttggtaacataaggcctagcaaagttttattgatcttacatatatatatatataaaatggtttttcataatttcatgggatgcatcatccaagagaatgatcacagtgatactaattactgccattgactagccacctgccacatgccagacacatggtgacatggctgatgataacatgtgataggtgtttcccaagagagtccctttaaacaaggtttttttcctgtcttcatattgatgaagtgttttttctaaagccattatttcatttattctatgaaagacaaaattggcattttaaaagtagaacacggtcttttgatacctgtcatctgagatacctaaaggattttttttttaagttagcatcaagggtaaataataacaaatgaagttattttatgttagatcttgtaggtctaaatatatgcacagcaatatttaacatcctgaaatcagaaattttgtttctgatggcatctctttccattatgtgatttgaaacattttagggatattttcctgtctactttgcatggaaaaaactacagactttgtcaaatctagttgccttggaagaagaatgaataagaggagatgtgttaaacaatacaaaatatttttgctatttcaagtttgaattgattttgaaataatagtttcaggctaaataataaactgtctttttaggaaacaaaagaagtattttagaaaaagacattaaaaagactttattaaaatagaggacatgatgatcttgtttgttgctttaagcagtttatgtagtaactttaaggtggtagaaagtgtcaggaaatcaatttgaaggcaaatcttcacatatgaaaagaatcagaaatgttaactcaggtcttaaataaaaaggaagaattaatatgatatattaaaagtgatacgaaagtcaaaggaaagattgatgagacttattaatatgaaatgaggtttcttcaataaatatgtaagtacaaaaaagttaaattgtattaagaaacttgagatttaaaaaaaaaaaaaagcgaagtatttaaactacccctcttgagctcccagccacattcctcttagttgtctaataataacacttcttggctatttcactggatatttctaaatgatagggtcctattcatatatctcaacttgtcaatttttaatatcatcaattgacattccttttttagaaatcatgacttagctacttatactccatcttcagtgcttatccttctaatgtaatactatcataattttatttaaatactatatgtcttttatgacgtaaatattgtctaatactaaaacatctactattccatgtttctgtgttttatcttaagaggttaattttatttgtttatttttcctgggtctttagcttttcttgtattcttgtcctatttgccattattatattattttcccactaacatttcaaaatattagttattctaaatagtctgacttttctttagagttcttcactcaaagtcctctatgttctgcctgaattaggattgattattccctatgcccactgtactgtttttctacattggatctaccttgtcagggatccacaccttcctctttcttggtttactttctcattttgctggagcacatcctcaaatggcttcttaagaaatattacatgggcagtgaattttctgagtccttccagtttaactcattgcaatatacaaaatggcaggcccattcaatttatatacttattccttcaagttttggtaatttatctgcattattattaaataatatattaatatattacttaaaatataaattaaaacataaattccttctaatttctccagtctacttttttgaaactcccatgagtcaaatttttaccttgttgtattggtgattgatattatcatttctctcatattttcagtatttttttgtttctcttttgtgggtgatgccttcaacttttttgtccaagagtcatattaaaactttattttaaaagatttgtatttttccctttttaatattattctatttttcttcttgaatctcttcaaaaatattaattagcagtttgcttttaaaaatattatcagttttttaaataagcatttgtcctccagattttttcccctgtttaatgttgattcttcttttccatgagggactatttacgcaacaatctacataatctttattccctactaacatttaactgtgatatcctaaaatggcctgattgaggaactgattgagatgattaagagctctgtagcagggcgcagtggctcacgcctgtaatcctagcacttctgtgaggctgaggcaggcagatcacctgaggtcaggagttcgagaccagcctggccaacatggcgaaacccggtctctactaaaagtaccaaaacagccannnnnnnnnnnnnnnnnnnnaccaaaatcagcccaggtgtggtggcaggcacctgtaatcccagctactcagggaggctgaggcaggagaattgctaaaaacttgggaggcaagagttgcagtgagctgagatcgcaccactgcactccagcctgggcgacaagagcaagactccatctcaaaaagaaaaaaaaagaaaaaaaaaaaaaaagaagtctgtgtatagggcaggacgaaaggtgatttggtagaaagctagctgttttgccaggcagcattaaatgtaagaatgtgcagattttttcctctgggatcctgtcatttctccagaatggtaatctccatacttattcctggaggagaggtggttacaagtattctggggccacaactattcttggccttttgtctacccctgaagtttccatcactggaataaactggacagttagacagattaacatgagaaaaggcatacacattcattacacgcacatgtacctggaaggcaacaaagtatgagacttaaagaggggccagatggttgaaatttagatagcatctggagatacggaaggaaggaaataaggacttaaagtctcttagtaggtggtggcaacaagctgtgggagtgtgaggagaggaactgcatggcaagcaaaggttgtcatatcatgaagataaagtctctaaggtagcaatcctcagaagaacacgtgaaaaggtgtcccaggcgtggtgtcccgggagtttcctctcctgagataggatttaatcttctctagttcatgtagattccagggaaggggttcatgacaattacattccttctggaggaacttcccttagataagggggaacttcagagaaagcctctccctgtgcttgaggagaggcagaggggcgagagatgggagtggaaggcaagtcagagagaacttggttctaaggcggcttctttagtccaaagtgctcagctcctcaaagcgccatactttggagtactattttctgagccctaacagccacaaatggaagaagtattcccctgtacagaaaagtttgcattacttttgtcagattatgtctcttaatataatcacattttatgaataagttttatttcacttaacagatttatttattttttaaaaccacaactttaattcccaagtaactcttagaagtttctcctttttggattttcattttgatgtttagtaggcttaaattccagtgtttaacacaacccccagcttttgagtcacagtttatttcattatagtagacccctgattgccaaattacaatatcttatgaaccgggcaaaatgttgacttatttaggacattatgttacctatttattccaaaatatttcatttgaaaatcagctacattcccatgtagacttttctttatacaaaaattaaaataattacagaaaggtaaattattctgatgctaaaattagcctttcattgatttcaagtagattgtaattggctaggatcaaatacatgctttatgtaatacagtttatttcttaaactgatacagaaagtgcacataattctggaagtaaaaatgttcaaaagctaagaagctctcatgttatttttcttcaatttgctacaaacatatatagagtgtagttattttctagccataagaattagcagaagctttggagagaaaaggtaggagactgaatgccctgagcatccctttgaatagctcaggcaagaagaggtgctattatcccaggaggagactgtaagtgacgtttgtgtaattcaagtatgtcctgcctggataaggacttgtgggtaaggaaacagagtagtaaatagccaaagggaagaaagtcagaaaagcttgctgtgttcctccacttaaatatatgttatttctttagggactgcaggttttacaaagagatgaagactaattcggaatgctacttacctctgtttccaaaagaaaaagactcctccagaatgtggttttaagtaggccatggaccaaaagtaggccacaaggcatggcaggcagctttatgaacttcaaggttctaggaaatttcatccattggagagttctccagtgctttaaacaatattagaaagaaaacagcggtacaaatcaaccatgctagtaaaaatctctcctgcaagacattactgagtggtgaagactaagtggttttgccattgttgttgtattgttggttggatggtttgccttggatatttgcttgcttcttttttgttgatttttagcatataaataaaatttataagcccaacaaaagaaaagaaagcaatctttcaagaggctttaagataacatcatacattttcgaggtttttaaggctgagattctattttgttttacttaaaaggaatgttacaatgctgttaacgtttttgcttattctacatttttgcttattcatgaaactcgggagaaattctgtctattggcaggctctcattgtgtattcatcaccacactaaccactcatttactccgaaattaagtgctcagtgatatgcatgttataaattcattctcagttgcaaaattttcttggtgcttaagaaattgtactttaatcgcttttagccaaaaagtttagcaaaaatagtactttgacatagtactgacagcctgtgcttagattttgataaatgtggacaaaatcaatagatagatgcataaggagtgcccagataaaatcatcatacttcaaaatctttttctaacataactcacagctgtagacttttcctttcaataataagcaaaaacaattttcatagctacaaaccgccgacacaactttctattcaaagaggacttctttgcaggaggcagaataataactcaacaaaataaatagaatctctaatttcaaaatannnnnnnnnnnnnnnnnnnnatgggaattttaaaaattatttagtgtctccagtttagatatttaagaacaccactcacatctacatgccaaataaattgactccaccctccacccgttatatcagggccccactccatccattgtcttttttcttagttatatcttgatatgtcaccctattagttttttccttgcagcatttcacttgcttcttgccttttttaaacaaaaatttatgcactaccctccctgcatccatgttcctgctgcctcatattcattcattcttcagctggtggcaatcagcattcagtttctctccataaaactgttattaaatccaataagcctttcatttctgaatcaagtgaagatttttctctatctttgctgaattctttatggcatttaacatgtcttttcactccatctttctttggggactctcttccatgacttctaagacaacactttttaattctcttccaccattttaggtttgtctttgtaggtaacctttatagattcttctgtgtaatccttacataccaatgttctgaattccattctgctcctctttttccattccatagagtctgattgtgtacttgcaaacacttccatggtatctatttcaagtgtattttgaaaagtctaacatctaggctttcaacttgatctgttgtactttctatattctatacctgagtgtcagcaaagacgcctgggagctgtctttgagtcttccttctctcttacctccatatttaatggattaccattctcattgattttaccttcttaatttctcttaaattgattttctttctctatacctaatgttagtacctttctgccatgtttctatctggtttacattgctggaacagcacctgatttgctatcttgttcttagtcttgccatcccaacttagtccattcctctgatgtcttttcctttatacagttatcataccatttatcaatttgcattatatatctgattttatttacttataagtcatgttctttgttagctcattaggtaccaattttatatcaatattatttttctgtttgtcattcagtccatttttgttgttgttgttttgttttggttttagagacgaggcaggtgaataggtatagactgaatgctcctaagctagatgataatgaccaaatgattactgagacagggatgagcgatggtcagtgaaattgaaaggatattttagcagctgctttaacaagtatctgggaaaagtccggtctcttccttgcatttctgaacgttaatttgtattaaaagcagcatgactcagaaattttatataaaactcaaataaaccttagaattggatcttatcgagtattgtgttatacagagaatatggagaatatgtgggataaatgagtcaaatggtatgttaaaaaaaaaagtaggaagcatgatagactcaattcttaattcctagaggaaacagagttatgtccaaggaacatattcaacccaatcactgtacagctgtagctttttcttttctttcttttttttttttttttttgagacagtctcagtccattgcccaggctggtgtgcaatggcatgatctcagctcactgcaacctctgcctcccaggttaaaacaattctcctgcctcagcctcccaagtagctgggattacaggcacctgccaccatgccagctaatttttattttatttttttgtatttttagtagagacgggacttcaccatgttggccagcctggtctcaaacccctgacctcaggtgatcctcccaccttggcctcccaaagtgctgggattacaggcatgagccaccgtgcctggccaatttttctaaataaattaatatgatgatgataatggtatatccaaatagctacccagtttttgattaggcagaagtatgcttatggtcagtcagagtaaaaagtgagaccagcatggtggcatgcacatgtaatcccagctacttgggaggcggagacaggaggaccctttgagcttaggagtctgaggttatagcacactatgcttatgcctatgaatagccactgcactccagcctgggcagtgtagcaagaccctatctctgaaaaaagaatcaaaggccttaaaaaatattttatttttacctcagaaaatttaaaaattaacttagagctaaatagtttgggtttcattatgtgtagaaatgaatcttgcaacagtaacagtttcccattacacattataagtgtctgttttgagtaaatttgttgaggagtctaatttagtttgaatccactgggaaaagacacaattgaggttttataaaatgtaaaaaatcaaatgaactactgtactttcacttttttacataaagtacatcttccacttctagttacaaaaaattttttttttctcacttgagtcgtttatctgtagtaagtaaatttgggaaaagtgcaagtattcatatacattgttttgcatttaaaagaaaagtgataatgttcaaacccatgctatttacaaaaatcaaaagctcaaatcatgaattctgtttgtgttaaggatttaaaaaaatagtggcgtgagaatggttattgctcttcaataaagatagagataccacgttttgctttaacatatctagaggcacctttttcatcgatagctttattagtaggtcaaggagaaatcatacctaagtagaaaggtccgtggagaaaagagacaaaccatatcagagttaaaattaaattgaaaaaatttaaatcaaggaaaccattttcacttctttcgatatgatgtgcaaaatcatgcattttaaatgggaaatgggaaatttcatagcttcttagcaatgatgtgagctctgtggtttgggtggatgcagggcatgtgggtgcttttgctcatttaaggaaattgcatttgaaacattctcaatacattatgtagccacaagaaaatttatagtgatttctttttggtggaacaaagtatatgctcttttccagctcaggatccttttccagtcttcctacacttaacagccagtacaaacttagtccatagaacgtatttgttgtgcacagacctgcacaaacacacacacatgcaaggttgcacgaatcaggtatgtattttgtgtatgtgtcaaacttagccatcaactggaatttgtgttttagtttggatgctgatttacctcatcagtaaaatgcccttcacttactctccctagacatagactattttccgtaaaatatgttagtgatttcatatttaatgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggggaggtgggaagtgagatgctgtgttccagagtgagataaggaaataatttgaccagagcatgggattttaattgagaatattaagagataaaattataataaatgtagggaaggtgtatcagagtgagattatggtatactatacttgaaatatctaaatgaagtatttatgtttactctaaaagtcaagtgagagagattctggagtgagacaagaatgtgaggaatggggacttctgtggagtttaatctatagtaatgcacatgaatctgataaattattataatctttgcttttagtagaaatggggatttagagtacatcagtacaggtggcgaaaaatgtgaatttaaaacatattttgaaaaacaaggataagaattagtgtttaaaagctaaaagagaagaatttgtgtcagctgcaaaataaagtaaatacacatacacatacactacatacatgctcataatttaaattatgaactattttatcacactctgctgtgtaagtttttctaactcatattgtatatcagccatgttgtattcttgcattaattaatgtattcattaaatatgtcttcagtactttttttgggtccagcattacattaggcagatatattattcagcaagttttcaacttagttcagggaaagagggatgataaatattattatgagtgtttagaaatattaagaacccgaatccatttatcagtttcataacaatgattttcaagcttgtttcatttctcacagggtagacaaagacaaaatatatatctcataaaagtaataatctaccagtcatgtttgttgtagccaagcaaatatatagaattctaaaaatattgtttatagctcttgtttcaacatgcttgggacaagttaatgtttacagttttgtgagtgaatgaatctatatactgaaaacatttcattcaataagttgaccttcttgaggtttgaataaattttggagcctgagggaatcaatatggtttttaagttgatctcctaggtatgtctaagtttaagttcttaatataattatcaaccctttattattttaatatttcattacattaattatcttttggaatattttcactgatcagtaacttctagtcataagccgttctggtaccaatcatcaaatttcatatttgtaagaaaaaatgactagcctttggctgtcttgacatgcccaaatccaccaagtatatatctcacttccaaaatagtctcaggatatgttttctagatatgatcttagatgatggagtgtattgttaaattaacaagtagtataaaaatagacaaaatattattaaaaatacaaggagaaaggaatatgttagaaacaagtaagaagttccatatggaaaactgataagcaattttttagaagcaaaaatctcatgacgctaaaacaagatgatgaagaaattactctgtgtgcaagtgtggagaaaaatagcttgtgataccatagtgatcttagagctcattatacatcagcaatgaagagctttaacaaccatgcaattaaaatactagagagtataaataagattgtaccatgtgtatgtggcagcatataaaaactcagaagtggaaggaattttagtcaagtgttactcttgaaaaagcaaacggattaggaatatttaattggagaacaacatagacaccttctgtaatattattcaagtaagaatgtctcattttggacatcttacttatagtcagattgattctcaaaacactttttaaatgtctagaaatatttacaatggtatttatcctgagaaatgctaaaaaaaattagaaaatgtaaaggtgactgaagttaggaaataacataaaattggtaatgatgagcaattttcttaatggctgttcataactggaaaaaaacagatatgctccgaaatatatgaattgtgagataaactgcagtaaaagaccccaagaaattgagggaaactatggaaatgattgtagcaagtggtagcaagctatttttgtttgcattttgaaagcagtttttagaaatttctaattttgaaaatcttaaattgatttttaggaattctggggctacttttttctcagacctctagggcaaccaattgtagagacttcccccttctgttaattgactcagatctgcttacatattaaaggccacctctggttctcagctggaaaaaagagttcctcccttttgaaacagttgactcagaatcagttccttcctttcagatccttatctttaattactttgtcttctaacctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtagaaatacatctcaaaaattatgcagaagttctatcatataatgttcttgcatgggtctgaagctctttgaaggcaagggtccttgactgtgttgttcattgttgtgtaattactgcctagatgagtacttggaaaggtggagtgattcaatgaatatgtgttgcatatagtttaagaagaactgggactggaattagaaacacatgttccgtctttagcaaatcacccatcattactaatcttccattattttatctatgatattgagcaagtaatgcctatcccatctatattatagctttgttggaagactcaagggataaagtgaaaatgctttgtagagttcagtgctacacatttattatggtccaatgaactgcattacccaaaccaacattaattgtacataacatgtgacaaagaaaggcttatggttttggagtttgtttattttagaagaccagataaactagaacaaatattttccatgaagaagttttttttcgtgttagaactcatgtgattaaattgattcacaaaatttgaggtcatttattaattttatgaatattttactgagcacctatatgatgtcagtgactctaattgtctctgaaaataaaaagattaataaatcatggcttctgccttcaaggaacttagagtttagtggttatagaatgttggtttaaaaaaaatggcaaaaataaaattctgacaaaaactcataatatctgagagtttatatgtgcttgctaaatgaaaagaattattagcaatactatgctgaatgactgtaaaatgctgactttttacttgaaatatttacaagaggaaacagaatatttgtgggtttccctgcatatttatgtgtgtgttcaaacagctgctagagaacaaagtgttttgctataaacactgtcaaatctcactgtgaaaaaaatttgtctataaaacaagtattttcatagatacactaaagctgcatagaatttgcttttatagcataaaacagaattagatgcttgagtcagctatgaaatactttttcatgcaacactcattctaattctttacactatgcattaggctgaggcctggtgtaatttgaaagtgataatgcaatagagaaattccagaagctgggggtggggggaatagactggatattgcaaaatgcatcagttagtcaatcaaactcctaatttatcaaccaaaccaacctaatcccatagagaattcaaagtgactcacgaaaagacacacaaaagaagaaatgttttgtttattttccaagatggaaaatgtaaactatccagaggacagtggtatgggtttagaaagacaattcacacaataaattttaaggaaataatggttttagtctttgatgctaacattatttctgggcttccaagtcactaaaacaatacatacatctttttaaaatgttatttttgttgtgttgtttggttttgtgttttagtctttttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgccttatcctcccgagtagctgggattacaggcatacactaccatgcctggccaatttttgtatttttagtagagacagggtttggccatgttggccaggctggtcttgaactcctactcaggtgatcctcctgcctcggcctcccaaagtgctgggattacaggcatgagccaccaggcccatcctctgatatgaatttcttattggagaatccctttatgtgtccagccctgtggtaggctctgagaatatagtaatgaacaaggtaaacaaaacatacatagtctctcccatcatgaagcttacgttccagcaaggaagctagaccttcaatagataattatcatttaaaattataccttgtaatcagtgctatgcaagaaaaataaggcagaattaggggctgtaatgaaggacctgtttacaaagcattaggaaagccctcatggaggaaataagacaaggaagaaacacttgtgaacaataggaaggtatgtgaagtgaaggagcgttaaggaacagagatttctagacaagccctaagcaaggaaaaagcagagctttattctagaatcggactaaaggcagtattctttgaatgtgatcagaggacattgtaagccaggataatcattttgaattttaacctaggtacaattatgatctatttttaagaagactgacttgatcagatttgaatcttaagaaaactcattatgtaaaaaaagggctaaagaaaggataagggtagtcagcaggccattcaggaggctattgcagatgtccagatgttacaaatgcttgtgacttggccccaagtattggcaatgaccctggagagaagcagatggatctgatatttatttcggagttagcataatatgaaatgatgcaatggcatcaataacgactcccggttttctctatgagacactgggtgggtaaactaagatgtgttgagcttgagagaattcaggagtagctaaatctgggtgtcccttcgggtggggattagaacgctgaaaaccacgaactctactttggagagtaatattaaatttgtgatgttcctgagacgtctaaaaaaatggagatttaaccaggcatttggatatatagctctatactttcagaaagatacctggtctggagatataacttgggagttattgactctacagatggtgtgtaaatgggttggaagtgggtaagatttggggaagagaagaatgaaataagaaaatgatccaggattaagccctgaggaacgataatagttactgataaaaaaaaaaaaagaaaagaatgaagtaaatgaatgtgacttttctgtttcattttgtctaagtcttttaagccagagaaaacataatgtgaaacagtgtttttatgtgtgttttatcactagagataagaaattgtcaagctgtccttaaggaccagggagggcccatggggaacagcatctttcctgatgctgttgtattcatcaaagcatagatgagtctcttctgatatttttgtttgaggaacatgaatataagctcatgctcctagcatagcaattagtttagagatttatcattgttttatttttattttttgaattattaactgcagacaaagccctaaattttttttgttttctatatcacaagtacctttttttggtttaaggttctaaatttcattttccgtgacttgaaactgttttgcacttcctctccttgctttatattttgagtttacacactaacctgccaaagagacatctagtttataggcttgattttggaagaaagacagaagagagcagatactgaacatatgttccgctgatattgatgaagtgaggttggaagaagcttggaagcagtctatttctctccaactgccaccccctctatgaatattttgggtacccttatgctggaacattccaaataagtgccccagctatgggttttttttttttttctcataatgattctgaaagcctttgggatgatttaggattgttctacaagtggaacataaaccaaaacaaagcagttcgtggactctaattttaaatgggtgatggatgagatttcaatgcaaattgtaaagactgaaaatgatgtgaccagagaagggacccctagatagtaagtactcaataaatgacagaagcagagtatagtatgaacctgtttcttgggaaaatagacttgaagttagacaagaatctatttaatcaaactctagatatgatgttttgctaacttttgttttttgttgctttggttttttggagtttttttgcacttcaagaagtctttttgatctgaggtagggtagtcaactctaatttattaagcatgaagtgattggttacaggtattttaacaagtatttggaggagtttggggaagttgaagtacgaacacattatttgaagtcactgttacagaggtgcactattttgtccttcctgatgtagccattagtgttcctacaagaaatctggattatcatgacagtttttttttcttttttcctttttctttttttaattttagatttaggggatacatgtgtgggtttgtgacatgggtatattgtgtaatggtgaggtttgggcttctactgaacccatcacccaaatggtgaacattgtattcagtcagtaatttttcagtcctcattcctctcccagcctcttcccttttgtattcctgggtgtctattatttccatctttgtttccatgtgtatccattgtttagctcccacttagaagtgaaaatgtcatattcaattttctgcttctgagttatttcacttaggataatggcctccagctccatccatgttgctgcaaaggacatgatttcattattttttatggctgcacagtattccatggtgttcatataccacaccacattttctttgtccaaccaacacatagattgttgagcacatagattgagtccatgactttgctattgtgaatagtgctgcaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttaaaaattaattcaacagagaaacatgtactactttttctgattaaaaaaaaaaagaagaagaagaaaagagcccacagcagctcaggaagcctccaaaaatactcttttattttagaagctgaaaagggcagatctaactaatggtacaagacaaattgaaagtcctataaacaggaatagaatacttactctctttggttttgtttgcttctgaacaactggattcaaccttctttctttccccccagctcttaggcattgttgtgtcaggacagctatggttcaaattgggctgattttccagttctattaaacccttcatctgcatcgtggatcaaatacattaactagctgtctgcagtgcacagctggaaatcattctcttccacattttgctttgtgccatttttgttttataccaatatgctctgacacacccacatagctcaggatttcagcagtcaattatctccttttcttccttgataggtcttagaacattttaaattggtgtattctcttttgtcttttaaatattgaatcacttgcaaacatctctgcttgcatgaatatttttcaaaatgctccatagacctagaagctgaaatggaaagttagaatcattcaaacacaaattttgattttattcctttgagagatggtaggtgattggcatgaaatagcaggataaatattgtctaccaaaagtaagatgagagagagaggaagacagagagacagagacagaaaggataaggatcagccatgtattattgtaaacagtatatgatatcttagagattattttaaaatgaatatattgaagtgaattgttgcattgactgaatggcttttccatagaaagactccagctatcatcagttatcaattacattattggtggtctttacaaacttgactataaatgttgagacatttttcgagaaatacatacacatgtgtgtgtatgtgtgtgtataagtatctattggtatctccgcatgttagttaaaaatataataatatgccaagtacggacaatgaagacagctactccacaatattcatttaatttaatttttttttttttttttgagacggagtctcgctctgtcgcccaggctggatggagtgcagtggcgcgatctctgctcactgcaaagctccgcctcccaggttcacgccattctcccgcctcagcctcccgagtagctgcaactacaggtgcttgccaccacacctggctaattttttgtatttttagtagagacagggtttcaccgtgttagccaggatggtcttgatctcctgacctcgtgatctgcccaccttggcctcccaaagtgtagtttaatatttaagctgataaaacaagaaaatatatttaaaaaatttttgctagactacattagaaagattttctttaaagatgtgagctagatagaggtcattttaaaatgatgatttatcaaattttacacagttaaagatagtgaaaataaagagcacattaaaaaataactagatggaaattttcactgtgaaacagaatttctgaagtgacactgtgttcacttctgatcatggtcattgtacaaccattgagtctttgtataattgctgtgagtagtgtcactaccattttcccttcactttttttctatagatatttaaatgaagcaactgtatacatatttattcattttgtcagttataatcaagttattctatcctaatctttctatcttcactctgtgtgtgagtctgtgtgtacataacatgtgatatttatatccatcttccttcttgatcatgagcaacaggaaccaccaatactattttacttaagctgaaatacatttgaaatataccatataacttgcagagttgatgggaaaatttgaaaaccagggtgagaagatggcaggcatcaaggtcatccctaggttttgatacctgtacagaatagtcattgcttactgctgccgccatcactactttctctttcattcctctgatatgactatctctactcctatcattatctgattttccttatctctctagtctgtgcttcacatgcttaatattcaaattcctaggccaaagtcacatgtacatgccctaactgctatagggtagggagaagaaaggtctcctctatttacatttccttggcaggaggtaggacactgcataccctcaatagtagacacaatgccaattactcaagaaaagaaatggaggatgaatgttggacagccaagaaatgatgaaggtctgccacatttttcatataggttggctttttctttgaatgttttcacttagctagtgtaccaaaacagttctacatttccaccaaattaaaggtctgattagtttaatgtccttcatttgccatatttttctcaagaaagattatacagtgcatgaactcattcttattcagtaaatttaaatttgagtggcattatattccaactagtgctatccatgccctcagtaattttatagacttgagagccaccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaacatgcaacaaaaagggagaacattctttgttgaagggacaagataatgtcatcacaaagcattttcaaaatgcctgctatatttgtaaataggaagagatcagttcactagatgtataagaaggcatgaaggaggatagcaacagttgagttcagacaggtagaaagcaggcctgattataaatgtttagatcaccaaggagtttgtctacgacactacaggtgacaggcaactcacaaaagtctttaaaaaagaaagtgagttttagggaagataatttcaacaacaatggggaagattaatgggagtagagtcacgcaggaagactaggaagggcagtggtgctcaacctgtttggcaccagggaccagttttgtggaagacaatttttccattgacagggataggggtggatggtttcaggatgaaactgttccacctcagatcatcagccattagattcttataagtagctcacaacctagatccctcgcatgcacagttcacaatatggttcacattcctgtgagagtctaatgctgttgcttatctgacaggaggcagagctcaggtggtaatgcttgtttgccagccactcacttcctgctgtgcagccctgttcctaacaggccacaggctggtactggtctgcagccctggggttggggaccccgggttaggatgctactgtaataaatgtaaagtaaggttaggatatctgaatataaatgttgatgtgtttgtgtggcggggagcggtgtgtgtagctgaatttgaggtagagacaaaaagtaattaaactggaagcagaaatcttagaatggggaaaagtaaggcatatttgttcacaaagtatcttttaacattttctggtttctgtggagtcacattttattaatgctggttgacatttatctacctagaaaaaaatgacagaaatttcaggaacaaaggtgactatgaattaggtaccaatatttttgtggatgatcttcatgaagtcagccaataatggagatgagtatgtggaaaggatggattatttggactttttgaaaagaagttattgggtgaacatgatggctcatgcctgtaatctcaacagtttgggaggttgaggtgggaggatcacttgaggccaggagtttgagataaacttgggcaacagagcaagatccatctttacaataattaaaaaaaaaatagaaattagctgtatgtgatggcttgcacctgtagttctagctactcaggatgctcaggcaagaggatcacttgagcctaggaggcagaggcttcagtgtgccatgatcatgccactgcactccagcctgggcaacaagagtgagaccctgtcttaaaaaaattaaacaaattaaaaagaaatgaagttattgagtgacagttaaagaaactgatttgcaagtggccttcaggaggcagaagaaggctacttgtctttccccagtgattttatgaatccattgaggagatctgcagaagtgttgtcactgctggagaaaaccaaggcttcacttgcaaaaaggagtactttcttaaaactgagaaatttggaaatatatcataggacttgtaaagctatgatggaagttagcccatgagtgtgtttacagaaggcagagctagatggcataagactcagggatgatgcaggaggtgataaatatttttgtttagagtagtgagaagagtgaaacacagtagatctttaataataaaattttcactcatttggaattatgaaaattgtgtttgaaaaccagctgtgccatttaaattctgggtatatgtttcttcatttgtaaaattcaagtttgaactaggcttctttgaactaaattcttcttgccaccagacaacaaccttcttcttcatcacctagaggaacattgcctgaagcctaaggaagcagccttccctgtgccacacagaagaccccttaattgttcaatgaatttctcattgacttgtgtagtgcttcaaaagaaaacacttacacatcaaacatgattctaagtcaaagttcttcatttatatgagattaaagaactggaaaactgtacaagagaaatagtcacctgctgattgcaggcctgtgggtttcttggaaaaactcagcaattttgcttatccaggactatctttttgcccagttcctctgattctgaaggaagttgaaaagatagttttcctttgctgtatccaacatccttttctacatttgatttaagaaatgtcaatttaactttttattgatactgatattgaaaatacataaaatccaaagaatgagataaatcttacatatgtgtcatatttctatagatttttttgaccaacattttattttgaaaattttcatgcacttggtaaggttgaaagaatcatacagtgaacactatgtactcgaaatctagattctaaaattaggccaagcatagtggctgatgcctgtaatcccagggatttgggaggctgaggtgggagcattgcctgagggcaggattttaagaccagcatgggcaacatagtgagaccatgtctctaccaaaaaaaagtaaggccagcacggtgctgcatgcctgtagttacagctactcaggaagctgaggcaggaggattgcttgagcccaggagttcaaggttacagtgaagtattataatcatgctattgcactccaacctgggcaacagaatgagaccctgtctcaaaaaaaaaaaaaaatagttaatgccaggcgtggtgactcatgcctgtaatcctaacactttcagaggctgaggcaggtggatcagttgaggtcaggagttcaaaaccagcctggctgatatggcaaaaccccgtctctactaaaaatacaaaaattagctgggcgtggtggcaggctcctgtaatcccagctactcgggaggctgaggcaggagaatcacttgaacctgagaggcggaggttgcagtgagttgggatcatactactgcactccatcctgggcaacagagcgagactccatgtcaataatagtaataataataatgataaattaatttaacatgtttgagtagggaggagatatgtgctttatcacatatctatccatctgaacatatctacccataaatccattttatcttttaatatactgcaaacctcattcctatacacatgatcatgaatatcattaactggagttaaatactgctaatttttttcaagctcaaatttatctacattgaaatgcataaattatcaccccgtgtaacattcactcactgaatgtaatatttaattaacaaatacatacaccattataatacaaactgctatcaagaatattatcatcatcccagaaattttctttatgcctcttcccagtcagtctctgcccccaagctcccaaaggcaaccatttttcctgttttattttcctaaaagattaggtatgtttaaaaagatcatataaatgaataatagagtatccactctttggtgtaaacttatattatgtggcataatcctttttggagtcatcagcattgttgtgtgtatcagtaatttgttccatttttatgttgaatagtatttcattgtttaaatacaccacagtttttgtatcatttcccccattcatggaaacctaaggtgtttccaggtttggctattatgataaaaacttctatgaacatttttgtttaggtctttttaaggacatgtaatgtcatttatcttggatatgtacctaacaggggaaaatttgaaggacttttatatttattaaaaactacctgttttctaaaagggttgtgctaatttacattcccaacagcaatgcagcagacttttgattgttttacaaactttttaatatttgatgttgtcaatctttttaatataatgccatttaatctaaaacatgagaactttgtcaatatataggtccagttactgtgatctctcacccaccatttctttattatagttgtcatatatattctatttacaaacatatgcaatgatgtgattttttgccttaaatattaatatgcatttaaaagaatttaacagggaaaaagtctattgacatcaaatgtacttatactgtcttttatcatctccaattttctattaatcacatgtagtggatttttttttcattctagatactgtgttacatttttcagtcacagaatttatattcaatattttttgttgttaccatttcttttttgctacaagaattttcgtatgtgtgtatgtccttgagtatagtttaaaagctgcttgaagatgcttgtttgcttattccaacatctggttgatctcagtacaatctccgttgattgctttttctcataagtatgagttactttttattgcttccttgtatgtctagtatttttttttaattgcaacctggatgtcatgaataatagcacattgtagaaactctgggttttgttatgttcctctgaagagcactcacccattcttttttgttgtcgcatcagttggttaacttgactgggctcaaagtcccaacttttttctttcctgtagagtgcagaacctaaaatctctgttcagtttttcagccctagctgggctacttggaatctgactagggcaggtgtaggtctggcatcagtgagcaatttggacagagtttatgcacagattgaggctccctttctgtggacctctctttacacctgctgtggctatttttagttttgttcactagttcttcaagccagtaaaactgtgggtttctatttgagttttagccattctggagctcatccagtgccttttccttctaagtattcatagtcttcctggcttacctgttcttaggtgcactccagatatctggtgtttgctgtgtgtatatatatatatatacacacacatatacatacacacaccaaatatatacacagaatttatagctgttatctctgggagctttgctccaataaaagctacttcacaattattaaaaatagaacctccataagtagattttaaaatgtttctgccatttgaaaccaaaaagtgggattttgagaatgtagatcatcaaaatcatgccaacatgtgtgaacatactacattatttgagaaagcaaatatggtataaacacatccaaataaaaacagtggaagttaggtgatttttttcaaatgtttgccatattgtagcagaatttcagtttttcaaattttcacatgatatacacttagcctttttctagatatcctattaccatatatatatatatacactatagaacagaatatattattctatatataatatgaatattctaatctctaataaaatacatagtataaacagaatattgtttgatttttgttcagacattgttccttataaccagaactccaactaaacttatttagtctagtgctattcagaaaaaaaatgtcaatcatagttgtatggataatgatcactggcttttatgtcattaacattacaggaccttaagttgagttaagaagatgtaagtcaatactctctaaaggttcatcagctatttatagttaatttacactcctaatgtttacataatcttaaccaagtaacacatattgaatatggaaataaatattgccctggtgcttttgaatgggaataagtaggcacagcataatagatttaacatataatgaaaatgggttgcaatctataataagacatgctgaagattcaataaaagctcagatattgattcattcttcaaattggtcattcattagcaactaattggagacctttgctgaccaatatgcttaaccgatttttaaaaataaacagcaaaatagcaatgaaatttcataaagcaactattccctgaccataaaacaaggcaattaaattgtgcaaaggttaattttgagcacataatcagtaactgtaatagaaacaaatcaaagaaaagaattgaaagatcctaaatgtaaattttattagtgtctttagttttatggttagaaaactctatgaagcaacaatggcatggtgagggataagttatttgttttattaaagatttaaataagctttaccaaggaccagattttggttctactttaggccctgacaagaagtcttgtaagctttttaaagagctcacttcaaatcatagttatcaatcttactaattcataactttgtacatatcatttatcttctctgagctgcacttccttcatttttataaagtggaaagaattaataaaatttatacaatgggttatatgggaattaaataatatgaagaatatagaatagcttcagaatcaatgtttcttgtactctgtaatccctttgtagctgtatgcttttgctctctttatttatttaattatgtgggataattggtacataatccaattctatattttctgaacatacaacataaagaaaatactttatccctggtctcttttcttggcttcctcccatgattgctgaggcctgggaaagtacaggcctggcctgctccaatcaggtctttcagggcagaccaaagcagggcacagggagtcttacccatacctgcaaaacaggaatgaggccatggtcagggtcagaactagtcagtgctgagggaggaggcaaaaatccgagagaaaaagtgacaatgccctggtgaagttttagaaatgttagcacctgcctgagatggcttttgtgtaagtaagctggctgtctttgaagggggcagatggagctagactgcttaaactcatcatataagcgagcaagagaagtataattttgctctcctttaaacagaattcccagcatgtctctttgttcttactacttatttttctatactgtaaattaaatttttaaagaactggagaaaagtccactaaaacaaattactaacagtgacaaataagcagtgctttatgttaatatgtaagtgcaccattgtattagtccattctcatgctactaataaagacatacccaagactggataatttatagagaaaaataggtttaatagactcacagttccacatggctggggaggtctcacaatcatggtggaaggcaaagaagtaacaaaggcaggtcttacatggtggcaggcaagagagcatgtgcaggggaactgcactttataaaatcgccagatattatgagacttatttactatcacgagaacagcatgagaaaaacctgccctcatgattcaaatacctcccaacgtgtccctcccacaacacatggggattacaggcgctacaattcaagatgagatttgggtagggacacagccaaaccatatccaccattatgtttattcaatgtgtaacctatatgtatctgtatctatagccacatctatatccagacaattacataatcttatatgttgaaacaattacagattcaagtactctgactcactcatcatttacataagctttcagcagagagaccatacttatatgccattccctctgcctgatacgtttgttttttctttcttcattttccctaacagataaacttctatttctccttgaaaattcagctcaagattacttcccatgataagcccatcttagtaatatttttattctcagatcctttactgtctggcataatatgtgctcaaaacatatttgatgaaggaatagttgtaccgttaaatgcaaaatggtgatgaatgacaaaatagaaagatatacagacaaactttatttaatcgcatatcatttattaacctagaaaataaaatgtctaagatagataatggcgtggagaccatctaattatttttaaatttgtaacctgacaaacgtcacaaaattgttaggaagttttcactaaggcttatatcatggaaaagataaaaaaaaataaggtaaaaacttttaaatggtactctactttttataaaacattacattttctaatgaaataaataatactttatgaatgtttaatatttctctaaccaacaattacattagctttccttatgtcacattgacagaatgtctcattgtgttggggccagagagcacagagatgaggggggaataaatgtatcaggaacaataaatgagatagtgattaagtgaaaaagtaagtaccattggcaaatcaggaaaaattgggaacctcaactttcagctgaagaaaaacacaaggcaggaggccagatgagagttgggggtcactattttggaggaacaggattaagggatttttaaagacatatgtataaggagggagaaaagaaagaaaagattctttgggggcagctctttgggagatcttaagaatgactgagacaagaactgagttgtcacttgatcttttgaattcatttacctgtggaattttttggagtgattacaacaaagatttaaactatttataattgcaatttttactgtactattatctttttttaacagaaaagaaaacttaatagtcaatacatactctaataatcaaatattataaaaatcttcctaatttactttcttttttaattttttgtttctttcaatgcaattctaaggccaaccaggtccgcaaggtagcactagatctatgctggtttcataaaacattgtagatgccattcagtagagtgattaagaggatagactctggagccagattgctttggttcaaatcatagctctgctacttgctagctgtaatcaggggcgagttacttaacacctctctgccttcttaataaaatagagataatagtggtatgaagctcatgtggatgttttgtgtagcaaatcattgtaggaacagtgtctgacaatagtgcttggcacattgcaaacattcaacgatgctggctattatgattataattattattattatatgcagatgatacagacaaacatttatgagtccaatatttataatctaattattcgtttattttacaaatacattgagtgcctactctgtccctactatgtgccaagctttgaggataaggcagaaaatacaaattcaagatctagagatcttggtaaaaaaggcagaaaacacaaactcaagatctagggatctcaagtaaaatatcaagccatgagatttagtcaggaaggtttcttttttcttttctttctttctttctttctttctttctttctttctttctttctttctttccttccttccttccttccttccttccttccttccttcctttctttctttctctctctctctctttctttctccttccttctttgcttccttccttcctttctctctctctctctctctctttcttgacagagtcttcctctgtctcccaggctggagtgcagtgatgtgatctcagctcactgcaacctccacctcccgggctcaagcaattctcctgcctcaggtttccaagtagctgggattacagatgcccaccaccacgccctgctaatttttgtatttttagtagagacagggtttcaccatgttggccagactggtcttgaactcctgacctcaagtgatccgcccacctcagcctcccaaagtgctgggattacaggcgtgagtcaccacacccggcgaggaatgactttctatcagaagttgaattgatatagacctacttggcacatatatagagctgaaacaacctagatggtcggcatattttctccataaatagagtcaaattatctgtaatttcaaatgtactttctccaagaacagatttttcagttaaagagtggcttttgatgagtgactttgctatactgttattgaaaaagggtctataatatgcaaatgctagacatgtatgaagcacaattgacattaacttacaggaagaaaagagactgaatttggttctcagagggaataaaaaaatctccccagccctacacttagatggacctctgagatcgtatctatgaaagttaaaaacttctattatatctaagacataattactggtgtatgatcatggaccactataatggcttgtttctggcaatatattgctttattatattgctggatggcatggaaagcagtaaaaattggtattccaaagtaaacattatctatcttctctagtctgggataaagaagttttaataattatttacactgaaggataattagagcatgaaatgaccatgaaaaaatatatttgcatagttgtgcagaaacattaacatgcaattatgtcttgatactagatacaaaatatctgaaatggaagatggaagatttagtgggatcttttaccaataacttcaacagaagatttgtgttttagaatgtgtcctagagacaggaccttcttcctagctaaatattagagataaaaaattaaaaagaggcttaaagtccatacttaagacccagaaagaaaaatagtattcttttgataacacatagtatttatgtagtatactgaattgtcaggtatttatcattaattatctcatgttgggttactttaatgctccgaaaaatattttatctcaattgcttttaaaatgtatcaaaatcctaactttgtttctggtctacacaccttcatttgtccatctttttcaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccgtatgtattttagtgtgtaggtgtgtggcgctgggtaggatctataattgtgagatgttgaggccaagttgcattaaattcaagggtttgtaatactaagaattcctagaattctttttaccattaagagcttcttcctggcccctctctgtcattcagcaaacattattggagttcctgctatgtgctaagtacagtgattggagatgattcgccagctgaaggcctgtggcagtcattgggtttactaactccagataccaaagtggtttctgagggtgtggttattaactcaggctatcatcattcattggtaatttatgtgccagatattgtgcctgagatccaggaggaataaggtaggatatcgtctttgagctactgatatatagtgtggtaagtacaaaggaaagaatgagcacagcgttctgcagaagagagaggatggccacaaaggcttggtgtaagtaaaggcttgccagcaaggagcgatatccaagctgatgaccaaggacatgagctaaacaagggtatgagataaacaggtaaagaggtgagggaggggaagaggagaagtcatgccaggaagagaaatcagaattagacagaaaatcctagttactcggggagctacaagtaggaatgactagaactgaaagtgccaaagggcagagagtagagatgagactagagcaaaaggctggagccagattatgaaggcatttaacaaccacaggagaagtgatttagggagaggcaccatgtaaagccctctttccagcctctatgaaccacagtgatacctcagactcattgatgtatttattcaacaggcctttgaacacctcctactagcaaagcattgtattggagcataatgttaaattacacataacccctgattcagaggacctagaggggaaatagaggcaaaagaaaagtaaattcagtgctaaaataacatgaatgctccatgtagatgctaaagtcatctaaagatttctggctaagaaatctttatatctatatatctctatctgtatctatctttctgacatgccttcttctcttctcctcgcttacctctctctctctgtatatatataatatatatataaaatatatatagcaggtagatatatacttatatgtaatctacataaaggtaaaaatatatattatttatatttatttatattatttttaatgaacagatatattattttatttttattttgtttttgaggcagaatctcactctgtcacccaggctggagtgcagtggtgcgatctcagctcactgcaaccgccatctcccgggttcaagcaattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaaccataagtgtgtgtatatgtatacaggtatatatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcttgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccaccccaacacatgcgtggacttctccattaccaaaatccccctccagagtgctacatttgttacagtccatgaacctacattgacaacagcatcacccaaacttcatagactgcattagggtttacttttggtggtgtaccttttatgggtttggacaaacttataatgatatatatctaccattagagtatcacgcaaagtagtttcattgctcttttttttttaaattataaaatgtataaaatgagagctttttctcacaatttacattttttatcccaaaaagaaaattgaaaggcgttgtgccttttttcttggagctggttaaagagaggcatgcatagtcccctcattatataatttaggaatgcagaaaacattagtatatttcagcaattgacacttgtttgattaaaattagtggtcgtgtgtatcacagaatatcagaaaacatgttaagacaccaaagaaggcaaccaccagaaacctttcctattaatgactctggttaatttctttcttttttgttttgttttgttttgttttattttgagacggagttttgctcttgttgcccaggctggagtgcaatggcacgacctcggctcaccgcaacctccgcctcccgggttcaagagattcttctgcctcagcctcctgagaggcatgcgccaccatgcccggctaattttgtatttttagtagagacgaggtttctccatgttggttaggctggtcccgaactccagacctcagttgatccaactgcctcggcctcccaaagtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcaaggcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttctaaagtactcagcagattcatagtggcaagaggcacactgaagaggtaataaatgaatgatgaagaagaagaggggactatagaaatattctgtcaagtatccttgatgtgaaagagaatgaaggacagaggaggttgtggagttgcaaaggttttcaaagataagagacatttgagttggtttagatgcttggggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcagcagaaagtgttgggagaaatttcttatttgatgatcttgatttcttcattaagatgtaaatctgggttacctgctgaggaaagaagcaaacatttagattatgagcctctcaggggaataggaggggatcactgagccgtaatcagaataaagcggcaattccatatggagtaaaataaagaatcaaacgtgtggactgatactcttggagcattacagggaaagtagaatggaaagagaagatggcaagaaaattgaagaaaaggtcagaaagtaaatgaattgatggattattagtttcaggttcattaggcaagatgacaaagcctgatggagggaaactaccattggttcagggactggtggccttgaaaatttcatagagaatgtgagaaagcccaggggcatgaacggagttgtggggaggaggtgcgagtgtgtagacgtgtatttaggatggactgtgcagacagggagaattagagagataaaatatgtaaaaccataagtgtgtgtatatgtatgcaggtatatacatatacttatgtatttattaaatatttaaattaaacatgaaatatatgatatgtaatataatatacttatataatattaaataaatttatataaataatatacacatataagtataaatattatgtatatataataatatgtacctatgtgtatataatatttacactagaaaggcaagaaataagaaaatgtatccaatcataaaaatgggatggaggaatgatacaaagattggggtagaaaataatttagttctccactcaattatttttattcttggctggaaaaatggatgagatgcattgtcagattgagtccaaaagctattctgtctttcaccctcttgaaagttctacattcagagtatcttttgtctcgtggaagataaatatattcagccaatactatccatgttttcacattgaaaccaaaaatgaatcaattatttcagtaaagcaaggtgtatataagttatgatttgtatttccccatttttatttacctgtagtgttttctaaaccagtcacagtctggatttactttacattattattatttattattatttattattattattattattattattattatttgagatggagtctcactctgtcacccgggctggagtgcagtggcacaatcttggctcactgcaaccttcgcctcccaggttcaagcgattctcaagcctcagcctcctgagtagctgggactacacgcgtgtgccactgcgtctggctaatttttttgtatttttagtagagatggagtttcaccgtgttggccaggctggtcttgaactctcgacttcacatgatctacctgccttggcctcccaaagtgctgggattacaggtgtgagccaccgcgcctggcctgcatgattatttttaaatgaccagattcattccacatttccagattatgctttgatactagaaatttagaaagaataaaaccccacaagaataaaaatctagcaatcaactgcatgaatatattttagtaaaagttggagcaacagatgataaaattccacaaattcagtgaactctgagaataaatatggaaggtccgcagttaattatcctgcaaagaaaacgaaccttgaactttctgttaatagactttgcttcccaattaaaagctagcagtttgaaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacctaagagccatgaatttgatttagaaatggggttgtatgtgtgtgtttttctatcacatattaaacgcacaatctgtaaaaaagattcaggaggatgtttgggaaatgttttctgtgatatttatttttcttcagaagaagtgccaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgactaatgctaacatttaaatatattcagaaattttacttttcattaatgagacaggaagcctcatctctatggactgctaacatgatgatttggtggaaaataaagtccagccagctgttaagttgaattaaaaaatttaccaataataatggaatatttttgccctgtcttgtacagtcatattaagatttgcaatatgaatatccatatctggaataggactataataccataaatagcttaaaacatagtcttcatgttttcagtaaatgttatgacagtgtattatatattaattataaattaatatgtaatacaaatcttcacaaatctgaaaatgccaaatttagtgaatattcagctttttaaattttgaaatggagtctcactctgtcacctaggctggagtgcaatggcgtgatcttggctcactgcaacctctacctcctgggttcaagtgattctcctgcctcagcctcccaagtagctgggaatacaggcacctgccaccatgcctgtgctattttttttttttttcatagagatggggtttcactgtgttggccaggctggtcttgaactcctgacctcaggtgatctgcccacctcagcctcccaaagtgctgggattacaggtgtgagccactgcacctggccaatattcagcttttaataaaatttttcttttaaagatgattttactttctatcagattcctattgcattgaggacttagttttgctttatttttattgttttttcaaatgttttaccaagtacaacttgtctctaagattcaaaacagtgtacattttgaatagatgtatcatttattttatgtatatgcataataatggttagaatgctcacagttatactgttcatcagtaaccctgtgaatacagggttcacatccaagatgttctcactggtccgtggcaaagtaagaaaatgagaacaactttccacatttttcataaaaatagaaaggatacaatttaaataattgtcctccattttgatattatgggttttaaaaactaatgatggtttttaaatgccctttgtttcatgaaataataatgatgctttattaaatgatagaaatatattggaggttattattacttggaaaaactaagagctagaactcctatatcaatttcacaaatcgatcacacatttatttttaatttcatattttttctctgaaaattatgaatctggaaaccactgctgtgagcggaattttgttattcctagatcagagatgacacataatgttgaatgatttgtctgtggtcagttacgtactaagtggtggagccaggaggaatatcagctacccgtgtgccagcacctcatggtccccctctcatcaccattattattagaatacatggctagattgcaatattaggtaggcaaattgagagtccatgtttgttcctcatagcaatgtgatttgttcattatgtgaggtattccttcaaatttaaaaaggattgtgttctaatctaaaaggtcattcataagccactcattcgaaacatcttcccagatacttagttttatgaaattctcaagactgacaccccaaagcatccttaatctataataaacacaggagtacagggaagctcacctccactttgtttacatttctatgggcaaatgtgccgactttctagtgagaatgtgaggaatttaagtgcccttactgcagccttgggaatagaaacaggatcatcaacagcctccactcctgccatcctcacccatgcatgagcaaggcctgtttagagagggagaaagaaaaagaccttatattacttggaaaatgagaagcaaagattttagacaagaaccaatgactgggaaccaaaatgcaatgagggcttggcagcccaggagtagtggctgctgttgtgagacacatggagctaaaatgggagagatgagaaactgtgagctttgaggattgtaagaaggaagggagctgcaacaaaggtcacaggtctgtggggttgccacgcctcctattttctatctctaatctcccttttgattttcacaattggtcctgttcttatatgtctgggtgaaagtaagggaagatctgtggtttttggtaggatagagtttcatgtgccatcatctccttccttgccattattgtaaagattcctccactagagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctgaaaaatcaactgaaaaaagttagcttggtaggtgaaaggcatacaaaatgtattttaacatgcatagcatggaagaatcacaggaggatgattacccaataacccaataggagcatagatgtagatatacccttcttcacgggggagggaagatggggaaaatatggcaatttggaaaatagtaaatgattttttaggggaattcaagaacctacaatggcctgggacaaagtctgttgggcccacagagcagatagtggtttgtaacaaaagtctgttcaggtgtgccgacagacttcagtctctcttcatgtgaaatgagttaaattaatgaaaacttaagcaagagggccagaggaaacttttcctcctggtgggatcagactgtaagtagatacgggagtatcagagtaaaacttatttcagcatttgctggtctccaagagcctttaatttaaaataatcagcataccagcatgctatattttcgggtattggtttctgagcctcaatatctcatagaatgaatttaacagcattttatgttaaaaccagatatatattggactccctacgtcttaataataatgaatgtgtcagaagggcaagtgttcaagtgtatttcaaccacaagtcaggattttatgtttctgttaacaaggttgatggcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttctgtattattttaatgtttgatattcacatgatggttgttttaaccatttttttttactttaaagaaaaagctataaactagttatatgatcttttcttcttcctttcatatgatgctgctaactcaatagagagacacccgattacaaatgctattgatggaaagaacacttggtggcagagtcccagtattaagaatggaatcgaataccattatgtgacaattacactggatttacagcaggtatagttcctctttttttgtcatttccacttttgaaattgcattttacatttgctatttgtttagttagtggtttgtgggtgaaaggatactctttcttatcactctccattgttttcttgataagatgaacaaagggtcctattcatatagcgtattgttatttacgagtattcagcatttaattataaagcacaattcaaatggaagcacgtgaagagcttagaaatgaattaggtgctaactctgttttagctagctggacttaatgatgaaaatatggatcaataaaattttacataacaaaaatataatagtatcatttttaacttttaaaataatacattgctcccactgtgctgatggtgtgtgcacttaaaggttcttggataacaaggctcttgagcaaattgcctctcattactgagagctgagaaagttttgacagttgctttcaagttaaacttgggtgactaaatgaagtaacaagctttgtagttatacaaaattgatgccggaagttgttcaagtttgtcttgcataggcctgggtgccttctatgcttaatctctttcttccttctcttcacaatattcaggtcaggctgaagttattaatcaggaatcgccagcacctcaaattatttaggcttgcaattaggatggaaagtggacaaatgccacattccatcctatttgtatgcctaaataatgtgcaggggtgatggtcaggatagttaatgacagacaccatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggtggattgcacggtagacctgccttccacccatatgggcctcctcgggatatgaggaactggtggcggcaggggctcagtgctgcagcttatatcaccaaatggcatggacttatttctaccctcactaatatacagcagctgaatgtcagtcctgagttaataatatttctcaggaagtctcagagcactatcagagaatggcagggcaagctaccacactgatcaatcatgctttaggaaaattaatcctgtgcatgaatcccctggggatcttagcctcaaaatggactgcataccactcctgataaagacaactttgtcctttattggtcacaagagttctcccccttcatgtgatcattgaaagtctagtctcccaatcaagagtgagtctgctgtgcattgactcaggtcatctccagggacaggcaatcaataaataatgatgctttattgttctggtttattctccatttattcttttagattgcacatagaacaatggggtcaattattaatataatttgcacaaatcacttatagtactctttgagctgaacagcaatattatttacctgttatcaaacatggcagcaattttcccctcctaatttacaactggatggcgcaaccacaagtttttactaaatcatttctaacttgcctgtttttatcaattcagcaagtcaaagagtttacctgaaagcctatttttcagtgatgtcattgatattttcctaaatttactttgcatactcactcatccattcccacacagtatcttaagaattatgtggatttgtcgttctgttttctcttcctcccatttagtttaatggaggtaagatgagtgaatatgccaagacatattttatgcttcattcatcataacaaagtgccagaattctgtatataacccaggtctacctgactccaaagtctgaaattcaccaagtggaattggtacagagcatatgtgttcaaattgtcccatattccaggatggtgtccatccatatccttatttattccagctttctatttcctgaaaatcaacctactgtgtgtgtagaagaaggggaattcaagtaatctctaaaaatgtaataaatccttatttctacttgactcaagattttaatttagtcagttatttagtgatgtgaaaagttaaacaggttttgtaatcaagtttcgtgatggaacttctcagacaagaaagagcttcagacttccaatttggcctcaggctttggaataacaaactgtgagacatgtttataatacttattcagctatggatggtatattgtactgcactggcaacagagaaaatgtggacattcttattatgtaactcctcacaataatcctgaataaaccagctaatattaatattcctattgcatagttgaagaacactgtgctttagaaaagttcagtgacttggccttctttctaaagcttattatgggcagggctggggcaacatgaatagtctgaatccagacccaaatacactatcttttctaatgggtatctgaagacataatcctagggagctcaggataatttttattatatattttcaagggctccaaatgtagttcaggttcaagaaatattgcactatcttctcctggcttctatgggataatatagccaacaacctgtttcgttataaagcaggggactagaaccctcattttctagtatactctagtgtgcctctaaaatggcaaagcttctgtcttttctacctaccgcatgaaggattaataggttattcaaaataagatgagctattatccaactgggattaaaaggcagtaaaattataatgaataggtaaatatcactaaatgtttgtttgtcatttattcagcaagagacttgaccatttattagttcttcttttgtataaatttcaacaagtgccagtattgttgttgataaatgcttggctcctctgtgacacattttcataaattagtatcttaaacataacagaaacgattgcatttatttgattaaatcactatagattacagtgggtttttttttttttttttttacattttaacattcaagataagcactagaaaaaataccaatttgtttggaagaaagtagctacttattttataagtagattgttcttagatacgtattactaagggattattaacttttctcattctatttactcatagcatattttgagcaagtgatttaatcatgctgtgcctcaacttctagattagcagactaaatattacaatatcttggcaagaaaattaaagtaatgataatggcaatatagcaactaaattccatctcacaattacagctattaaaaggatccagagtcagcatgaacttaaagaaaagcttaactgttccagtgacgtgtatataaaaactcaatataattgcgaacaaaaatatacaacaatttaaaggagacagtaatagggactcaaacgttaataagatgtctaaaacattctattttagtctttttcctaccagatttcaccagaatatgtcattatgtctgattttatttatttcttttaaaatctagccattatctccgtcatgccctttgatttgtttcagaagaaagctgattggcaggcggggtaaaacagaggggggcagcttttcagtagacttttcaaacacatattgaggtgatactcactcctggctaatccaggaatgccattaattagttaagctcatgtcttaactaggagtcttctcctcaataagcaattcacttctcttcctggtctatccctcaaaactaagaatgcgtttaccaaacaagattatcttacagctacagagatcacactccacatattcttaacctaaatattttattcactgatcttgcagagaaaaatttgtttggacaagttaacagttttaactggaatttatgttttaggaggaggataaactactatttctatgcaaatattactatacttttagaatccatgtgaatagtataaaatgatttttctctaaagcctagaatcattaatgtaatggttaaacatttctgcaataataaaacataaaatacgtggaaatactttatatattcaagttttaacaatcatttaaacatattaaaggtgatccaattttcagtcttgaaggaaggtcattattctttcatgtcaattctttcctcatgctcttcttactgattcctgattactgattaaaggatgtgttgtacaaggagggaattttggaaaattcacaaatacatgggaaattaaacaacatactcccaaacaaccaatggataaagaaaaaattaaaagagaaatttaaaaataacttgagacaaatgagaatggacacactaacactgataagaagaagcaaaagcagttctaagaagaaaggctatagtaataaatacctacgtcaaaaagaagaaagatctaaaattaacaacctaaggttacatttcaagaaagcaaaaaaaaaaaaaatgaagaaaagataaaagaaagaacaaactaggcctagaagtagcagaaagaaggaaataataaaggtctgggtagaaataaatgaaatagagactagggaaacaatggaagagattagcaaaactgtcacttgggttttggaaaatataagctaaattgacaaaagtttagctaaactttctaagaaaaaagatcagaattgaaagaggagacattactactgatacttcagaaatacaaaggatcataagtgactactctcaacaattatatgccaacaaactggataacctagaaaaaatggaaaaattcctagacctactaacactgaatcatgaagaaatagataacatgagcagatcaatgaagagtaaggagattgaatcaggaataagaaataccctatcaaagaaaagcccagaacctgatggttttactgctgaattctaccaaacatttaaggaactaataccaatccttctcaaaatcctccaaataactgaagatgagggagtacttccaaacttattttatgaggccagccattagcctgataccaaagccaaaggcactgcaagaaaagtacattacagatcaatatttttgatgaacatagatgcaaaactcctcaagaaaatactaacaaaccaaattcagcagcacattaaaaggatcattcactgtgatcaagtgggatcactaccagggatgccatggtttaacctttgcaaatctataaatgtgataccttacattagtagaatgaaggacaaaaatcatatgatcatctcaatagatgcagaaaaagcatttgacaaaattcaacattgtttaatgataaaagctgtcaacaaattagctatagaaggaatgtacgtcaacataataaagactgtatatgacacatcctcagctaacatcatactcaatagtgaaaagctgaaaggtttttctctaagatcaggaataagacaaggatacccacttgcaccacttctatttggcataatactggaagacctagccagagaaatcaggcaaaaaaagaaataaaattgtcatcaaaattgaaaaagaaaaaggtaaagtgtctctttttgcagatgacataatcttacatatagaaaaccctgactccaccaaaataactgttagaactaataaacaaattctgtaaattagcaggatacaaaatcaatatactaaaattagcaacatttccataaactaacgaggaactatctttaaaaaaatcaataaaataatcccattcaccatagctaaaagaaaaataaaaaatttggtaataaatttaaccaagaggattgctatgatttggctctgtgtccccacccaaatttcatcttgaattgtactccaataattcccatgtgttgtgggagggacctggtgggagatggttgaatcatgggagtgttttcccccatgctgttgtcgtggtagtgaaaagtctcatgagatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtatgtctttttttttttttttttttttctttttttttttttttgagacgcagtctcgctctgtcgcccaggctggagtgcagtggcgggatctcggctcactgcaagctccgcctcccaggttcatgccattctcctgcctcagcctcccaagtagctgggactacaggcgcccgccactacgcccggctaattttttgtatttttagtagagacggggtttcaccgttttagccgggatggtactcgatctcctgacctcgtgatccgcccgcctcggcctcccaaagtgctgggattacaggcgtgagccaccgcacccggcctcaggtatgtctttatcagcagtgtaaaaacagactaatacagagatgaaagactggtacactgaaaactgtaaaacagtgatgaaataaattgaagacacaaataaatgggaaaacatcctgtgttttgtggaataactaatattattaaaatgtccatactactcaatgtgatccacagattcagtgcaattcttgtcaaaattccaatgacgtttttcacagaaataaaaataaatcctaaatattttatggaaccacaaaaggtgctgaatagctaaagcaatcttgagcaaaaagaacaaagctggaagcatcacactatctgactttaaaatatactacaaagctgtagtaatcaaaacagtatgctgctaacttaaaaacagatacgtagaccaacagaatagaataggagcccagaaataaatctaagcatttatggtcaattgatttttgacaaagatgccaagaacacacaatgggattgaactgtctgtccagtgaagggtgtttggagcagtagatgtccacatgcagaagaatgagtatagacccttatctcacgccatataaaaaatccattcaaattctaaatgaattaaagactgaaactgtaaaactactgaaagaaaacacaggggaaaagttccatgacattggtctgggcaatgattttttaaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaagagattataatatacatgttccaaatgtagattataccttacctgagtataccttgtttaagtacaacagaatatagttaaaatcacagttctttacctgctttagttgtatatagatttttaagatcatttgttcagtatcacaagtagaatctgtggttaattagaaaatatattttccctttaaaagaatttgtgctgacttttaaaattattaataaaggtgacagctagctttggtgtctatattgaagaaaatgttcatcctaattggtttccgtttgtctaccctttggtctgctttcaacacagcagtcacagcaatctcattagtacagatcacataacactttccactaaaagtggaaatcttattagtacagatcacacaacactttccactaaaagtctctactggttttccatcacattcagtgggaaaagcacaatgacccacaaggccttaaggaccttttcctcacctcttttcatctctggcctcatctgatctctcttcctcagttgcccagctggtcatcccgctatgtcttgaacactcacacctgcctcagggcctttgcacttgatatttcttatgtctagaattattttcttcaatttcaatgtagcttgtttcctcacctccttttggtttttattcaagtgttaccttctcaacaagggcctccttgacaactctatttaaaattgcagctcccagcctgtccacttcctaaaccactttcctgctttatttttctccataaaatatatcaccatctaacttactatgtacatgttactgttcagttgaatatttatctttctaaatgcaatttttttgtgcgtggagctatttgttgttgtaatcattgctttctaagcacttagaatagtgcccaacatataggaagcattcaatgcgtttgtattaagttaataaatgactgaatgaataactagtacaaaccaccaatccataatttaagaatcttattgaatctgagaattaaaggattaagtgatttcactgtgcttcttatgataaaacacactgcactttttctaattatgaaatttcctttaaggttgaatggcattgttttagtctatttgggctattataacaaagtaccagatgaggtggcttataaactgcagcaatttatttctcatagttctggaggcttgacgtccaagatcaaagcactggcagattcaatgtctggtgagggtctgcttcctggttcatagatggccttcttcttgctgtagcctcacatggcagaaggggcaaataagctttctggggtttcatttataagggtactaattccattcttgggggctctgtcctcatgacctaattacctccccaatccccatcacctaataccatcacattaggggttaggatttcaacatatgaattttaggggaacagaaacattcagtctatagaaagcgtgaagtaaattttcttccagttcctatgcatgttcttactctgcttttaagcgtattctaaatttcagttgtatctgtcactatgtgactttaccacacttacagctttatttaggaaaagagatgttaattattttaactcttcttttgtaacagagaagtctgggactgtcattttttgttttttgcttgacattgtattttttcctcatagaacaaaagttagtataaaagaaagggaaaaaaggccatacaatgatgctgtttaaacaagagtgtaaatgtaggatatgtattttgatctaaaatgttgataaaccaaattctagcaatatcatgaaaatgtaaacattttggagacccagatcctatttcaaatagagtcaagatgactgccctagaaaatgcttcttgaagtcatggaataaattagatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtgaatactgtgtattttccaattttattcttagagtttaattttttacttacatattatgcttatgtatatcatatttgttatatatattatatataactaatatacaattatattatttatttaaaaataaggaattaaaaacaattatattatttgtttttaaataaggaattacaaaataatgaagagaccgtatttattatagatcttgaaactgtgactaaaaaccccatgcacagagaaaattcttgagtcaaatggcttcattgatgaatagaagttagaatactggttattgttacaaggagagggaagataatgactgggagagggtatgtggaaagtttcatttcttatttttgattatataattgtacaataataatgtgttagtacatagaactaatataattgtaaataagtgtgtttatatataataaaatatacaaaatatagataatatattgtataatgtataattatatacaatataataaaaatgtgataaataatattgtataatatataattatatacaattatattatatgtactaatgtattagctatatgtatttatatgtacctatatataagactttttctagaaattgactacatatttgaattgtgagacagcatgtatgttttgattcatagataagatatgtttccaatattacccatatctctaaaatacaaacatggcaaaaaaaggctggagtgagactaaggagaaaggaggagctataagtgtgcccagattccatttctttacctatgacttatgcgttggtacatttaccttaggtaacttgtcccacttttatgctcttcaatttggtctagtgtaaaatggagcaaataggcccacttccttattacgaagcatattataaggataaagtgatgtgttataggcaaagagcatagcacactgctgcactttaggtgatactcagaaaatattacttttggtcttccacattgaaaataatggtgaatggagaataaatgggctaagttgtaatgtgaaaaatggaaaataacaaaacaaaagctcaaaaatgctttaattactggatattgaaatgatacctatgaggttcactttgtatatcacctaagaatattattttactcaatatatttttagcactttatggacattaatatttctatggagaaagcttaaaaagtgtcacttgtgcattgaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaattattttaataatttcaacctttctgcaactttccattttagatatgtctcattaatggcatatagtgaagttttgacgttttgtctagtttggcagtgttggtcttttaatgaaacatgcattttcagtggatctgtgtgtatctaagtgaagcatgtacacagaaaaggtgacaaataaaagtctgagagaatttttgctaaatgaaccttcccaagtaactactactgagacaaaaataaccagcaacccagaaacttccctcatgccttttccaatcactatcttgccttctcccctaatagtaaccagtattctaacttgtattcaccagtgaagccatttgatctaggagttttctctgtgcatgggttttagtcacagattccatatctataataaatgtgggactcactggagttttcatttcttatattttcagtttagttgagttgggcttttcaagaaattgatccacttacctaatttttcaaatatatcgacatgagttgttagtgatattatcatcttttaatttacaatgatctgtagtgatgccctttttttattccagatattgttgtgtaacctttgtttttcctttacagctttaataggtcttcataatttcattagtctttttcaaatagccagttttgggcttgattgattttctctatcgtgaaattgttatattgtattgaatcctgctcttatatgtcttgttttttacttctcgttattttttattttagtttactacattttcttagcttcttgaaatcgatacctatgttattaatatttcagttcttttttcctaatatatttattaacgcctacaatttgcctctacatagggctttagttgcctcctacaagtttgatatattgtatttttcattatcatttattttaaaatatattctaattttcatagtaaatttttctgtggcctctgagttatatagaagtgaagtgcttaatttctgaacaattgagtatttttctaatcgttttgtttttgttgttattcctttcctcactaattccactatggtcagtgtattttcaattctttgagactaaactttttgagacttgtttttatccaacatatggcagtgacttgaaaacaatgtggaccagttgccctggctcactcctgtaatcccagcactttgggaggccaaggcaggcggatggcttgagcccagaagttcaagaccagtgtgggcaacgtggtgaaacctcatctctaccaaacaaaacaaaacaaaacaaaacaaaaccccaaaacaaattagctgggtgtgtgcctgtagtcccagctattctggagtctgaggtgggagaatcacttcaacccaggaggtagaggttgtggtgagccgagattacaccactgcactccagcctgggtgacagagctggacatcagaccctgtctaaaaaaaagcaaagaaaagaatgcagattctatagttgttggttgcagtactacaaatatatcagtgagttatatttatatatattgatacttttaaattagagacatacaaatttaggattattaaatttaataatttaaattttgtattaactcttttgtattaaccacctttttaatactactgccagcagtacttctatctttagagtgtacttttgtatgtagattcactagcttccttttttctctgtgtttgcgtgatataggttttctcatatgttgagtgtacttatatttaaggtgtatcttctgtgagcagcataaatttgaattgtttatttaactaatctgataatcttttcctttaaattggatacttaattcatttacatttagtgttactatactgatatatgggttcaaattaccatattctcatctgttttctgtttgtcttatcttttgctaatttttcttcctcataactttcttacttttggaatactgaaggtttttccctatttaattattccatttcttctttcattagcttgtcttctgtgaagtcttttattactcatactaattaccataaatatggtaacttgcgtccttcatttatcagaactttgtaatattttacctcagtcccacctccccatcagatttaattctatagttctcatatgtttaattctatgtatatattaaactccataggaagtaattgttaccatcataaacatgcagttttcatctaattttaaacacctttaacttttttgtttattttttgttagtatactttgtttatttatttatttctgttagtaaacttccatcaagaaagtatcccatttcttttctgccttttttaaatgaaagcctgctagtgataaatctctcatcttttgtttgttttttcacttttctttacttttgagacttattttccaccaagtataaagtagaatttcttgcctggttggaattttgttttgttttgtttttttccagcactctaaatatatcctatcattattacttgtttttcattatttctatcatgaagtaagcggaaagtcttattgttggttcttggaaacaagatcatttttcctttcactccattgaaggctattttttttaattttgcttttggtgttcaggggtttaccacaatgtacttaggaatgattttattggtattaatactatttgggattcaaaagcttctagattctgtggatcaatgtctttcaccaatttggtaaaattcttagccgatattttctcgaatgttgttactgtccattctttctctccactctccctgagacttcagtcacatccctgctagactgtttgccgtgctcattatgtattctatggcttcttttcatttgtcttctcttcttttgaggtttctcagtctgtacattttctgggtgacctgttgtttggtataaataatcccttttttctgctggattcaatcttttattacatacatttactggatttttaatttttgtatttttattttttagttttagaatatccaattgatactttaaaaaaattagactccaaatatctctccacttagtcatctggaacatattaataacagttattttaaattatatgtctgataactctgacgttggaaacaactgggagtctgtttctattgtcttttcatgcattcctgttttatgacaagcttggtcgtttttgattaaataatgtatgtgtctgaaaatgtataaaaattctggaagatgttatttttctcttaaaatgatttattttcattctgtcaagagttagtgtagaggcaagttgctttgcttcagtcagcaactcaaatgttttgtagcttagttagagattctgatggttgtttctagtttactcttagttctagggatagactttcaggactccagtggaaaccccgacttgtttaccacactctttccttcttggctgactcttaactccaaagtttgtcttcccaactctgggagacttcccaaggatcttcttagtttttcacttctcatgagttcatttttgcatgatgtttatcttctggctccttcaccacttagaaattggcaaatctcttgaaggcaaaagctgtgaagaatgtaggtctcatttctctatgaattatggtccctcacatcctagctgacttcatagccctgaattctaatgtttatcttcttatcctgtgagattgctgaacacactaagatgtagctttctctataacctcctattcaactgtcagcaaatcagtaaaagtaccctgagaggaaaatggctagcttaccttattttgcttccctttacttaagtctggctgccttggttgcttgctgatgccttcaaactgctgtttttagtattttatccagcttttatggttgttgtctttgagagaaaatggaaagggaaaaaatatttattttatttacagttttaaaaacaaaaatcagcatattatctgataaaattattattgctttttgtgaatttaaggaatgttctgaattattgcttcaatattaaaacagtaattattggaacattttgatggattatgaagaaagaatatgtaaaattgggatcgtgtggaaaatctggtatgcatgaaattggcatataaagtaggcctaaacaaagcaggtgctattcttagtaagaagcttcatgccccttatggcatatctgccctgaataatacataaagaaaataatttaacaatatgcgtttgaaaaatatttgttgagcaactactgttttttaagcagtgttctaagcctgtaggtctgtccatgaaggagacaggagtccttgcattccagggttttcaagtaaacaatttagaatagtgcaagttcatgaaaaaaaaagcataagattataataagattatagacggtgatgaaagagctaatttacatgtatgttctatgtatgcatttttcaggaagtgatatttgagctgagaattaaaaaccagaaaataccagtcatagaaaaatctgggtagagtttattaccagcaggaataaatgtggggtgctgaggaaaggaaagaaggccaatgtggctggaacctagtgatcaagagcaaaggtggcatgagatgctgtcacggaggtctccaggtcttcttagctcctgaagggagtagtcagtcatgataaacagtttatattgaattctgggtataatgagaaacccgcagtggtatttaagcaggtgtaacatgatttcctttatctcattagaagtaacattctgctaaatggagaatgattatagtgagataagtgtgaaaactaggtggcagtcaggaaaccatagtacttttttagcaaagagatgatggtaacttggaatagagtggtagtagcagagagaagtggcaggctgagatttatctggagttcggcatcacccgaattgatggtggaacaaatgtggagagtggggccaaaatgttgactcctaggagtttggcctgaagaaattttcctgaaatagtatggattaaaggaggagcagaatggagatactgggtggcaattaagggtctgttttaacatgttatctttgaagcattcgagtggtgccaggcatggtggctcactcctgtaagcccagcactttgggaggttgaggtgggaggattgcttaagcccaggtattcgagaccagcaaccagcccgggcaacaaagtgagacccctatctctacaaaaagaagcaaaaaattagccaggcatagtagtcccagctactcaggaggttgaggcaggagaatcacttgggtccaggaggtcaaggctgcagtgagccatattcatgtctctgcactccagcctgggagacagagcaagacgctgtctcaaaacaaaacaaaaaaattattcaagtggaaatattaaagggacaattggatttatgagtctggagttgagtgatgtgcactgggaaagagactgtacttaacagtaaaggcctgtttaagatcatttagaaagcaggtatagagataaaaagagggcctataattgaatcctaggcacttcaaatttaaaggtggtaagatcaaatacatcaagaaagagggaatcttcagctatggcaatgcagatgctgtgaggtacaaattaaaccactcaggtcttggaaatacctaaacatagggggaaaaaacacctaaattgtaatgagtatatgtgtgtatatatatataaatatatataatatattatatataatatataatacatatataatatatcttatatatattatatatatatattatatatataatatatataaaattagagaatctttaataagaggtgaatggctccaaacacagatttaatttggaagctcccaccctagcaatacctactggtgttcattttatttatgtaaacacacaaatgttgactatgtaatttttcaattaaggaaatagccaataaaattgtgtggaaaaaagatagcggtagcagataataacatcttttacttactaaagagattgtgtctaaatattaaaagtaatacattcccttgtcaaaacacttcatttttgtttgttttcacaaatattttaatgtggattttgagtcaaattttctgtaggaaggtcatggtagattaatgtcaaattagctgaaacaataaacacgatgaaaagaaaaatcagccttgtaagacagtacaactaaggagatcagtttaaaacactaatgaggagttgcctctcagcactgggtcattatgattatactaatataataagttaggttcaggttagaaagcaaagatgaataatcttcaaaaggcacagtaaatagtcaatttagttgtctaccttcataatatttactatttccatactaaaagcttacagttgtgggctagaatatatgatattcacgtaataatatttaaattgaatttcatttttttgcttcttcattatccttacctctaccctcctcaataaattcatctcaaatgataagattttccatccatcattgtgaagaataatttatttacttaatgattctggaaatatgggaatgtttataaaacgaaatacaaaaattaagaaatggagtgggcaagtaaaaagacattttcccactgattttagaatatactcaagaaaattaaactagtgacaaaatagatttatttaacttataagctaattcataaattaatggcaaaatttatcacagtatacataactgagattttgcagatttttttgtaaatagataacattctgatacaattaacagatctccatcagctgcattagatttcaagttgccctgctaccactgtatatatgcacatagataaatatgtatatgtagtgcaacacagatgagaagatataaagttgttttattttgttcgaatatgtattacagagaaccctatgtgctgtatagcaccttatatatctttcttttaagagaacctcataggacttccaaattcttcactgaaatagctcctacttcttatattacctttcgatatgtcagaaagattctttttctggaagctgttgttctcatccacatcattgcacaggctgacaatcaagacactatttctcactttctttaaaactaaatcaggatttgagggagtggagggatgactaggcagagcaaaaggatttttaaggcagtgaaaatactctgtaggatagtataatgatgggtacatgtccaaacccgcaggacgtgcaaggccaagagtgaagccgaatgtaaactataggctttgggtaattttgacgtgtcaatgtcatttcatcagtcattacaaatgtactactctactgggggatagtgataataggggaggttatacgtttatgggggcagtgagcgtatgggaaatctctgtattttttttttttcttttttgagacaaagtcttgctgtgtcgctcagactggagtgcagtggcacaatgtcggctcactgcagcctccgcctctagcattcaagcgattctcctgcctcggcttcctgagtacctggaactacaggtgcgcgccactataccccgctaatttttgtgtttttagtagagacaaggtttcaccatgttgcccaggctggtcttgaactcctgaccttaagtggtctgcccatgtcagcctcccaaagtgctaggattacaggtatgagccactgcacctggccaaaatctctgtatcttcctttcaattttgctttgaacctaaaattctccctaaaaaataaaatattaaaaaataaaagaaactctatgtaccctactgactactttgtcaaagattatctattttttttctcaactcatgcaatgtttaacactttggaccatattatcacttatggttagcctcttataatatggtatggctatttttttaaaaagtcatggtaaaatgacataacaaacaattttttatcttagccacttttaagtgtacattgttgtgcaaccatcatcaccattcagctctacaatgcttttcatcttgtaaaatttgaaatactgcacccattaaataataactccccattctctctcccccagtccctggcaaacactattctaccttctgtctctataaatttgatcattctgggcacgtcatataagtggaaccacacagtatttgtccttttgtaactggcttatttcattcaacatagtgtcttcgagattcttccacgttgtagcatatatcagagtttccttcatttttaaggctgaataatattccaatgtctatgtataagtagactcacacacacgtacatatatggcacattttttgtccattaatccattgatgaacacaggttaattccaccttctggctattgttcttaatgctatgaacatgggcatatgggcttcaatctttaaggtttcagttactcatggtaaactgaagtctgaaaatattacatacaaaaacattttaagagagagagagggagaagctacattcacataacttttattatattatattgttctattttttattagttattgttgttaaatctcttactgtgcctattttataaattaaacttcatcaaagatgtgtgtgtatagaaaaatacattgtatatatgggcttcatgcattgaatgagggtcttaggatgtatccccctgaggataaggagggactactataattctactgttaattctttgaggaaccactatattgttttccatagtggctgcaccattttacattcccatcggccatacacaaggattctaatttctccacacccttgccaacacttctttttctgtttttttttttttctttttaaatagttagcatcaaatgcgtatgaagtggtggcggttcatattttcagtcatcgtttcccagtatttcttgagacaattttgaaatattgtaagagatataaaataactttgatgttggaaagaatagcagtgaagaatgcccatgtaaaatttgagaatcttgaaacatgacagatacaacattgcattaaaggaaattaaatcctggacaattttgcttagcttgtaagtacatatacaacacatatacaaatacatgtacctataagtacatataaaatatatcctttctaaatttggctatattgtcagatacctgagaaaattattatctttatagcctctgtgatatgtcgccaatgcaaggcccatgaaaactcaaaaagagtcagttagtaaatgaactcttttattatttgtataaattatagtttttataatataaatgtaacatatgaatacttgtgtctggaattacaatagacacatttttatctccagggagttactactggcactttttgaaatcctgttttgtcctagacactggacaaaatattttacataaattatcttatagaacttttcaactccgtaagaaagatactattataattagtacattttgtatcacagaaattaaacaacttcctcaaaatgacacagttagaaaacaatagagcacaagatgaatccagttctttctgatgtcaaagcctgccgtgtatactccagatgacctgaaccttagagtaactaaaagcatcagggcttctctgatatataattgtgagaatctcactaaaaacaagattaaattactacagaggagtcttagaatttaaaactctaaaaagtgaaacttaggatttaccaaaaatgtttctaacttctcatatacatgtatggatgtaacctgaaatgctgggttgattattgaaatgtccatatgaacttacaaatttaccagaaaaaaatcaaactaccccatcaaaaagtgggcaaaggatatgaagagacacttctcaaaagaagacatttatgcagccaacagacacatgaaaaaatgctcgtcatcactggccttcagagaaatgcaaatcaaaaccacaaagagataccatcccacaccagttagaatggcgatcattaaaaagtcaggaaacaacaggtgctggagaggatgtggagaaataggaatgcttttacaccgttggcgggactgtaaactagttaaaccattgtggaagacagtgtggcgattcctcaaggatctagaactagaaataccatttgacccagccatcccattactgggtgtatacccaaaggattataaatcatgctgctataaagacacatgcacacatatgtttattgtggcactattcacaatagcaaagacttggaaccaacccaaatgtccatcaatgatagactggtttaagaaaatgtggcacatatataccatggaatactatgtagccataaaaaatgaagagttcatgtcctttgtagggatatggatgaagctggaaaccatcattctcagcaaactatagcaaggacaggaaaccaaacaccgcatgttctcactcataggagggaaacgaacaatgagaacacttggacacagggtgggtaacatcacacaccggggcctgttgtggggtggggtgagggggggagggatagcattaggagatacacctaatgtaaatgacgagttaatggatgcagcacaccaacatggcacatgtatacatatgtaacaaacctgcacattgtgcacatgtatcctataacttaaagcataacaataaaaaaagaaacttaaaaaaaatgaaatgtccgtatattttcttgattttttccaaatgttttgaagaaagtttttgtattattaaatgctattcattggtcaatttaagtaatcttcttttaagaaatcattcagaaattgtaggtccttgatcgtaattctttttgggtaatttcaatttcaataggttaaacactgtgctggaagatttgagaaagattatcattggtccattttgtcaaaatcatttccagaagtttaagtccttttttcttcatttttagtgtgattcattgattttcctaaggaagaacatttaacttctctcagtattcacaaggaatacctgcttgaatgtttaagtaccaacagaggatttaaagttcttattacttatgagcattaaatgaattcaatactccaaattttatagaagaagcatttctgaagatagaaaataaggataatttttaaacacaagaaatcacatgcttttcatatcattatcaatgtggaaaatgctgaaacaacttgctattaaaaaccatttatcagaaacttgtttaattaatatgtcaaatatctgggtttttaaatcatgtataacaatgaaaatattcctaaaaacatattgagaactttaacaaaacattttacagttggaatgaaattagtactggatgattggattaaaagccagtagaaattatatattatcctatttaaatgtaggactatataagttattggtaatcctttttcataattttattactttttccagtacctaagtggatactggtgactggtatataataagtaaccaatgaatagatattgaataatgcattgctttgctcaattttctcatctctgagctttcctgtctgtgctactgcaacattactttcttaattatattctctcactccactgcaataatattacagatgttattccctgattaagaatagtataaattgacaatccaacccctcaaatgaaattttttggtgatccaaacgttttaaacatccaataaagatataacatgctagttctctagtaggcacccatttccaggtttccaaacgtttcaacaaaaacatttatatatttctctattgattgcataatgtggagattctgttttgagaatgcacataaagtatattatattctgaactgtaacaaaatgagactctaatttattcacagtcctttttaaatttgtctgtatttttgttttcctgagaaaaatcttatctttatagcctctctggatattgaatatcttgagactagctttaattctcttgatttttattaaaacttctaattccaactttattcgtgaactacatgcttatataaaagtacgtttcatcaaacagctttctctttatctctttaaaatcattaccttttattattttcagtatgctttaatgctttaaaattttattcttgaaacatttggtttttccattgctactttcctattgattgttttcctcatatgtatcttgagattttagtctaggttttataacaagcatagctatatttacagatattttttctataaagttttcaatatagattctgatttttttatcttataaaaaatagttaacaccattaacatttggatttatttctgtctagttctcctctgctcacacacacacacacacacacacgtgtacacacaaatacatatatataaaatgggcagcacactaataaagataaaaataaactttataaagttttacattttgtaactggatattatattgtgaacatccccatgtaactgtgtagtatttgaaacttagttatttaaaaattaaattgcaaatgtatgatcttatagactattttcctgcttccaagacttctttggaactgtggactccctgaaatgccagggtaacataagcgagacagaacagctagcagaacctcagggaataccactgactttatggtgtcagccagtatcatgagagcccacaatgttgcctttcaaaccaagtgatacatttctatcaataattaaataaatttgaaagtacactgccattgcatttgcaatcttctttctttgttctttattcattgcaataataaaaacaaacaaacaaaaaacaacaccaaatcaaatgactgttgatgggggaattataagaatagatgggagtgaagacccaagctgactttacctccaactcaaagatttttgtccactaatctaatttctctttctctctgtgtttgttaaaagtttcaaagtagatgtaggttctcttgccaagttgatactcgtgttctttccttttcaagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgttcaaatttttctttaccactctatattaacacctaagttaaaggccggcacaataaacaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctcctaaaaagattactgagaatgtagatatttaaatgtattctgttcatctttaaataatttcatttatgtttaagctgcaaaaattgatctgaagttagtctggtatattgtgtactttaagcatgtgatacgtttctaaaatgttcatgtcaagaatatctacaattcaaatcatgaccttcttttggcttgtattctaattttgaagtttctgacctagacacaaaaatgattaactgaagaattttaatagttgtactgttgttcttcacttctatcagtgatgatatttgatagtgtaatatgctgagcaggcaaacaatgaaaaagtcccctccatgcaaaatgtatgtaaaatcagctttcaataagtgaacagtatttactacctgctgttccttttcactatttgcagtaccattcttagactcactgcaggcataaaccctgggataaggaaaagttaagcctccgttcttcatacctctaataaggctttgccaatggctgcaatcattttacaaccatccacttatgtttaggtttaacagagtcttggcttcataatgaaatacttcattaaagtatttttatgatatctgtttacacatatgttcatagtagaattgcatggtgttctgttatccagtctttgccattcacatggactcagtttatagtgtctggttatgctactgaagatcttcccgctttaccatttgctgttaagtaattgtagtcagacagactgcccaggaagccccatggactcagttttatcccttgggtatcacaaatgaggaagagtttgattccatattggtgaaatactacttctgtttcctaaagatatgttgttttctaagatttgcttctagattttgtgattaaatgttttattggacagggatttaagaatcagaatttcatgacattttgtcctactttaaatggaaatgtctatagacttttctagtgaaggcttttacaaatgttaagggatgattgaatgctcacagcaggacacatggcattacagaaagtctccaaaattattcatccttttggggacaactataaccatgattttttgtgacactcataacctgttgaattggaaaaatattaatgttagaaatctgttctcatgtcacttttaaaattcttctccttttttgcctcctgtagcatgagtcctagtttgattaaactagacacttgattttctccaatggtaacatgtttttaaaaaaggacttttactctgttggaaccaattaggccaatgtgaggaactttggaaggaccatgagcagccaaacttgctaacagcaaaacatatttttctgaaggcagcatgaaaaggacggaggagttctctaaggactgtgagttccacgggtccttttgagcttcagaaatccagctctcagcacttcataaatcatttctgacctgatgtcactgaagttgtattattatgtggttagtatcaaattcagaaaaattgggagaaaatacaaggagaagaatttgcagggtgattgttgtaagatttttatcatgtcctcttaaaaatggtagcttttcagaaacttttgttaactgctttgcattccatcttgagaaaatgtctgtatagttagatgagcatcatctcctctccttgtttttaaatcacatccaaaatgacatcaggcttgcagccgtctcattttttccttttatttacactcttcacacttcattggcaattgaggtcaccactttaaaatttagggtgaaggctaaagaccagcttgacaaactgttggcggaatgctctcttttgcaagtcttcgttttgaagaaagaatgtgtgatttagaaatatttaagattgtcattttggtagaacttctcatctatcaatgcagggtgcagcatccctatttattaatgttgtgttggttagatatgttcacccattaggtacgtgcagaggtacctgaaaccatctgagaggtggtatcccatttttcataatctattcaattgaactttaaaaataactgagcatcttttatatacaagacattaacagacatttatattctatggtatctactgctagcaacttataacagttttggtggtaaaataaaggcaaacttgcttcataacaaaacaaaattaaattatcaaaaagaaatgctcagttgttaatttaaaatataaaatgagacatgagaataaccttaggttagaaattcagatgtagaaaatatctgtataaagaagttagttgaaatactcataggcatgaaaggtattttgcaaaaagcaaaagtaggcaaaactggatctatgaagttgctccataatgtactagtcaggtgaagtagcacaaattacctagtgtatcagttttcttttgttaacacaacatattaccacaaacttaatggcttaaaacctcacaaatttatctcacagtttaataggttagtagtctgacacaagtctcactgagctaaagtccaggtgtgggtagtattgcatttctttctggaggctctaaggtagaattcattttctaaaattcattcatttaggatagaagctgaaagaatcagtttctacaggctacctgcatcctttggctcatgaccccttcctccatcttcaaagccaggaacaggttgaatccttcgttgtaccaccctaacctcttcttttgcctccctcttatacttttcaggacccttatgattacattgagcccagtggattatccagggtgatcctttcatctcaaggtctttaactgaatcatatctacaaagttccctttgccataaaaagggtcatattcacaggttccaagaattaaatatagacgtctttgagggaccactgtttactctaccataactagcctatctcatttcaattttctaatcagttactacctgtctcttagagttcttgttagcagaaacaaatttctgtgtaataaagtgcctggcaaaaagtaggtcctaaataaaatgttattttccccaaggaaaagattattaggaattataacattgggacacacctttgtttaaaaagctctaattaacaagaaccacagcaggggcgcgcatacaggggttggagagaaattcagttagtgctgtcttctggacactccttctatcttcattctctcctctgccattgttaaccttccattttaggcaaggagctgtattaggaaaatgtggtttccttttattaaaagaaaatctctaaattattaatagatattacttttccaaagaaaatttcagaaaggagaagaacaacataatcaaaatctgtggacactttaaagataaggatgatggagaaagactgaattttgcaagcaggttataataactcctgagagtgattgtaatagggtgattaggtcatgcatggactacaagggatcaagtagaaaaggagtggtaaagtagtaaacagcagagggtacaggctactcttaagaaagtccctagagaaggataagaaaatggggcaatacataagcttggaaatagatgatgatatttcttttttttttaatttaattttatttatttatttattttattaatcattcttgggtgtttctcacagagggggatttggcagggtcacaggacaatagtggagggaaggtcagcagataaacatgtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcacggcccttaatccattcaaccctgagtggacacagcacatgtttcagagagcacggggttgggagtaaggtcatagatcaacagcatcccaaggcagaagaatctttcttagtacagaacaaaatggagtctcctatgtctacttctttctacacagacacagcaacaatctgatttctctatcttttccccacatttcccccttttctattccacaaaaccaccatcatcatcatggcccgttctcaatgagctgctgggtacacctcccagatggggtggcggctgggcagaggggctcctcacttcccagaaggggtggccggtagaggcgccccccacctccctcccagacggggcggctggccaggcgggggctgccccctacctccctcctggacggggcggctggcagggtgggggctgcccccacctccctcccggacggggtggctgccgggcggagacgctcctcacttcccagatggggtagctgccgggcggaggggctcctcacttctcagacggggcggctgccgggcggaggggttcctcacttctcagatggggcggctgccgggcagaggggctcctcacttctcagacgcagcggccgggcagagacgctcctcacttcctagacgggatggcggtccggaagaggcactcctcacttcccagactgggtagccaggcagaggggctccttacatcccagacgatgggcggccaggcagagacgctcctcacttcccagacggggtggcggccgggcagaggctgcaaactcggcactttgggaggccaaggcaggcggctgggaggtggaggttgtagctagccgagatcacacactgcactccagcctgggcaacattgagcactgagtgaacgagactccatctgcaatctcggcacctcgggaggccgaggctggcagatcactcgcggttaggagctggagaccagcccggtagatgatgatatttcatttgcaatagctaaaattgactaagtgttaagtgactctgatctgttgaaagaattcatgaaccaagatcagaaactttcttctgtctttgatttgttattctactctgttaacattatacttctaacacttcccatcactacaaatctttgctattagtccccaaatgctttgaactagagtgattcatttatgtgtgtaatgtcataaattggagaatgtgtaggttcatcttaccttggtaaatacagaagcacaaaaaacaaaggcaatgccaggtatttctccagggtgaataaattttagaaggcaaatttaaactgtcatatttctgattgcctgtgattcacaccattgttgtactctgtgacagtttcattgaaaggactgtcatgttccatgaggaactcagcctacctgctcttttaccagtagctggtgggaaagccatactgtgccaatgacttattcacaggaggcaggtcaatcttttgaaaccacagattgtttcaaatgagagaaaaatatgtgagaagagaatagatgtcaagggtagtgctaaagacaaggaaaatgcttgcctgggttttccctgcagctgacgttgttaaaaatgatagcaacttaatgaagcatggcgtactaaatgcattaataagctgagggaggaccttattcattccaatttggactctgctcactcgtgttactcgttttcttaagactggactaaaattgtgagaccttatgggccaacgataccctttagagctgataattaatttgaaagaattattaaagcatatttcttgagctaagaatgcagtgtattcacagtaagaggcagagttaaccatttatcaagataattaagaaaatgcattaaatgtttgctccgtaagagcaagcactaaattaccagtagtagtaatattattatgtgaaagggaatcaatagtttgtttactaaaatgagatgcattagcaagcttttttattctgatataaaaattttcaaatatacacaaaagtatagagaataccgtggactcaaatgtacccaacacccatccataagtattaactcaggacccctcttgtatcagttttcaacccatccacatcctactccacccctccagattattgggaagcaaattccatatgtattactcgcttcgtaactacttcattatgtatctctgaaggataagactcttttataaaggaaaccattgtcacatctaaaaattaatactattatactgattctttaatattaacaaatatttactcagtattcaaattcatcacacctgcttccaagttttttaaaaacagttgaatcaggattcacaagaagtcacatactgcatttgttcgatatatctaggtctctcaatcaataacattttaacttccttgcaacttatttttttgaagaaaccacgttgtgtgtccagtagtgtttcttacatcctgcattttgctacttagggttcctgtagtactgtttgcatatttctctactactatatttcctgaaaactgatagataaatttagagagttactctgattcagggttcatatttttggcacaaccactttatagattgtgctatgtgcttccatcacactgcagaaaatatctgggtgtctcttttttggggatgtttctggtcattgatcagcattaatggccacaggtccatcattttatgggggctcccttcatagtaaactgcacagtaaactatacacagtgaaccttgtggtaaactgtagcatcctgtgtactatagcaatttactccatgttgcttttttcatttaacaataaatcccgccattcattgctcttccatctcagggttttcttgcttattattgcttgttaaaattcttccaaatcacatttataatcaagtcgttcagcactaaggaaaaaaaataacattttcatgaaaaaatgaaattgcattacatttatatattctcttagggacattgaaaataagtcttgctatttttcagagctagactttgagatttgcttttttgcagagtgagatagagaagtccttcaaatactgtcccttgaagagttaggcattgatttaaacccttttgaaaaacaatttcaacaaataattgaaaatgttctcttcaaagtattatcattagtcatccagttagattattattattaggaattctgaggtggtggaataattcattttccaatgtgttaacttctcatgagtttaatgtgagtataaaaagtctgttttaactgagggcagagtattcctttttctcttataatacaggagccagttacaacacaggaggtgaaatggcctgtttgcttacctgcaacttcaggaatttcatgcttagcaattaattgcagtacacacttgtgggggtaggggtaggaggttggataagtgggttgcacttaataattcagtgacaattacaaatcgtttcactatatgtgaaagtatttgaagtaaatttacctgaagatagaaaatatgggtgggcaagctcctcctgaactccccaccacattattctaggtttattgaagtaaatgtaaacttataaggggacataaaactcacacagaaaataataattagacatatttccacattaatgtttttaagtttaaaacatcatttaaaaattttatcactgatgcttgacttaaacaagtccacttatagcattgtcagaatctgtataagtatctcttcagggaatttttaagatgagagtgaacaattttctgagattgcctacacatttttgttacacagtaagagccaggttctatgtggcttaggtggggatggggctttgagtgaatcctctgttgtacacagacttaatacattctccatttcagcccacttttcacctctgttttcatcagacctacctcggtgaggttctagacttctgccctgctgcagctactcagtactttaggccatgacctccgctctccttcctcagcaactcaccacagaccttccggaaaaatgttaaacccttctcatccttttcttgttattggtttctattttctttctttcttttttctttagcgtcacaggggaagagctgataattgtattggctatatgtatcaactcaaacagagagacattacctgcagttctataaagattcccagattattccaatgggtattaagcttgaaaacatgatgtctatgatcctttctggttctgatattgtataactctcatcacttaatgaaagccaccgttcctatttggataaataagagaattgaaaaacgcactattagaactgagagtacagatgagctttccaaatatattagagatggcatcacagtacatggaaatgttaaaatccataacatgggcaagagcacatactagaaaagtgcagaacctctttagaagtgaagcattttcgttccatgcacatcaatttgctataggagttcagggacaaatagcaatatgggaaggaggcggagctcaacattgagcagaaattagacacatgctgttctcttgagagattaagaaagaataaatagaagagagtaagtcaggtcctatgagaaggataaagcattgtcttccatagagagtgaccttcattaatattttttacggcttttgtggagatcagcctaaggaaacagaagtcctatggccttattacatcattacagaatcacactttggctgggtctcttaactgtgtaacagtggtgctcaaaagtctctgtaaatctccaaaacacaatactctttagtagcatttcttagatttgtgattcttctggggacaaaggatctgggatacaatgggttcccgagtgcagtggtgtgatctcggctcactgcaacctccgccttccgattttcaagcgattctcctgcctcagcttctggagtagctgggattacaggcgcccaccaccacccccgactaattttttttttttgtattttttagtagagacggagtttcaccatattggccaggctggtctcgaactcctgacatcgtgatccgcctgccccagcctcccaaagtgctgggattacaggcgtgagccaccgtgcccggccgaggattttttttttttttaaatcaagacttagcaatgcatgttctagaaactgattctggttttcagacttaactaacatgggtataggtgagctaagatattaagctgcagggaagggtctagagtagctagagttcctgggctgctcacttcaagctatgaggtctcctgaacactggtaaaaaccccagtgctgtacaaatatcattttatcttagccatgatgttcaagattggaaagcataactctatgtgatgatcattgtccgttgcttattattttgagactaaaggattcttaagaaagaccctattctccatttccacactaaatgagatcaagttcttaatactcttcttattataggaggaacatctaattcaatgctacatcagtaattaaatgatattttgttaggtgacatgcaaatgagtaacaaatggaatatgaaatagaaagttccctttgttatgtaaattgtcaaacacttgatattgtttttaaagttatttgggatttttttaagacaccaagtttgtaacaagtgcccttcaacagaaaagacacttggatatcatgagatgttctcttaggttcctcaaagcctagcagtcatagcattttaatacttactagtggggagtctgccttccctgctgcacaccagaacagactggggtgggggttaatcatctggaaatgaggtattataactactgattttgaagagtctttataatgaaaacaagacacagttaataaaagtagcatagaaaacattagagagttattttattagggccattaaatatttggagtacagtacttagaaaatcactgttaaaattgttacagttactctctgaagcctgctaagaatactgctatttattacatttttaataatgctattcactacattttaaaagtttactcaaaaactacatgactttcaagtcatttaagaagtccaaaagaaattccatgccaacaaatttaattaattttgcatggaatgtgaaagaacccatagaaaataaatgaaagagggatattgttttgaaatgggactcattcagtcttctgtaaggcggtgactgcttttccgtgtcactgctggcagttatgttgaattatagaaagagtctgtggggtctctagtagaacttctcttcgtggattatttttatctattattccagagccaacacaggagctatgaagtcataaatccacattgtagctgcatgagaacttggccttatcacatatttgcatactcagtgctttctaagcaaagttctttatccataaccttagtgtagtcttatttttcttagtgggtacctgtgatctctaatatgctttgctatctctctttttgttttatatctttaaaaaaatctctatgtttttattttttctggaaggaaacaggctcacttggaatatttacctagattctctctttcacaagaacacgcagtattttgtattcattatctcattatctcttccctggttgtgtctttagaaaagaaacaatggataacagagggtaaaagagtttcagtaattttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttaccctgagataacttgtggcttactgtcctaaccttatccccaaagtttgccatgaaatatctcacttttattattatttttgcataggtctagcatattgactttggaaacaaaagacatcattctatttgtagcattctgtgtttgatagtagtatttccatatacaaaatatagtaattattgattgctgaaatcaaatcctagaaaatacagcattcctatataaaaaattattaaattctgatcatcatatacatttctgttacattaggattagagataagttttatttagaaataactctaagaaacgtttttatattttattttcacattgaaaataagtcagatttgcttcagcctcaaaaaatgtgtttatgtaaaattaaatgagagctggcagtgagctgtacattttttttcctaatgggacatgggttatgggttaaagatgtacaagctggccgggcacggtggctcatgcctgtaatcccaacactttgtgaggctgaggcaagtggatcacctgaggttaggagtttgagaccagccttaccaatatggtgaaactccatctctactaaatacaaaaaaaaaaaaaaaaaaaattagccaggcgcagtggcacctgcctgtaatccagctacttgggaggctgaggcaggagaattgcttgaacctgggaggcagaggttgcagtgagccaagcttgcgccattgcactccatcctggacaacagagcaggacgcagtctggaaaaaaaaaaaaagtgtaaaagctagaggccctggcctccacaagcccacaatttagttattcttcttctttatgattttaagaccttgtcaggaatactttgggattatcagtagttaggaccaagatatttcatattttatagcagagacaactctatctgtgcattttataagattaatccattggtatgtttcttgttgaatttctatataaagacattctacgtgatgagttgttcaatatgaactgtctaaaaaacaattccttatgaataatacctaaaaatgcataagtagcaaatatcttttatagtggttgatgtaacatattctatgttgttcctacttttgccctttctctgttacttattttactttgtctttattttaaagataattttatttaaaagtaaaacatttatgttcatacaaaaaatatagcagaatacgggatggaaaataaaagtcctcctcttttcttgactcctaaaggtggcagctttaatatgttcacataattcctctcccaaaatgtcttggcatattcaagcagttacaggcacatacatagatatgtgtgtctatctgcagttatacctatctatatgcctttgtaaatataaattcatcagtatttctcacctgcagtgatactcaataaaacagaatgctcaaagcccagacccctcaggacaaatatcttggctgtccttgctatgctggggtcaatcagatggtctcaggggagaggaggcatttgggaggttgggcagcagtgatttgtcaacaagtacagaagcatttcagtattttatccactagttgttccacaactgtgcctaaaaggctaatactaaccctactttgactcattcgatgggtgatttcccctccatggctctcaagcatgcatgcattcaagtaaacatcttgaaggaatagcatcagagccacctgtattaccgcattccataccaaatttttatatttttaaatctagtcccttagggtataccatagatcctatacacgtatgcatgagttaccatgtcaaaactatgaagcagataaaatttgtttctagagcatccctttcaggattccctctgtagctcagcagtcctgttaatcacattgtagtgagcctgtcctcccaattgtgccccaccagtgacctcatccacttagagcttagagctgccaagctctcatacctcatagcatttactagtcaagaacatatcatactgttttattattatagcacttttcatttgtctcattattacaatatattaacaacacattgatggtggaatagtaatttaaactaattcatatctgtctttctacctagaacattgtacataaatgtcattccataatgtttcttcactattcttttggactacattggtaaagacacagatatgcactaccacaaaacatctagaatatttctttttttacgtcttcaaattctatataaatttgtaaatagagcattgccacattcctctccattgtcactctgttaacagtaacaatacctctttatttcaccccttttcttgcatgtttaccttttgtaaagagaaggtacagaaacccttcatttaatgtgtttcaggttcaatccgttgtcttcataacactggaatttctcctccattattttctatttggggatgtaaaggaatggacatttattgaggatttactgccacaatgctagaaccacaatctgaacataggaatgtgtttatgttgtttttgctgtaccatactaactgcctctaaatggcacttttttgaggattatgtgatataagtaaacaagttttctaaactatcaagcactattcacactgggaatttctagcttgtattttacagtctttaacacagtaaggtgagtaaattggtatgtactattaataaatgttttaggtggtaataattataatggaactttaaacatcaggtgaaatgttgccaatgagttgttactaaaatccagtcttaatccatttcttttaaagccatggttgtcaaaacaaaacatcacttcttagcaaaaaattattagatatgaacctgtaatagtaaaatcatttcagagaacattataagattatagaataaaatctgaaataaaatctactgtagcatttagacttatatttgacataaaatgatgagaatatttgggaattcaatgttattgttgttgttatacttccctaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagaggtaagatgagaaaactcaccatttaagcacatttgatacggtgaaataggcctgtcagaaagacctgaatatatcagtaattaatgtcagggagattttaaaataggatttagcaaaagtacatttaaatgagttattaaataaaaaagaaaaacctgaggtgattagaattttaactaccttcatgtgtctcccatctccagtaaagatcagagaagaggaaataggtttaatctggaaagtcaatgattaattttacatataaagagactttctcaacaatgaggattgctaatgattagagaaggattggagaccttaaaggtggccttacatttgagggtactttggtctgaagatggagacaaaagaaatgaatttgtgaagaaatgtaatccacatgaaagacccaaatgaaaagtaattctttcaatcttttgatgtttttctgctgtcaccacatagggctacagtggggtttcttccctgggtcaggctttgtggaacagtaatgtgcaggaagtcttaggttctcagtgatgtgcaagctaggttacgtgcttagttcaaatatgttcttctccagtgtctgtcatcctgtggttaagattttagattcattcattgattttaagccacatattctaaccatggcttcagttgttattagtttattagttgtatgtgggggcggggaggttttttttttgtttttttttttttttgttttctggcttagttgtgtgttcttgatccagttacttaaattctctgcacctcagtttcatcgcccataaatcaggaataataatagttcttacctcatataattgtcaagaggattaaatgcattattgtatttaaagcattagaacaatgctgaaatgcacactaagtactctgtgctatttttattgttttgttgccattaaggaaataataaccattactactattatttttattattatccttagtcttctctcaaatacccaaactttgacttagtgactctcttgaattattcaatatttctttagtatgtttccctgacttgtctccctttagtatatgtgacccacctcctttcatgctacctaattatgtatatctccattgatactcatgtctgatattctctcccacatagtccacacatctgaagctagtatcatcatttatatttacattttcagaaaacccatattcacattctatcatgcccaccccagccaatctagggttatctctcaacacttctagggaaaattagggttttggcataaatctgtcagaccctcattaggcactatttttatattaatgtataccagtgcttcactatattttaaattccatgttcaaaaataccagttttggggaaaaacattccaaatggtactctcagcagaaatctcaatctgccaaatgacaaggactcaaatgcagtgagtcaaacagctgttcaacctgctttgtgcctagaggcatccaattcctggccagtttggcctgaggatatgggagtagggagtgcagaaagagttttgagttgaatttttattattttttatcctagattcagtttacataagactaataattctcaaacaatttaagactattctatacctttaaaaatgattcaattcagaaatttattaagcaatataaaatacacttcggcaggtatgtaacatgcgtgtcacaagcatataccctacccattctctcccttcattaataatggttctccattccttaaaccaagtcagcctgccaatatgaaacaaaagacatgtttattagttaattagttagtttctttaattggctatattgttttcactcctaaacaacacttactaaaaactgcttattgatggtaactattaggagcaactgactgaactgtctctgtgacatgtttccttacgtctatttgtcactcatggggaagtgaatgaaataaggaacagaaagtaattcaaaatatttgccatagaatgataagactgaagaataagaattaaattcagacctctcctaggctatctattcattttatatagcttactttgtggaatatgttacttttttgaatagacaggtgatatcctccaagactctcagctcaatgataatataactgaaataataattgaggtctctgattctcaggtaaatatttcatccataatctggtaaggattaaaagttgacttttaaaagttgacaatcgctaaacttaaaaatggttcagaggagatacaatattgctggatctaatgtaagtagaaagaatcctaattctgatatatcatggcatagaaaaagacacaaggaattagaagacctggattctggtactggttccagttatttgtgggaccttggtcaaatgatttaatctctctgggattaaatttctttaatagatgaattagttcaatgcccagattgttctaaggcagcatggtattttctaaaataatatagctttggctatcatacaacatttgaggatattctaaaagttttggatacttttctctaacattatccagacaaagtagctgtggaataaatctcactcgtcagctttagttttaaaattatgtactttcacataatccctggaatacaattattaattgtttatgttcaaaactttacagagaagtgacagtcaaataagagaaacaaacatataaaccagtaaataaaacatgattgcataagtactgtaacagtagtgtatacagagagcaataaatctccccctgcttgagtggaaggaggcacattgagaagataacttctcagaatatgggaaaaccagcaacaactcttatctcaaaagtctcaaagccaatatgcaaattcatctccaataatgcctatgtgttaaactcggtacatacagaatttacctccattgttgagggatattgttatcagatgtagaattctaggtttgcagttattttcttttggcacattttattgttttctgatttccattgcttatgtagagaatgcagctatccgattactatcttttggagtgacttttctctgatttatttaaatatttttttctttgttcttcagtagttttactatgatgcttcagatcttcactgcccactacaatagccactagccatatgtggtaattcaaatttaaatttcagttaatcaaaattaaattaaaattccatttccccattacactagccacatttcaagtactcagtagccacatgggactagcagccaccacactggattgggcagaaagcaacactgccattattgcacaaagttctgttgggcaatgctactttagattgtacctttttattttctacatatctgcaaagtgatgtctttcatcagttcagaaaactgttcagtcattacctctctaaatattgcttcttccgcattccctctgctctatgattctaattaaaaatgacttggaactttttactgtatacactatgtattttaaactctcttctttagttttcatccttttgtctttctgtatcttcattctaggtattttcttctggattacttctagttcattaattctcttctcagctatgtaaatattgctattaaagttattcataggattcttaatttcatatatttttcagtttctaaatttctctgggtcattttctttttttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggaaatctggatcatcttaattcaattttagggattcaaatttctgggacattcagatgattcaaagcattgctataacccagtgacagctgctttaattccagtatacgctcattcccatgctgcttatctttggagtccaagccagcgtgtgtgggaattacgaaagtcccacccatgcagtcctggaatccaacttttgtcctcctaatacagcagggctgtcaaaagagctgctcagtctctcagccatgtgtctggacaggaaaatgctcacaggacaaaagctgtcacaacgtaccaatcacctgtctagacatctcttttgtccttgatgttgagaaggttatcttcactctcttgatagctctcacatggctttaaacatatgtttttgtatatttatccagtttgtctagttgttgtcattgagagtgttgactcttactgtataatctaccataaatagaagcgaagttgcacatgcatttaattttttttattttggaattatgttaagtttacacacatgtatgaagattatagagaatcctcacattccctcatccagctatccctaggaataatatcttaaataatgacaatgcacatgttaaaactaagaagttagcattgatacattattgttatctaaaccacagaccttattcaggtttcattcattttaccaatttcattttttctcttctgggatccaattcaggtactattttgcatttagtcactgatctgtgacagttttaagagatattttaagaaatattttaagagatatttagagatattttatagactattattcagtttgggtttgcctgatgttttttcatggttaaactgggcttctggattttgggaaccaatactacagaggaaacagtttctcattgcatcaatcattttttattaatatatgcatatttttttcttttttattggtttatggggcttgtgcttctattaataggtagatttttaaaatgtttttaatttttatggttacatagtaggtatatatattttagatagatttttaacgtggacagcagtatctaaatatttactgtgatttgtaatgtatattttttactaagcattgaatggtcattttcttccagaccttcaaaatattccttaaatatgtcagaaataagaaaaacaagtccctccctctctgccttcctcccttccttccttccttccttttttttctttcttctttacaaacaggttctcattgtgttgatcaggctagagtccagtggcatgattatagctcactgcaggctcaaactcctaggctcaagaaatcttcctacctaaaaaatcagcctccagctaattttttaaaatttttttgtagagacagggtcttgctatgttgcccaggccgttctcaaactcctggcctcaagtgatctttccaccttagtcttctaaagttacagtcttctgagattacagacatgaaccaccatgcctggcccagaggaatttttaaggcccacccatgtaacaaggcattatgaaataaacatgtctcaattgttacacactagttagacaacaatgttcatgttttaggcttagaacattaatcggaaatagttttcttgtgactaatgccaaatccactgagtctaaagtttattacatttccacttgtctaaagaatttttgagacatgtgccaaaatctttagaacattagagctgaaagataccttaggtaaatttctcatcaatctattaaaggatattcaagcccccaatttcagcctctgtatccaaacttcaatactgccctatgttcatatcatcactggagaggtctggcctttccttatggcctctttaatcttaattgcatcatctctgatgttttatttggctttgtttgttactccagttactcccacctgtttcccttcatggtttggtttggccccttctctgccctccactccacattgatttcaagagatcaacaaatgttagagaactgggttcaactactaccaagaaagagcttaaccctgaaacctagcatcctaggcctgcacccaaagggagaagagaagctcattctgagctatgagataatcgtaaggtatcaagtctcagggcctggcaaaggagggataatggaggatataggcaagataataatatgactgggtatgtcgttatccaggctgcaaatagaaggaggctttgagcaaaagccttaaaacagttttattttagaagggcaattttctatcatcaatgccaagagaaggctcagcagggaccctactttgtcctgctttgagcaaatgatactgagctccctaataggagttgcagggtatgaagcaacagactgcaggggcctccattactttgaggccaaccacagggtagagctcttgtgggaacagctacataacatgcatgtccagcagtgccccagggaaccaagccatcgagagctactatcacagcccaagtgctgcctctgcagaaagcagtagcccagatgctattgagaactgcttacaagaactgccacttggaagcaccctgagaacttggctttacttggaaatcacctaggagcatttgaaaaatagctactcctgagaccagaacttttaattcattatatttgtcagaggctcattaagccctatgtatattttaaacaagtactcttggtgattcttatgtctgtattcctggcttaatgttcagctatttccagccttttaaaccctgtaggagaacagggcaccagttatttagggaaagaatattggtcattctaactacttccaactgaagaaagagactaactttttctgtcaacaaatgtgataggttttggtggactgagtctcttggcaggtttgagttgagcaaataaacttcgaactaaaactaggttattgatggtcaaaggggtatctgagagaagaatcacagtaataatattgaggaggacgaactttctagatggcactgctttagagatcctagaattaaaattataatatttttctgttgtatgagacttttccctttctttgactcacattattgcttttaatttatttggattgtcactagactgctagctaaatattcgtggttaccatagtgattttgcttccatttcctcatacagaggcctttaagttatttacatatnnnnnnnnnnnnnnnnnnnncaatggaacttagattcactttgattctgctttgaaacatggcaggcttgtataaaaatccctggagaaaccatcattaaatcttgaagacacttttttttttttttgtaaactgtatgtagagctttgatattattttgatttcctatgtgacagaattttatatatacagacagaatatttttcttcctcttttcatcatctgacattatggtggtccttagaattgcaaatacaggagaaggaagacacaaacccaagactgtattaaaaaatgtttcagaaattctcctttgatataacattgttaaggttataacatgattttgcatgtgagtttgtatggaaatgagggaatggaaatgaagacctagcctttctcaattacccttgcaattgttcctttagggagaaacagcggagtattactaatttgtattggttttcaatagaaatttaggtaaataattatttggggtttcaggcttcctttctctaaaaataattctttttagaccaatgtggggccaatcagtacctggagcaacaatattaaagtacctccttacagtgaggtttatatggagtcctctaaaaaatgaaatgtttcaactctggttggaatacacagagcagctgaaatattttgaaatgacacacacataaaatacataatttatttaaggtaatttattgttatattttaaaaatacatctttttaataaaataaagataaaattaagaggattatattcctcctttttctttgttgatcagttactagactcccttactcctccaaaaaaaaaaaaaaatatatatatatatacaatgcccagaaagtatccacaaatccctgttaaattaatgcagtattgttgaaaaacaaagatggccagagaaactgaatgagaatggaatcctgaggagaaaacaccaatatttaagagacctggttctctcagtgttgtggaacaggatccactgatatggaacagaagggtaagcttctgttaagctaggtaaggaagcttagggttgtgaaagaaggtacaaagacactgcacactgacttttggggaattacctggatttggctttcaggtagctctgccaaggattaacaatagggttcagaaagaagagtaaaccatctaatatgtgccccagccagtttacgtggttataataacgatcaaattagatttttatggcaaaactctctttaacctctacgatatgatagtatttccagcctttttattctcaaggttcagtagctaacattggcttaagcccactcctaactatgaaatgactgagctggctcagcctggaatgagagtggggagcatgagagggacacagccataccacatgaggccatggctagggaaggcagaggctactgaacaagactgaaggaataagcaaagcaaaaaaccacaagcttgctgaagttggaggaccagaaggaataggtgagggtctcagtgctaatgtagggttaatccagggccaagtagacaaaaataataataaaaccacaacaataataataataataaatgatggctagcatttgttgcacatttattttatggagggtgttaatctaagaaatttcccatgtataaattcatatatactaatacttgtcgcattttacagttgagaaacaggtattacagagaggtcaaataactttcccagggttccacagctagtaatttttggagctgtgatttgaattcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaacctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgttagaattttgtttgctttaataatttttaaagtgactttttgcattacttttgatcattttactcttagcttattttgagcttttgatgtctaaatataactttgtttgtctagtgttttagtgtctttagtcattgcttctacatggcaataggaaatatgaccataaaaacctcagtgaaagtaacccacatttagagaaggcttgtattccttaatcccacccctctacacaccccacccattcaacccatctgtagcctccctttcagctgttcttaaaagaccttcccttttaagggaacttacattttcccttcaatactaaatcccaaaagctaatagcaatacagaagatccactgaccaacatttcttcccaagacaataatagtaacttatatgcataattgttaaagcaattttaagattttgttttgttttttgctatccaagttcctaagacatgttattcctctaaaagtttactatatgaaatgattgactaatggttgaacaaatactataaacacataaggaaggtgatatgggttttactcacagaagattcctcaaaacgcatacctgatttggttttaataaggatcacattacaggagatccaatagaagctacttaaaaagtgttttagaaaatgtttttaaatattaatttgcatccattataacattactatttgaatttaacttccttccaatatacctgtagaatgagctattgagtttaacttctttccaggcatggttatggagcctgctagtgtgtgggtgtcccggggccacaccgtattaaataggctagtgataaaatggataggacaagatttctcatcaggaacatttttaaacacagaatctgttgattctgtgttgggggcagaggctgggagaaatagggagatattagtcaatgcattacttttataagtgggcaacagaacccatgttgtgtggtcaaagtactgcagaacttctcaagcattgtacacgtttcagtttttgactacgactttaatggtccacaagaaaggcctctaagaatctttttcgtgtccatttctataagagagaacataatgctgtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggttttaaatgacttaaaagatatatatttctccaaactataggtaattatatcaatattactttgacagagatatagtaattctccatcttatagtaaaatttatgaaaacattaagtaaaccaacaggtaaatacatttttggtcaaacaaaactttaaaaattatgtttttcttttatttggctcaagctaattctttctgttatttttattattaattgactactcaggtaaaattctatctgaattgaattgacatcattgatcccattgtcagaaaagacagccctctatcccattcaatttattaaactgctaatcttctggacttttcttcaaagcttgtcagttttgatccaaaaaaacttcagatttcattgtgtggacctgttacttcttgtgtgaaaaacagtatggtttcatggaatccactcttggccattgttaatattgtacagataggcacacaagcatttaaatatgctagcaccttattgcaaaaaaaaaaaagttctacttatattcattgcaatttattatagaaaatgttttctgaactgaaaattataaactgttgtcaataattcaggtcccaattctgaagtgtattgagattaccaaactgtgaagcaggaacaatatttattctctacataaagaaagaaaagaactattaaatgaacttgatattataagaagcacttcaggttgtcaaaactcatattatgacatctataatctggcctaaaatcacaagcaaacattccatgatggaatggcagatcatgctagatttgctggttattatcagttttattttacgttacctaagtagagtttaagcctttcagttaaaatatgactcccaagcaaaaggaagaggattaatggattaactattgtttgtgttatcaataatattggcaataactatttgtctatggtgctgtgtcagttacaaggcactctgccatgcattcttccatctgatcctcaccaaagccttggagatgcttcaagccaaaattgttattattctcattttacagatggaggtgaaggaactgatttgaggtcacactgtggtaaatgttcaacactaatctctggtccaggtccagtccagatcttctgatggcaaaccttataatcattccacttcataaatggaacacttaggtccaatcagtcattttctaaatgtgtatttactgttggtcacaagagtttgtgtgacactgtgtggataattaaatgccatccaccatctctactcggaaaaacccaagggtgtgtcagttaatcagtcttaacaggaaagataatgtactattatcattatggcaaaagtacacttgaaaatacaacaaaggatattgaagctattaaaataagcttcttatccttagggaaactatttcaacactagagctatcatcaaaagtccttgagacaagtaacccaggagtggaatggttatgattacactttataagcaaacttaaaaagatatcaggagctgctttactaggcccctgctatgaagtgaaaactggagaaaaatctacagcaaagcattctagcctgaggatgtgtactattttgcaacacagcagactgactacagccaaatattttcattggaaaaatgtaaatgaaaaatgttgctcaattctgctacctgggtagtacataagacatgtaatttaaattctaatcagggataacaaaaatcctatgatacttattttgcaaaggaaaatggcagtcctggcaaggttataagttagaaaattatattttctttgtgtaaatttgttctttagcttcattcagtaatcagaattatttatttccttattcaaattgtaagtgccttctaaacccgagcctactactattatgttgagccatgggaaattgccaatatttgactattttagtccattaaaatgcagtttcatatggtttaaactaatatgtgccaaagcatgaatagaaatacttgcaggaatactgtcctaagtataacctcagatgcacacagtattttagcaaaagtatcaatgggaaatcaggcaagtcctttcactgaaacaatttataagtataataatttattttgtgaaggccttttctttaccaaattagtaatatggtgaatattaaactaaacctgagtcatactacatttgtttttaaattttgtagggaagggggaaatagcaaataatattttatgctagtaatcaggcattatatcagttgttgtaaggaactacatgaaagttggtggtatacaggttaccagtagtaagtttgggaactgtgttgttttggctcacagaatataaagcgtgtatgtatatacctgtgtttccacatagacacactctgttacccttatatgtattgtataatcacatgtgtagatgttcattgtatctggagtgacagttgacaccttttaggggcattttacatgttttaaaacctgacatccacttacagcacttatctactactctcttcaggataaactacctttattgcaagacttttgctaaaaattcttagattatgtcaagggaaaaaaatcctctattgctttttaaagaaaaaattatcagaatgatttaattttgtgttattttttatctccacattagtttgttatttcagtggttatttcagttaaagacatttttctcttccattatttcaatttgttacattgtatccatttatctcatagaaagataaacttttgtgttgaattagctgtggaagaccagctcacacattaatcactactaagcaaatgcgttacaaaaaagagaggacaacaaaaatgagctggaatacagtttcagttcaaccaccaaacgatttgatatcatgaataaatttcttgggtatatgtagccagtaagtagacctcaacatttagctatttttttcaataaataaatattgagcactgtctttatggcaaacactgtcttaggtgcaggggataatggacattatgcttttgggggattagataagagaggaaataagtcagagaaaagatctctagcacagaaaagtctggttacaagattacagagagagagagaaaaaaaaaactgtagtgacttgtctagggaactgtgtggttgccacatagaaaatgtggaagggagtgatgggagacaggctatgttcctagcaattgccttgactcaccataattatttcacctactgaataactgaataaattgagtagagaggctgcttgtaccaaactgtaaaacagtttcaggatgagaaaattacattttaaacatacacttagggaaaacaaaaacaaaaacaaaacacctgccttgcagaaacatgtcatagaaacagattttaggcagaattatttccctgtacaacaattgtgattaagtaaatgttaaaataaaaagaaggatgtttagcagcataaggaatagaaacatttggagttttagctttagcttatacaatgcatcctgttttataattgttttccaacaatgtttacataatgtgagggtcactctttaacatgaggggctctgtcactagaattgcagtgtgttagcccctcattttctccagtgtttttgtaaatctttccattgacaatcttttaataatttccaaaacaatcgggggtaatgttcgaattctaagttcttgtcataaatgaatcaatccagttggcaggagatggatgtagtctttttgctggtgttccgtgctaagaaaagcacacacatttttcttgagagtatggctagccgaaaagcatctgagaattgatggaatcctaaggcagacagaaacgccaaaagtcaagtaactggttttgtctccagcacttacagtttgttgtctgggtgccatgacataccctctactagttaattccattaagcaacatgggccatttaaatataggcaaaacaacaacaaaacaaagcaaacaagtaaaaactctgtgaccacagaaagagcctgtaacatagacagaagactacaaatagtgttcttagaagataaatcattaagacagtagcaaaatgagaaggaatagtgtcctgggcaacataaagtgtgtgtacccttctacctgcacaaacactcaactgaaatttgccaaggctcactagtgtctttgaggcaccctagagaggggaggctagaaataaccatcatcctcagctgttccatggtaaggccctacactaggactcagaggagagatagtttggaacattttatccctatcagtggaaaatagcacagttggtgcctaacttcctttcgttgaaaataacacaggtaattttttagccaaatgagatttttatcaaaaaagcaagcaaaggcagaatgtgaaaaggagctgatatcagtaattccaaggatactaaaatttgttttaaataataaagaaatagcatcttcaggccctttagactttggactccaaaattggatgcagatcaaataggatatttatatattaaaaaatcccaagagaacttgtacagcataaggtaaatacaaatcaaggttgaacaggtataaaataattaggtcaagagcaatcagcaaaatatatgcagaaccaaacaatactttgatattctggtctggaaagagaatttggggttattctgaaaaatactgtcactacaactctgtccagaacccacagctgcagaaatgagtaaacaagtcatcttattagaagactgcaaggttaaagaacagctaaagattcaaaactaaatgacattcttgttagttcccattgatacgattataactcacacaattccctaaaggaaaactacaaaaaggatgtttcttgagataggaatacaaataaacttttgcttgtttgtttgttttgttttaaatccagtgataagaatgaatgttttctgtatttgctttttttaaaaaaactctatattttatgtgcagacatttaacataaaatcttttcccaatgtctttcttagatgattaggtagttgaaagacgctactgtttacgaggcattgctaaaagcttttgggttccatgagggagagggccatgacatactcctttgtacatttccccactcctccgtttacatcacataaacatatatgtatggtcttccatgcagtcagccaaatcagacaaatcatgcctaggagttgaaagtgggaactgatttgtctagtttgaatattctgattagtgaactagctagcttagaattttgtggtatttgcatatgtcattcatttatgtactacagctacacctaaatcccagaaaaatcggtaacaaaataacctattattctagatttaaattttaaaatccacataagaatattaataacacaaattatttgtatgacaatgacttctatttttttcatttcaccctcagagatctatatacttcctctatccaaaaacaacacagaagcaaaatgttacagagacaccagaatgttgcccagaaaaccatgcattaattactcaagccaggaaattcccaattttgcaactctattttatcatttaagagagatctttccacatgtgtgttctaaaaaagaacagagaaataaccagtcctctgtaacttagcaaaaatacaaattggtgtttccactttgatttctctttttgaaataaattttcagcttgactttcttttgcctcgggtattctggattatcattttgtagcatctggataattttacattaacatctggagttgagggtctttttatttgtcggatgcatatagaatacttctgtaagaaatgtattttcccagctgctgtttattcattttaaagagacatggttaagtaagtctaacagcctccttaggaaattcaattcctaaattccttaggaaacacaaaccatgtttaatctgaagtcctgccagtctgttttctctcctaccagcttttcccatggcagaaatggttgagatctgtacagaaggaggactttagtctggtaacaggtggtgttgctgagtgcaagggcctttgaaatcaggcctggtttggaatcttggtccagcaatcaatagctgtgtaatcttaggtaactctttgaagtttagtttccgcatctaagaatgaggaagtataaatacatatctgcccacgttggttgtattaaatgagatactttacataacacatccgactaaggtgcagatgtaataaatgacagctgttattatcatttatttcagcacgttgcagaaagcaacttacaatttcttcttttcctgacctcctagggcttttatgcatgcaattagcaatttgggatttgcacaaggtttttccagagtacaagatttttgagagctgtgactgaatcttattctttagaaacttgctctttgagtggaggaaaaggaagaaactaagttgactaatgacattataaaagcaggtagagaatcatttctttctgagcttctgtagcacaggctatgaagtgtgctagtaaagtaaatacaattttaagcaaagtttcagaaatcaccataataaaataaagtctgtaagtcccagctattaaactggcagggacctacattcattaaattaaatgcaatgtgcaatgttgttcgaaagttgttcaaaatgtttttagaatttttcttggagttgattgcttttataatgatgacttcacgtcttgactctcagtgattttgtttgtctccttagccccaaaattattcaccttaaaagatgaaatttggtaatattaagacagtcaaaggaatgtcctgaagttctgatcacagctatgaatagttctaaaatcttctaaatatttttgggatatgtatagaaccaagatgatttgtgtgaagggtttttccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatccatagcaaggttggtgctcaataatactagatgagcaactgaatgaagagatgacaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaaaaagaaaatgttaaattagctagtgtctgacaaagaagaaagctttcaaactttcaagacgaacattttattagcaatgaattctcagagcaaatttaatgcagtccttatgtaaggatgtcagatagaaaaaagtaaaaggatttcaagcatcactagtgcaaaggacaatattacttgcttatttctgcagtgtaacaaagatgaagatattctcttaaattttttactcaatgatgattcatgtgtctctgagaaactaagataatatgatttaattctgtgcttttgggatagtctaacttaattcatgaaggagtacaggggatgggcgctttgtgtgtccactttgtttgtcactctcaaatgtcagatgtgcaggcaaattctcagagttaaattacttgacaggaacttaagcatccgtatttgttgccaggtagtcttctgtgtggttaaagtacagaatgtactcctacaaaagcagagaggcggcccgttgccacacaaaagtgttttttcagatggcttatggttagaaccaatatatttttctagcatacagtttgagtgataatagctcacattccccgatcacatgccttgtgccaagtaccattctaaatgccttgcatcttgtaactcattaaacctttacagtaacctcatgcaatgtacactcttgttgttcccattttgcaaataagaaaactgatgggcaatattaccttgcccaagtttatacagctggtaagtggcagagtcaggatttgaacccaggctgatggtatagtctgcgtgctcagccacaatcatgaacttaccctcaaactgcctgtgtttgcataatcatgtggatactacaggatagattctttagactcatcttatgtaggaggaatagtgacatgaaccatcataagaggagcattaactaaactttgcttgtcttacccatgaaagaacatcagtgtgactccctgccaaatatctgataatgaaaagaaatgcattgtgatcagcaagataaaatgaagaaaataaaaatgtacactgaaatagctgaacgaatgaattaacaacctattttatagcattgtgctggagaagaatgctcatcttacagaggtgattgtgtctaataaaaactgcactggatttgaagtaaaaaataaaaaacaaaaactggatctaatttccaattctatcactcgtagtctctgtaacctcctagtctctttcactgggatcttagatgtgccttcttagaagctaaattttcttatctgtgagttggtttacgattccttcttcctctatccactcactttattgtgatatcaaaataagatagcatatgtgcatatccttggagattttaaagctatctgaaaatgtgccatatttaaacatactgtacatagttaaaagacatgcatctgattaatgtaaaaactataccaatttattgtagtccacttggaaagacaagtagcttacttaaagatctattttgttgcatttaaagttggaaatgaacctgatataaatctcttcccaactactgtgatcctgtctttaatacaactttaatagactggaacatatgccaagagtatacagtcagaatctctctaagaatcaaagactgatgagaaacctctgaaagctgtgaaaagtgtgttattgtttttaattgcttccctaaagaatgagagaaggcgaagctgggaccctagtggtattgatgggctgttgctccttatccatgatgtgtaagagtgaggaactaagtctgaaaactttttaaggggaaaatagcagtatagcatactgaaagttttgttgtaatatttaaaaatgccaattaaaaaatagtgcaaaattgtataacgcaattatatgagaattgttttgggatcagcggtccaaagacaaagaaagtcccctcttctctccatgttcttttcactgctagcagcaattaacatttggcatatatcctcctagatttcattttttatgcataagtgaagacatatcaataaaatgtgttcttgttatattacatagttcttgttttaacacaagtggaattatcctctacatggtgtttatgatttgtttttgcacttatgaggttgtgtttaaaatgttgtacatttttttaattttagcattggtaaatttactttgtttttattttaacatagtattccactgaaatgtaattatactgcaaattatttatcatatctccactgacggtccttcaggttatttctaacttttcttgattataagcaatgttgtaatgactatcttgtacaagtatgtttatactcttccattaatacttatgtaaataaatctgataagggaaattgtaggctaaagcatatattatacattttattttattttttattaattaattaattaattatttatttatttttgagacggagtctcgatctgtcgcccaggctggactgcagtggctcgatcttggctcactgcaagctccgcctcccgggttcacgccattctcctgcctcagcctcctgagtagctggaactacaggcgcccgccaccacgcctggctaatttttttgtatttttagtacagacggggtttcaccgtgttagccaggatggtctcgatcttctgacctcgtgatctgcccacctcggcctcttaaagtgctgagattacaggcgtgagccactgctcccggcccacattttatttttgatatgcactggcacaaaattgtgtgaagaaccaattaataaatatgtctaaggaatatagtttccattgttttaattatcaaaaaattatcacttacatgggctctagttatacccatgatatgaccaatttaagaaacttgaaaatataatttctagcacgtgtatactaatgcgagatagagaagttttatttacaaccagaaattgttgggtccataaaagaaacaaatatgtctagaacattttaaagttgccagagcagatttcaagatattccagcctgagtccctcagatatgtattttggtgattgtaaaaatatcaaaagaaattatttgtgtccgaaagtcacaatatgcgtgagtcatcaacacaataagataaggctaaaattgagtttcagatattttgggatttctgaaaaaaatttataaaaatccataatgtaatcatttgtaaaattttaaagtttatcattacgaaaaggaaagtcaaaatcaaatgaaataaaacaagctttgttccatgggatagtgtcagtcataaagacttactagttaggtgctaattcattttgagcttacagggttttatcaggatcagactaagtaaaaatgtataattattttataaataaaaatgttttggggtttcagatttaaaaatcaagagtaagaagttttacaatatttactaaagattacgattagtataccacaaaacatctgaactttagatattatttatgtgaccttaaaagtcagacctttccctgccaatgacttaacttctgtctttagtgctattttgtttgaaggcttatttatctgctatgaagtgatttttctacgactttctacatgtctcttcacattgggttaggaaatcttcaaggaaattaatatcctcgggtatacacaaccttttgctgtggtatttgctctgacatggaacaaaggcaaaagatacgggaaaatgtagaagtgggcattatagaagaatccaaatgtgtctaatgtcttcttcatactaattccttctagcctttatttaaaaaatagcttctgaattgcaaggatatttttaagccacatgaatcagtatgccccttcagctggacttttcaaggagcctgtgaatgctgaaatgattaacattatgtgaagctaaattgcactgaaccgtggaaccatgtggtgtggcaatagtgggtggggagacatattagtctagaggtccctgctgagcaaaagacaaagacctccttctccattgtcccgcactgatggtgggcttgggatgtattttcagaaataattatttgcagggaacttacaaaaacaaatgaatcaccctcatcactgtgcttgttccgttttgggatgtttgtctactagactttctaaattgggagatttagaaattcagtaagaaagatatttaaaaaaattttttgaggtcctcagtgtcttctgcaagtacactttcaatttttattacagacagactctcttgatgctgttgtttaccattgcatttttatttaacttgaatattttaatttagcatgagtcattcccatggattagcaactttgtatgctagcatatctagttgtatcttctgtgtgttttcaatggtgtgtctgctactccaaagatcttcctgaattttacatattagaagtggcatagcctcatgacactttatatcaagcaggaagttctggaagatgatgctaacaaatacctcaaatctggaaattgtaggctttagaaaaataaagtcatcttgttagtgaatctctatattagactttctaataccttataaacaggttttcagaaattaattatatttatagcctcgagaaactagggaaaaagctggatctcaaagacattattacaaagcagtagtaaattataaacaatatattttgaattcataattaaaattaacgagtcaattttctgaggcattgacctattaaagatttatgagttacctaaaatcccaaatcttccctgaggtaatagcttcagttgagataaagggaaggtatcttatttgtcgcttcactgcaggaaaaaataaaatttgtgattatgactcattatcatgatgcctattgcaaaattacagctcactcttaaaattatgtgaaaaaagatcattaaatgttttagacatttcttaaaacttataagcaaaactttcaagttttttaaactgatttactggttgtatatgtagctaattgactatgaaaacttgaagcttaactctttgtagaccttccatcataccattgctttataaattattaccagaatattgaaggaaataaacttttttctaaccatatttatgcaatcaatatttattaggtagtttttgagaaaatcttatatgagaacttattccttgtataccaaatgtttcatggaacaccaccagcatagacatttttgtttactctgtgcaactggatttcgttctggggagcttcaatttgtacatgagctcattttcacaaaccatcttaccgatacttagagtccaaagtgaaattcaggaactatggcccagcaagctttcatgtgctattctttgcttcatgactttggaaatctatgggagaccctgtatcactagacagaatactgaaaagcaggattacatatgaagtttaccatctgatttttttcctaagggtttttacatgaacgtttattccttgtctttttgtgtggattcagcaatctccaggtttactgaacaggggttgtgaagggcagttgttcacaactgagctcattcccactgtgttgatatactccggttcccccacatagctccaccccgctaactcccaacctcatgcatagctccaccacactattgggcttgaatctaggctctgccactttctagctggttcctgagcaagttctttaacctctctgagcctgtttcctcatccacaaaaaggatgaagaacaaaaaggacgaggcaataccttcttaacactgataattaaataagataagcttaaattataaaatcagcacagagggaatgtaaattggttcaaccattatggaaggaaaaaagtaggaaggttcctcaaaaaattcaaaatgggactgcgaggccgggtgtggtggctcaagcctgtaatctcagcactttgggaggctgaggcaggcagagcattttgaggtcaggagttcgagagcagcctggccaacatggtgaaaccctgtctctactaaaaaacatccaaaaattagccaggcatagtggtgcacgtctgtaatcccagctacttgggaggctgaggcagaagaattgtgtgaaccgggcaggcagaggttgcagtgaactgagatggtgccactgcacttcagcctgagcgatagagtaagactctgtctcaaaaaaaaaaaaaaaggaactaccatatgatccagccttctcacacatatatatatgtgtgtgagatatatatatatatatattcaaagcaattgaaatcaggatctcaaagagatatctgcatttccgtattcattttagcattattcacaatagtcaagatatggaagcaacctaaatatctgttgacagatgaataaataaggaaaatgtggtatatacatacaataggatattacttagccttagaaaaagaaggaaatcctgccatttcaggcaatgtggacaacatgaaggacattatgttaagtgaagtaagccaggagtggaaggacaaatattacatgatatcatttatataaggaaactaaaatagtcaaaactcagaaacatgagagtagaatggtagttaccagggtctgggttggagggggaaacaggaaagtattagtgaaaggataaaaagttttatttatacaagatgaattaagtcctcgagatctactgtaccgcatagtgcctagacttaacattactgtatcgtatgcttgaaattttcctaacaaagtcaatcttacaaatgttcttatcacaaaataataataataaagagagtgagagaaaacttttggaggttattgatatatatgtggcagagacggtggtgatggtttcgctggtgcatacttatctccaaactcattaggttgtatacatcaaatacgtaaggctttttgtatgtcaatcaacctcaacatgttttttttaaagcagtatagaaatacctattttttaaaattattacaactgaaagccttctaacttgtggtgttttcttgaaataataatcgtatcttggttaatagttgagatctaaaagcttaggcctaaattcagatagaaagcttggcacatctgttgtaagttttgaaaccaggtgcacagaccatctttgttccagacgatcttctcagggatgtttgtaaagtgaacagccttggaaggtagagatgatgtccccctgggaagcaaagggtaggtttactcatagcttgggaagagagagatggtgtctccctccagatgaggggaatatatttaccacccataagaaaagatttgaacccattaagctgagggttcctcttctgtaacaccacccactgtgagtggaggcatcagctggcctgctttctatctctctgcaggaagtagagcccaggcaactggcaccaaatatgccaaagcttatgctgcttcctgggctgtgagtaataaagtcccttttccctcttttagaagtctcatatgttctgtcagcagccaccaagctgtgtcaggctaaattgctgtcttgcaagtagaataaaatcccagaccctttgcaatctttttcataaaaaaaattttaaataccatatatttaccgcatacagttcagaattatttattaatagtatattcacagagttgtgcaaccaccaccacaatccaattttagatcatttcaacaactcaaaaagaaaccttgtacacgttaagtgtcattcctgtacccactccctgaaaatctgcttgctctagctgtgttggattgatgtcagaacacaggagggaagggcaaatgcaagggagcaggtaagaggctttcacagcaactcgggacaaatgatagtggcttggagcagggtagcagcatgaaagtagtgagaagtggcggaatagaagatacattttcaaagtggaaccaatagtatttcctgaccaattggctctgccaagaggatgtgctgatcaattttccgtgaggtgtgagaatgagatggctgagggatgagtccatggttttggcatgagcaaagggaaggattgagttgctttgaaatgagttggggaagactgtgggcatagcaggttttgacagagaagaataggagttcagcattgcatatgttaactgaaaatgtctattagacattttggtgaagctgaatagatagtgtatagtattctggaattcagatgagaaatgctgcttaaagatacgaattagagaatttaaaatcatgagactgcataatatcacccaggaagtacaagaagacctagaaaagtaacagtctgagaactgagctctaaggaacatctacctttagaggtcagagagatgaagtagagcttgtaaaaccaaggagcaagcacacacagttttggacacagagatttcccataagagcattgcaaacgttacatattctctttgttggatgtgaaaataatcttttgggaaatgtgtgcttagaccttgatgtgatgcatagggacaaatttctaattctatttgcttcctaagaaaatgaaatgttactaaataaacagcgtcagggcaaggagtccaggtccataaagaaaaacttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaataaaaaataaaaagccatcaaaaaacgccaggcaaaaatatgtgatatacttatacccatatttaaacctacaccataaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttctttttttgagaaccagaaaaacaattatacttagatgggccatctaaaatgtccttccagcttgtggagtaggttgtgtttgtttttcaatgaacatctgtttgacaaattgaaatgctaattatgatttatcatttccatgacatcaaatatccagatagtaataaacgttgatgactaactatatttttcagtttcagccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaagaaagccagaatcaaaacccaattttgaatatcaagtgttaaatatgaatatcagaaactgaatatatcatcaatacaaattttaaaaaaaataagtttgtaaattcagagtttatccctcagatgttatttcaagcatatatcatagtgacatatccttgaatatatatttaagatccgatagggactgggcacagttgctcacaccagcattttgggaggctgaggcagatggattgcttgagctcaggagtttgagaccagaatgggcaacatggtgaaacgccaccagaaaaaatgcaaaattagcaaagtgcggtggtgtgcacctgtagtcccagcgacttcggaggttgagctgggaggattgcttgagcctggtaggcagaggttgcagtaagctgagactgtgctactgcacttcagcctggatgacacaggcagaccctgtctcaaaagaaaaaaagaaaaatctgatatgataatttagaatatgggtcctcagggccataaaacagcatatgctagtttgttggcttttactcaccatgctgtgcactaaaagtaaaaaaatataaagtaaagcccattcttttaactgagattttgtgccctttgacataatctctccattcccacagccctcagcctctgtaacttctatttcactcactccttctaagaatttgattgttttacatttcacatgcaagggagaacatgtaatctttccaaatgacagaattttcttttttaaagctaaatagtatttcatcgtgtatgtgtacgacgttttctttatccattcatctgttgatggacaggttgatttcaaaatgtggctaatgtgaagtgctgcagtgaacatgggagtgcagatatcttttcggcaaaactgatttcacatcttttgggtaaatacctggaagtgagattgctagatcgcatcgtgattctacttttagttgttttggaaaactccatgtagttttccataatggctgtactaatttacattcccaccaacagtgtacaaggattctgttttttccatattctcgccaacatttgttatcttctttttgatattacctattctgacaggtgtgagatgatatctcattgtaattttaatttgcatttccctaatgattagtgattttttcatttatctcttggccatttgttagtcttcttttgagcaatgtctattcagcttccttgctcatttttaatttttttttcttcctcttaagttgatggaactctttatatatttgtggatattaactttttattgaatatatggcttacaaatattttctccacattcatagtttgtctcttcacattgttgcttcctttgttgtgcagaagctttttagtttgatatgacccaatttgtttgtttttacttttgtggcctatactttgggggtcaaattcaaaacattattacccagatcaatgtcatatactttctcccctgtgttttcttctagcaatttggagttgctggccttatacttaaggctttaattcatttcgaattgagttttgtatatgatgtgaaataaggggccaattttattcttctgcatgtggatacctagtttccccaacaccattcattgaacagactatccttttctcattgtgtattcttagcatctttgtcaaaaataaattggttgtacatgcataagttgatttctgggctattatgctgcattgacctatatttcttttttgccagtaccatgctattttaattaatactacaatagctttgtagtattgtttgaagtcaagtagtgtgatatctttatttttgttttgtttgctcatgatgattttgactgttcttggtttgttgtggttccgtgcgattttaaaattgttttttctatatctgaaaaatgacatcaaaatcttgatagtggttgcactgaaatctgtagattgctttgggtattatgaacattttaacaatattaaattcttccaatccatgaacacaggatatctttccatttattcatgccttcttcaatttctttcatcaacattttacagtttgcagtgtatgcagatcttttcaactccttggttaaatttattcctaagcatttaatcttttttatagctattgtaaatgggattttttaactccaagtatatttcatagatggcattgatacagtaaaatcctttattctgtaaatggcatttatatagtaaaatcttttccatggtgaatgattattagtcttaagtgaaatacaaagatttgattttataagtgaaatatttcttaagtaaactatccttggctgccagtttctttcttaaaagtttaatatttcccagcaacttcctgtggttgactcttaaggatactgaagctgaaaggagcccagcaattctgggtgatggaggaaatacgtggccaggctctgctgtccgtatcttcctcaattttcaacttgaattttatacttctactctgacctttaatttttgtgatctaatttccttttccccaataatatttgtttttgaactagtcttcctcatgccatttaaagaaaaatttcaggaataaggaaaaacacaggagtattaaaatggagaaacatcaatattgttataaacagagcaccccaaaataattattttgaaagagatgcactcatttgaatttataaactctggaatgcttattttaaaattaactaatgtgttaacctacatacaaatttgtatttttacttgaaggaaaagcagcattgctggtagtgcacatgtgcttctgtacatacagattgtacacattgaggatgatgtttatgccataagagaatcatttcctctctttttatcagggccattacatcatttctcaaatagaccactgttaggaagtagggatatataagtataagggaggagactcaagtaaaaccagagtggtgcatatcctacaaattgagaataaggcatattttatcttttaaaataacatattttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagattccgtctcaaaaaaaaaaaaaaaaaaaataacatattttagagactcagtaaaataattttaaaggggcagaagtacagatgtagctgttaggaggaagcattatttcagctacagcacattattggaggataggaagagcatatggtattccagtgaaagagcttaattataatagagcagaaaggattagaaacagaaaagaaggtggattatcaggaataaagtcaaagaagggactgaatattgatcagattttcagaaaaacctgcaaacaaaccccaccacatactagcactagtcataggactgagatttgtcaaagctagctctcttctggtgcactctggttcactgtgaatataagtgggccatagagtgtgaccattgtggtctctggccctaggccatggagtgagataattgagacaagagaagtctgtatatcatctctccacataagcaatagagctgattgggctgcctgtaaacaagattttagagactcacttttctttttcttaaaagactgccacacttagccatctgatatggaatggcatctcctcttaatgagcctgtgtctttatttgcaccttatcaaactgggagatactgaagatggcagtgatgctgatagtggtgagacatggaagatgtagaggaaacctacaaagaagcctgagataggagagaaagggtaatttttagaagtagattgggagaactgcattctgggcaataaatattcactggacttacagcgtattcctttttttaaggaaccaagttcacagttgttagaactacaagagcacaacattacataatcatgacatcaaataagcataaaaataatgcttatttttaatttttacaggtgccattttataaactatctctataaagagattaatgttagcttcttgttttggaaataagataatgggagggaaggataaatgaaacagttttgttgccatctctcattgtgagccagtttagaaatgaaaacaaacaaacaaaacaactcttaagcccaacagcaacattcattataattttcctaattacactcccttttctttttgctaagaaagaacggttgtatttttgtccttaatagaaaagggaacagtgcctaaacaacctattataaattcttctgggaaagcatattacaaataattgaaaacaaccctgattctgtgaacttggcagcaaatgtataaaagaaagcaattcagccctggcccctggatgattgattaaatgttttattctttttacctttcattcatgctgtgtttgtcaagaggaaagagaaaaggaatgttgtgaaatgaagtccactttagacaaataacttacaataatgatcagtgacttctcatcagctgtttattcatttttcttgagttgtaatatttcttaatattagctatcctgcatggacccgacagaaaataaggtcctgagttttagcttgtccccaactccctgccagctaaccatcaacacaagctgtatctgagcttctttgagggcatggccctgcagctccctgtggtcagttattagtctgagtccagcaaaggaacaagaacactgtgtgcttgctaaatctacagaaaacttcatcttctggttgtgtgggaggagaggtccctttgtgtactctgtttctttgaaggaactagggatctgttggtgctgtacagatgtcgaggtgcacagagccaacatcctacaaaactagtaaatagatgattaggatccaactctgtacagaataatggtaggaacctaaaccttggggtactgtttacttgtatcaaaattgttgttgtcctataagccatgtaaaattaactacaaatctcctcaatgaaacactttcttagaactttgatatttttaaatgatatctcaccatctgtgtacatcacaatgttgagctacaaatgtggtggctctaacaaaattttaagtatgaagtcagatgtatagaggatcccttctccatcacgttcttctgtttttcatttcccgcttctcacaaactactccccagatgtcaataattctacaatctcctcttcctacaaccttcgtgttggtccttagtcgtctactctgatctcaaccgcaaaagtcaggggatgagactataggccatccccagagcaacagcctcagcacctcagcacagatctggaggggatttgagctagaaagaactctgaccttactcttttttttttttttttgagacagagtctcgctctgtcacccaggctggagtgcagtggcacaatctcggctcactgcaagctccacctcccgggttcatgccattctcccacctcagcctcctgagtagctaggactacaggcgcccgccaccacgcctggctaattttttgtatttttagtagagacggggtttcactgtgttagccaggatggtctcgatctcctgacctcgtgatcggcccgcctcggcctcccaaagtgctgggattacaggcgtgagccaccgcaccagcctctgaccttactcttaattgcttgcatgaaaattggatatggataagaatgcaaacccaagaacatgtcctgctttccttgatgcacattctcctattgatgttcagtgaccttagcatttccagaagcacctctttattgtggatggaaacttacttattcatgttgtctcaggctgtccaggttggtaacaggtaactgctataaagggtggagcacatcctgctaaatggagagatccagtgtcatttacattttttttaactctttcaagggtaatggcaactaacaatagtttctcctgtgtgctagatattgttctaatcattttacataaattatttcttttaatccaccaaacagcactataagatagatattatttttatttacctttgttagagaaaactgaggtatagagagattaagtaaattgtctaaattcacacagatagtaagtggaggagccagaatttgaacacaagcaatttgtctccaacaaatttgatcttaaactatggttaactctctgaacacacacacaaacacacatacgtacatgcaatcacacaaagtatcaggcacatggggatagacaatattagaaaagcatatacatacaaacatccttacagttgtacacatagactcaggtttataaacccactgaagtgaagactcatcatttatgaaaatatacaattttgttctgcaaaataatttaattttttaaaattccttgtgcaatgagaaaagatcagagaggcctacagtttccttttacagagctaggccaggggctgtatttagagtaattgaacacatgattttacttgaatgcggagaaacttgaccaactgtgaatatgcaatttcactctacagatgaaataaaattaaacggggcaaaagtaaagaagaatggagactaggtaaagtgatggaaagagacaccaaaaaattagtcatgtgaaagcaaaactaagaggagagggaaaggtggcaaaagaagggaacattcagagaatgttgatatattgagaggtgagaatagggagttggtaggcaagtgtcagagtgtgggaggatggtgacagtcactaggaactccagtttgcatacacacaatgttaagaacattagaaattagctagccaatggaatgctcagtcttgaagagcttgtgtctctgcttaaactcctgtatgcattagtatgattccataaatttaaagtctctgacatcttgagttttaagctttctgaacattaaatcagtggaggctgctagtagctatcctgaaatgctgcttctatacatatgagtaaaaatccaaattaatgtatttatacagcttttcatttgtgtactcgtaaaatacacacacacacagagacaattcaacacacacacacacacgcgcacacacaattcaacttttctctgaagaacctttgagtcagagaatgagaatgaaggagactgaatttctcttttaagttcctgtctaggttttgttccaatctaatgacacaggatctggcactgtatttagacctcctgctccaagattttatttttattttaaacaagtgttcccacacggggactgaaaacaaaacaggaaaatgttgcttaagttttcctttgagctgctgttatctgactttcaagtgtactgattgttccgtctcaccaatgtaggtcattgtactctcagttactttgttttctatcggaactttctctagcagctctccacattaagggagatcatgttatttcacatatttatttttgttattaacatattttcttcatctccctataatttgaggttttagcactttcttctttgtagaatttaccataaagcatacgtatttttgaaaactagggaatagcttttacttactaaagtacttaagtactaaacctatcataaccaatttcatttattaagatgttagtaagactttaggagttgttggttcttttccggagaataatgctttagcccagcagtccccaacctttttggtaccagggattggttttgtggaagacagtttttccatggaattgacaggggggatggggagtggggatgggtttccagatgaaactgttttacctcatatcatcaagcattagttagagtctcataaggagcctgcaagctaggtccctcacatgcacagtttacaatagggcttgtgctcctttgagaacctaatgccacagctgctgatctgacaggaggtggagctcagacacctccttctgtgcagcctggttcctaacaggccacagatagtactggtccatggcccagcagttggggacccctgctttagccctcaactcttaggcatgtttcagttctgattttggtcagcatagagctttccttctatttaccaggagggtctctactgatatggatcaatggcaggaggtgatattgggtctggaactatcctttggcttagtgacatttgtactctaatctgcctcactcctgccccttctcaggggacctgggcaccgtcggatcccatgacaggtcctacatggtgacctagggcacggtaaaaagtctaccccaggaagcctagaatggatagaatacaaattcatccaacacaaattcatgaagaaaagccaagatctgcagaaaatcaaacagtaaagactattccagaagagcaacaggaggacgataaagaggagatggagttaaaatactgggtctgtcatagacaggattggaatggaatcccaaatcagatgatagaatgaagggaaggtacatggaatagactctcactagtggtgagctttcggtcactacaagtcttcaaaaggggcctagatgaccagttctttttcatccaacaaatgcttattgaacccttcctctgtgggtagtgatgggcacattcagtgaattcagactggaatcgaacacattgtaaccattaaatgagttaatcttatatgagttcatacatacagatcacatgcaagagtgtctcatatccagtaagtttgcaagaataactactattgtttttgtgtacaagatcttgtgtattgtaatttctgaaatagcaatgaggttggaatacatgactaatgattttatcctcttatgatatctctggttggggcacacccaaaacaaaatttggagcaatgcaaatgttcgaggagagtgagagaacttccttctggtgtttttctctaatgacttgctctgaagctactcctcttagattctttcctagctgtgtattcctatatagtcttagcttaacagcacaaagatttaacagtggtgtctgcatttgataaaatgtaaatgagaagctcccaaaagagattgagaagctctattttgacaactcttcttttatctgtgtaattattatatactttaactgaagaaagaaaaacacaaagataaatacaatatttcaacttcgagtactttttaaaaattatttgaaagcatttaaaaatagatgtaaaatgaactcctgtatgtcaaattcctttcagagaaaaaaaaaagtgagagggaagggggaaatttgcatttagtaattttttttgtttttttgaaaatttcaggcacttagtaatcactgttccttttgtacgtcatgcccaatgggaacgataccaggatctttcactcaattctgtggattacaggtcacccacctgggcatgtttcagatgaaactaacctaagctcatcttgagtaaggggcttagaagtaaatgctttgttggttgctttgagttgtacaaagcaggacgaccaccagaggctttctaagaaaaagaatcatagagactttgataaaattggaactcctaaagcagctaaggctttgcttctatttttgatcatttttaaaaagttagttcttctggtgtttggtagttccatagtagttagaaagcactgccacatgaaatctgctattggtagaaaaagaaaatgttacagccaactctgatacaacatgagagagagacagagagagagagagaagggagagaagagacatgttcttctttgaccagcaggaaaaaaaaaaaagctgcacaaaccttttaactagtttcactagcagaaaagaaaaataaaaatataaaatagcaaataatctttaaagaaaactgattttcttattatgctgaaatttattaaagactgttgtgttgactgaagaatatgtttaaatattttgtggaaggcaaagctttcattcaggaatgacaagtgcaaggactgtaattctaaagaaattaaagaaaagaagaatggcaatttaagttcagggacaattggaatcaagcagtaatgatttacagctttttaaaattttcaggcacttagtggtcagtgttccttttatgcgttatgaccagtgggaaggataccaggatcttccattcagttattatgggttacaggtcacccatccgtgacctgtggtcacagtgttaggtatcgaaagcataataccttcttatctaagaaggaaagacctgttaagtctaagcttaggggtagagttgtcaacgatacagtcatatttgttgaacagttcaagttgccatttcttgtattcttggaagaggtaagttaaagaaggttgtgcacagttcttgacattttattattacagcactacctttcaagccactcagtagtcatcggacatgtaagagtggttgttctatttggtcgtgtaaatttctagtgacagtaggaaaaaaaaaaaagacctttattaaagaccttccaaactaattcagtgccctacatgctgcatgaaaatgaggactttccagttctgagtagaaggaatattaaggcacctgaagggacaaatccatttataaaattatttttctttttgtgataaaaatataaatggctctgctagtatactaaaaaatataaatggctctactagtatatttaataatccttcattgatttacctaaacgtatgaagatacccatataatatttttaaaaataagttattgtagctctaaaataatttattagactagaataaataaatttatactagaatttatgatgaacagtcaataaatggaattaaaaatataggtaaaatacagttaaaatatatacaaattttaagtgatacatgcaatgcacaaattgtaaatgtttgattgaggaaagagctaattcattggaagctctagtccagtctatagtatttggggactgctattgatatgttcattcaacaaataattactgataatatagtatgtactgaaatcattatgctaaacactgagggtttacaataaataagaaaatgtataacctcattgaacttaaatctagtagcagacacaagcaagtaaattggcaataaaaatagggggagtcaagggagtttggataaattatagaagaagctcctagacagtccatggaggtatttgtgggaggatggaattggcaacacagctgagattttaaagatatataaagtacatctgtgtaaatggcaagcagtgagaacacagaaaaggtgtttgaggaaagggcctaaagataagatagaccatgacacagaaaggaaagtaaaaatgattcagtgaccatctagtagatatccaatacatatatttgagtgaatgagtgatagactgactatatgaatgggaaatattgaaatataaagaggaaggccagagataaagctctgaaaggtaagcatatattttaagacttcagagtacctaattttctgaatatgcaaatgagcagtattagaattaataaaaataaccctaaaaatgagaactcttggttggagaaaataacaaaatatgaagtaaaggaaaattgacagaatacttcaaaaactgtgcctgatataattggaaataatgcctggaaacagattgagtccataatcctgtatgtgttcattaaggccaggaagattcttggtaaggaaatgtctagtctgaaaggtctaaagattttattaatctgtataataaattatatcttatgaaactcttgtcatttatccagtatatttgaattacccgtgcattactgtttcatatattcatggtactttcatattttataacatttaaaaatatttcaatattccattgatttgaataagattctttaaattacagtgaaagctttctgataaggtatggtaagattatttttcagtaattatgctgatacatataataaagctactgacaattcataaagatgataatacacttagtacaaactgagcttcaatgggattactaaatgagtatgtgaggacagagcagaggaaaaggccaagggttgagcactgtggtgctctattatgagaaagttaggaaggattaaagttggcactgaaggggattgagaaggagtagctgaagcggtagaaggaaaacaagaacagtgtgtcctggaagtcagtggagtaatcacttgtctcaaatgctgctaataggtcaaatatggtgagaactgagaactggacatttcatttagtaatgtgaaggacgttggtgactttcccaagagcagtttcagtggaatggaggaagaccaatggaataataggagcattgtggaggaataaaccaaaatgtacctatttaccatccagagccagactcagagcctttactctgtgctagaaacacaatgaccaattgttgcattgttccctttccttgagctttctacagctcacctcgcttcttcaaacatgtacaatcagacctctgaatctgtggattccacatccatggattcaactgactgcagaagaaaaatgttagaaaaaaatctgcatctgtaccgaacatgtgcagacttttttcttgtcattattccctaaataatatggtataacaactatttacatagcctttacattgtattgggtatttaaagtaatgtagatgtgatttaaataattttgaaatatgtgtataggttatatgcacatactatgccatttcatttcaaggacttgagcatcctcagattttgatatccacaggaggtcctggaaccaatccccacaaatcccctgaaactataactgatgaggggtgatggtacttctttttttacacagtcaaaataaaagagattaggcttgtttttgttatttctccccaaataatgccatattgagcatgactggatttaagaggtccccagatgtctcagccactcatttacataaaaattctttgtccatatctgtacatccttaatctcaagctacacatatggatttactgttctgtctcctggtgtcagcttactttcaatttgttttacctgtttcattggcacacttgtagagattgataatacaaaaatgttttaggagagagcataccacacatcaagttgtcaacttcatccacttctgctacttatttcaaagtttctgatacttattcatgatctttcagtagccttcattctcccatccatccattcactcaagaaacttgtattgttagggaatgtattagaattatagctcttcaagctttccaaaacaaatgtagcaacataaatagacaagcataataatggaaaatcgtctatacgagaaatctaattattttaggcacaaatcattttttaaaatgtattctaaaataaaaatgccattgaggcacagaggtcttactaatctgtaaagcaaacatgatttatatagtatgcttacattagtaaatcaggattatttgggtgaacagagtataatattgatatagttatttggttataaaaagagatgtttctgataaggtttccccccctttatttgccttggaaaacaaatttcaaagaagagtgtcattttaaactctaaaaaaccagttgataaccatagtctgatatttgcagttggaatgaattcctgtgacagcatgaacatacacccaccaacatgtctgtaatagaaaccactttggaagacactagaggctgccacagatttctcaggtcctcacagcaagacagtggtggtcttggggatggatacatttcatcttccttgaagacagataccaccctctggctgtcaccccataggaaatcaggaagtatgctaagctatccagtggacttggaattacactgtgctgtgctagtggaaatatcctatccaacattatgatttattttgaaggagaaaggaaaaaaaaatacacacaaaacggtggaaggaagctgcacacaacatcgccaaacagctggcttgttttatatcccagaaacagcttgggactaactatattcacaagatctcttggcagagtagcttgatgaaaataccaaagctgtgagaagtgttcttttgctgaatccttcatgtagctatcacacggtttattaacctaaatgagaatatgtacaccttttttccaaaaaggtcctttgtatgtttaagtgagaaacttactgattcttcatacggcacaaacatgattcaccacagcattcacaccaaataaactctaataatgttcagaaactataatcctagacatgtagcgatttcctcctttctttcaagtagtatttttggggacagtcaagagagaatttgatagaaatgtaagcctgagttcaatggcactggtgacttttttaggtgccaaggttaatctcagagggaaattagttttaatggcttcatccatatatttatccattcttttaacatttaactctaacctccttaagccaaaaatataactcaattctaaacacatttctggctcacctgctaggtgccagaaatgcggatcttgaggaatatacaagatctgcttcactcttttagaatccctgcattagagaggattcagtattttcagattcatattttagaagacattgcattctattccttactaagcatcccaggtagattcaattaggtggaacatattcatatttttatcatgaggcattttgagtctattctttgtgacaccagaattagtttctcatctcagagtttgctgtatttgtctggtgactcaagtagtttattggcagtcagtttgtaaaaggctccctgggattatctaaatgcaggacgttaggaatggaaatatgtatcattgcctctcctgtcaaaaaatgtaattaacacacatgatatatcatcttacaaagtggatgaaaattccagtgggtgaccttgagtcacagctcctcagtgcacacactgtcctgtacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgttgagagattcctcattcttttttatggttgcagataattcattatgcagatatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcggggcttgcagactgctgacttcttgtagcctcacatggttgaaagagagctagctagctctctggcctctttttattaggtcactaatctcattcaggagggctccaccctcaggatctaattacctaccaaacgccttgcccccaaatatcatcacatttgggattagggtttcaacatatgaattttagtaggggggaggcaaacattcagtccattagccatattcagttcacctgtaatatagtatctgtattattttatgtctgtagaataattcctagaagtggaattgctagctcagaattactgtgtgtttctaattttgatagttactgctcaattgactttcttgaaatttgtatcattttacagttatacctgtaaatgtaagaggtatgtatctactctcttagtctaaccatcagagagtattaccaatatttgtggggtttgccaacctgaaaaaatgggaagtttatcagtgtgtttttaattaacatttatcctattatgagggaggatcagtatcttataaacttttaacagtcattttaattttcttttctttgaatagggccctcatatatttgtgcattttgttatggtgttggtgcatttctttattgatttacaagagttctttgagtattaggaacatccttcctttatccgtgccaacagtaccttttattttgtcacacagtttattcttcatcagaattctttgctcttgagaagtccctgtgagagcctgccagccttctacacctttggagggcagtttgttggcaatttctcaatttttctttcacatagaaaatgatctgactgaattttatttctcttgatgtcaactgtgctgaattattgtcttaaaaaattcaccattccattcaggtttaacatattttttagagtgtgattttcatagggtatgttacattcttgatgaatttttatcttcttgacctattaattactaaaaaaaaaaatacagataacgacaacctaaaacaacctattgaaatatctcactgtgatgatagatttgtctagttttccttgtaatttttgttctccatattttaaggctatataatgtgatgttttcaagtacagaattattttaagttcctaatgggttccttttttaatctgatattttataactttttccccaagttttctggtttcccaccataccccagattcttaagtaatttagggcacaataattttcagagaaagaatgattaagaatttatggaaatcttaggaaggtcgaattgacgcagtgccttggaagagagaaatataggtagttgaagtataaggagaaatgcctatgatataaacaaacaaattgcatgtacatgtattaagaagactataacatatatcagttacttcactagatgccagtgcataggcatgtacctgaatctgcgtaactaattgggagaatgggaagttaactttatttttccaagaaaaagaaacaaaatcaatatttaaattttggaaaacataattgttaaattatttttcatattgtgtagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagagtaagttatgatgaatcatattagagcctacaaatgatatcccacttatctttttgtctgttaaatactttaaaaatgttttcagtgatttgtaggagtggttattatcaaatttttattttagaattgtagattattattattattattatttgaaatttgacagactttcctttgttcagatccaagctgtgccgcttattacatgtgtaacatttatcaaacattttagccttctcaaactttaatttcttcttttgtaaaatgagaatcacaatgtctacttaataatcttatttttcagaataaaattagcctttgtcaccttaggggatctatactactattataattggctttggcgagttactactggaagtgcaggggctttgaaacatttttttgccaccactgagccagtatacacacatgcacacatacagagagcagtatgtcttaaaccttaatgtgtatgggattagccagtgatcttgtggaaatataggttatgattcagtagggcagagctgagacgctgcacttcaaaaactttccaggtgatgctgatgttgccggtttgtgggccatcaaataatttggttttatgcttgattaatgaatcacaagccatagttttaaaaatgcagtgctataggagaaaactgattctacatactgttttattttcctttacaaataaaatattaggggaaaaagtttaaagcatcttttcaaaagctttttgaacacaagagctaacagaagtgctgtcttccagtgttaaacaggaatttgtgggattacaagatagatgatcaacccagattgctatgagtgataaccgtgcttcctcctgtctaccttctaccatattcactggtttatggcacctcccacatatgctgctacacaaccaaggcattattaccagggaagtcaattcagccataactctataaagtaaactcctgtgaatagagtatctactgtatgactagaggtatagctaagaaaaaagactatagggagaaattaatattgtaggacaaagcatttaattctagaatgatcccactaaggtaagaccaccgtcatcggttgcaaaattgctgaatcactagggttaatagttacagatcctaaatactcctcacatgttttctttcctcgttacttaacttcccacacccaacctctccatcatcacaagataacttttaaggctttagttagtcccatgcaacatatgtcagatgttttagtgccctgtattttccaaacttgaaataatttccccttgtattatacctcaacatattgtaaattgtctcatgcaaaactaatcattattttatagcaatgtttggatttttcacttgtttaagaaaacattttcaattctaattttggcgggacttaaaaatatacaccaaggaagactggtgtgaaattggagtgaaatttaatctttcttgacagtatgtctatcagagaaaaaaaatcaatgaaaataaattagtgttctttctatcatctcttgcaggaggtagagtgggggttggggtacacatctattatttataactttatcgtacatgagtctttaaaataatgcagtataagtcaacatataaatatgttttttgaaagtactcaagttcaataaacactcatttaaatatataaaaataagatagcaaatttcagctcttcttcatgactcaaaagcaaagcattatacatttatatttaaaatagatttcccagttttaaaagcatttacaaatactactgtatcagctttttaagcaaatatctctatttgtgtctatattattaagtgatgaggttaaatggaaaaaatatttttatactatccaaactccctagccagttccattagttcaaggtctaggtatatcaaataagataacataacaaaaatattttcaaagacactatatgtatgtaacaaaaacaaatagaaggaaaaagaaacaaagaagtaaattggaaaaaggggattcttagtcaaggaactcagatatgtgtccacctacatattctagctaaatctgttttttttgtgtgtgtgtataattggaataatagaactatctaacgctaagatgattatttgaatatgataatgtaaagtgctctgacaattataaaatgttatatacacattaattaaaattttaaaaatagtctagcctccataattatccttaaaaaatagctgggtagattaaaataattagtaacatagctctatgttaacttcatatacaaaggtaattgtatggactatattacatagtaatataaaaatgcaaatgttctgcacaataaacttacagttaatgactttttaattttcttcttaatatggttaaggaatatattgttatgagcacaatttctacccagattttgttggttcttttcaaatccatcaagtaaaacagtgtgcgtatgatttgtgaatactgcagttgctataatcacaataaaagagggtttcttgcaagaaactatgtaaaacaacttttatgaagaatagctgtccttagccccagataaaaactactgtcagccacaggtactctagcatggacttggtgctgactgggaaaaagatatttctaaaatgcccaactagcttaaattaaaggccactcttcctttgggctaagatcacagtgctaagagttactttgtcagttttgtgagtcctcacttgtcctcaagaaacacaaatgtccttcaaactaaggataaaagcagaaaataaagtttttactgaatgtccccttttgttactttgaccttgcagtcatcttaacaggatttctctctggattgctttttgcagtattactactcggtcaaggatatttcagttggagggatgtgcatctgctatggtcatgccagggcttgtccacttgatccagcgacaaatgtatgtatatttataggatgcttaggcaaaatgaagccctgagctgtaaaatgtttcatgacagtctttgctgacagagaacgctgtaaatgggagtcaggtccccacttagacagtgtaacagaaatccatgccagggtgaaataagagctggcagttaggatgatagactttgaaatcagccatcacagtataagaaaacagattagtttttcctttttttttttttttttcaaaaaggctccaaactggtctattttgaaatctctctagctatgacagcctgcctcatgatatagctttagagaacgcctgccatcaatcaacctgaccatttcttttaaagtttctaatcaaaaaattaatgcaaatgagtaaaaaaatgtgcagggaagtaaatatataagtgacaatggaacaggaggataaaatagggcaggggcaataagggggtggagggggtggagtgggtgagagagtcaagagagtactgatagtggcaagccggaaaatgccagaatgctttttgatagaattttttcattaatgacaatgaattaagtgaacataacctaaaggagaagatgaatgagcatctatttttcctgtcatagacaaactggtgaaattcaaactcatctcctgtatagtatatggaaaaatacattgaatagtaagatcagtgaatgtaaatcgggccacagattttttttctcaaatattgtaatgcaaatgacattatactcaaagctagttttctgatgattggattataatgttatctcctaggaagattaaagtacactaacatatttttatgggcaaagctgcagtgctgctttctgcctggtatgggtgctttcttcttttttttgttttccattttttaaaattttactttaaatcctggatactcgtgcacaacatgcaggtttgttacataggtaaatgtgtgtcatggtcatttgctgcccctatcaacccatcacctaggcataattttccacaggctttacagagtccctttgtctcactggctttctgcattttaaaaatccctttactgttattttatttggaggaagtgaaaaaatgcatatgccaccatagaatactacgctgccataaaaaggaatgagatcatgtcctttgcagggacatggatgaagctggaaaccatggtcctcaggaaactaacacaggaacagaaaaccaaacactatatgttctcactcataaatgagagctaaacaatgagaacacatggactcaaggaggggaacaacacacaccagggcctatcagatggagggaggcaaagggagggagaacatcaggacagacagctaatgcatgcagggtgctttctatcaggtgtacagatgatcagtgtttcccaggctttaaaagtccacaagacaggcttggaaggccaattccaggtggtaaattgagactgtattcagagcatgcacagacaggagatttagtcctagagacattagatttctggtttacctgcacccctagaggcctaggaatcaactccctccttcttgccatatccaaaaatattaacaacattttgaggggagccttaaaacaagctaatcgacccccaaaaaacacatagatcccaggcatcagagaaggagaattcagtcttcaagaccactcccagctgggccttcctgctttcttctgagcctaaacccagtgattaaagaaccagcctggacttccttaaggtgatgttgatcaaatatacccacttcaagcctggcaccactttcttcccaggctggctagttttacattttagtacacagtccagatgttttctcttttcttcatagtacctttagagagaggcttcctttatggttctaaatgaggctaaaatttgtgcttcctccctctttttgactagaaatctcgctgtgagtgtgagcataacacatgtggcgatagctgtgatcagtgctgtccaggattccatcagaaaccctggagagctggaacttttctaactaaaactgaatgtgaaggtatgttctttagaagccaacaaaatatgtcattcttcctttccaagaaaaaaagccagtaatgaaaaatagtgaaatggctggttatgcaaatgtgtcaacaaatactcatttatattatcacttcgaagacaacccatatgtctagcttttcctaaagggaaatatctaagaaatgtagcagatgactttatagcctaatagtgacaactggtctttttaggtgacaggtatcatggagaaacctgtgtttctggagattttctcaacccaagaaaagacctaaaaatagtcttgggctgaactgcaaacctaaactagtatgaagtccaattcaactgaatgcaaatattaatattacagtaaatcagccctaaccacatttttttcagctcactaagtatatatggccttcaaaaacagcttgatagacattttaaattaataccaacactatatatcctttgaataacaaattaactcaactcacatttatcatgtacaatgtgtcagacatgacaggtctttaaaactattgaatcataacacaccttaatcacaaaatgttccccacctataagatataaagtcggccttccatatccatggtttctccatccatgggtctaaccaactgcagatcaaaaatgtttgaaaaaaagttgcatctgtactgaacttgtaaagacctttttcttattattatttcctaagcaatataacaactatttatatagcatttacattttgttaggtattataagtaatctagagatgatctaaagtgtacaggaggatgtgcataggctgtatgcaagtactatgccactgtataacaggaacttgagtatccttgaatcttggtgtttgagggaggtcctggaaccattcccatggatattgagggatggctgtattttctttttagtttgagattctgcatatatgctattagctctccttattttctgcactcacttcatttgcttttggatttgtgtctgcctgtttataaagatattatggattagaaatctcccattattacaaaagcatatctggaggcatgagccaccattggatcatcactcaccatgcatggtaggggaccattggaagcccagccttttgtttccttcaactacttccagccatgttctggctaatcccttagttctccacagcttctccatagagaacagacatttgttcttaatagtgactttaaatgtaatgccacccagggatgtttgctctcgagctcctttaaattttaattaaatttctcttctgtttgtagaatatcagtaatcataagtgggagcagcacttgaaggtaggggtcttcctgttgccactgacatgccttcacacagtgataattgtgtaatgttaagtggctctgcaaaatcctttaccactctttacttgtgtttctacgtttaaatacaaaacaaaaacaatcgagcaacttgttagcaatagaggtagactaagcaaggcaagacatttcaaactgctactgtacacatttttaaaatagtggaattgtgaaacactttttttctttccctgtagggaagaggggaggtcgtatttccaaactgaaaaacaaacattttaaaaacgcagaaattcaagatggggatcttagccataaagccatacataaaaatcacactttcagcaatgagtacattcctgaaagcttaagtaaaaattttcttttccaagttgaatcatattccaatcaccttaatatttagaaaaatccttccatgacatgacaaatccctccataaaatgaataatcacattctaattcatttgagtttaatttggattttcatcaatctagcttacataaggcaagataatatctctaaaaagcatagaatattcattcagttgctgagcctttactaaacaacagtttcatatgatatatcttggacattctgtgaaatagtaagttgctgatgatagagaaaaaacatggctttgtgatcagttactagccatattcttgaaggttacagacagagcggggtaggctgcagcctacagacagaaagtggggctgtaggtgtagggtcctggctgcacagagtgtgtgatggaccgtttatttggcatcagggttttacatatagtagctcatagttctaaacactcttgacaacacgaattctaaatagtgtgagaataagtctatgttactttatgttttcctctgcttatactggcagcagaagttttgactgttttttgaaatacactattacaacaaagcttttaagaattcatagccaggtccagtggcatgctcctataatcccagctactggaaagaagctatggtgggaggatctcttgagcccaggagtttgaggccagcctgggccacatagtgagaccctgtctgtatcactccgttttcacactgctgtaaagatactacccgagactgggtaatttataaaggaaagaggtttagttgactcacccttctgcatggctaggaggcctcaggaaacttatgatcaaaggggaagagggagcaggcacatcttacatggtacaggagagagaggagaaagtgaatggggaagagccccttataaaaccatcagatcttgtacgaactcactcactatcatgaggacagcatgggggagctgcccccttgatccagtctcctccctccctccatacgtggagattacaatttcaaatgagatttgggtggggacacagagccaaaccatatcactgtctttctgaagaaaaaaaaggaattcttgtatgttgccctaaagatataaaactgcttacaatgcctagtgatttgtattgattactatgtgttccctaaagtttgaaactctccattaacatagcaaaactactatattctaaatcaaatgtcagcaggttgggaaaggtatttacaacaaacatgacaaggggataataacctttctatattaagagatcttacatatcaataagaaaaaagttaacctgttagaaagatcaaaacaggtattcctcagaaatgacatataactttgtaaaaagataatgacactcataatgaaggaagtatcaattaaaacaatgacatattatttttcacctatcaaagtgtttattcttctactcaacaaatatttgaatgcttattatgtccaggaattgtattcaagggttgataacacacaaggttggtggctatggagaaagtgttttatcatatctactagaggaaaagtcatttgtcatagcgttcctggaggggaattttttaagcgattaaaatttaaattttacatatcctttgactagaaattatgcttccaggaatttaccctatagatatattcatatagatgtacaggcatattatcatgatcctcgtcattattatacaagtgctaccactactgctactaacatttattgagctcagtatttagtatgtttcaggcattctgctaagcattctcaaaacatgtatgagacaagtactaaagtgatgctaggactcgagtttttgcctcaaagtcactcaactggcaaataggaaacttttctaacattagagcgcctccctccacccggcatccttgtcctcccagtatgtgtgtggtgttatttgtaaagggagaaacatggaaactgtgtaactgttcattaatagggacctgataaataccttcattcaagtagtaccctgtgtacccttaggggatacacatgctaatatggaaagggctccatgatttactgttagtaaaaagaaccggttctaaacagtatacaaatgccccttcccttttgtagaataaataaaaagattgagctgtatgcatacaagcacacctacacacacacacacacacgtggaaataaatgtaagtactcctaagaaactcaacatgtcaggtaggaaggagactgcatcgatatatttccctggttctatcctaatataaattcttcatatttagaagagtcttacccaatcctttctggagaaagtgatttttcacttcttggaattcttctaatgtaacatgaaaaagacaaggaggaagaaaagaagaaaaatcaattgctaacttctttataagacattacgctaatgatttcacatgcattatctcacttgtgcttttaaatatcccaatctagtaattactattgaccactccatgtattatatggaaactgagccttcgtgaaattaagaagtttccaatgtcatatgactgctaagtagaggagagcacacccacatccaagacagttggttgcaaaatagcatgatcttagccaccagtaaactagctctcggtttgtcttaattccttggcacctgccatgtatcttatttcattcaccgggtaggatgtgaagagattctggcagtctttagcagtgcagactctggagtctggcttcagaggttggtttccaatactgattagaatatcttttacacgttatttcacttctctggactcaggtttctagtatacaaaaataggttaataataataatacctaattcctaaaagcatttttgaggattaaaatcagtagcaacaaatatggagcatttagaacagtgtctggcattgagaaaacctatgttttagttgttattagtattaaaagaaaggaattatattatacatacttttctttacccacaggctctaatacagaaatttccatatggtagtaattcattacagattacctagctgttaatcattcagtgccatcattgaataatttattatttgttataataggaaattgtaagttgaaccatataaaattgcacgttagtcaaaaccaaatattggcaattgcatatgattgagcttaatttatatgttttaatcatttcaaattctattaaaatgtgtgaatttattaatacctccaatacatccagatactttctggatatgtttgtgtgtgtgtacgctaaatgtaatttcccgtatggtataaaagtctaggccgggggcagtggctcacgcctgtaattccagcactttgagaggctgaggcgggtggatcatgggtcaagagttcaagaccagcctggccaacatggtgaagccccatctctactaaaaatacagaaattagctgggtgtggtggtgcatgcctgttgtccccagctactcgggaggctgagacaggaggattgcttgaacctggaaggcagaggttgcagtgagccgagatcgtgccactctgcactccagcctgggcgacagagtgagactctgtctcaaaaaaaaaatctattatgtataacagaaatgatttttaaatgtatctgaaatcaaattgatgtttattaatttatttttccttaatgcagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtaaagtatgctttttctttcataaagagttatttttttgctttttcatacaaaaatgttttatacaaaaaaataataattttgaaagcttctgtaaacagttgaacttcaaattaaaaggtaagtaggaacatttcgtagttgaaactgacctaaatctttgaggatgtaagataaaacttttccatcactccagaaagttttatcatggctccttccagtcaaggagtggacccctaggcaaactctgttctgatttttagaacgtaaattagttgtgcctcttagagaatttcataaaaatgaaatcatacagtacatactagtgagtcttttttcactcgacataatatgttaagatttatccatgttgtttgtgcatcagtagttctttttcttttgaaagaaattgctgagtagtatttctctgcacgaacatatcaaaattttaaatccattctcctgttgatagaaattaggatcatttccagttttagcttagctcctacaaataattttatactagttattttatagtcatatttttatttaccttgtgtaaatacttaggaatagaaagcttttttcataggataggtagatgcttaactttataagaaaccgtcaacattttgccaaattagtaataatgtataaaatgttcaccaaaaagttatatgagtttcagtcattctatatcatctctaatatttgatgttgactatctttttggattttagtcatctagtgggtgtgaaatggcatctgattatggatttaattttaatcgtaagggcttattgaccattcctgtatcttctcttatgaagtagatgttcaaagtctaaatatttttttatcctaaaaaccaaaattttaacttatagagctattacccatatcaagtaaatgtttgtgtgtggtgtgaataagtaaccagatttatatggttaacctgaagttctagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggagcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaattagcttgatataaccatttcacaatttgtatatatataatatatatatacaatgatattcaaaatatcatgtcacacatgataaatatatacaattttgtcaaaaaggaaattaaactttaaaagcaaacaagtattgaggaaaataacatcataataatattgaatcatttaaccaatgaacatagcatatctctccatttatttctatcttctttattcatgtcagtgttccagtacagagatcttgcatgtcttttgttaaattaatctttagaattttgctttgcatgactgtaaaaaaaatttttaaataattttccaattatttaatgtaattgttaaagaattttgaatattgactttatgccctatagccatccttaatttctttttttttttttaaataacttcccttttaaaagttactgagaataaagaatacagaacatggttataggcacttacattgctatcaaatgcaggaattcacttcaataagaagtgctttctctgtaagcatggttcatggcaatagaagctccaacttaggagaggatgttttccgtgacaaaaataataacaacaaaaaaaatggtggttgaaggaaaacagtccaaatttacagatgctttaaacttcttttggccttggcatcagctttcatgttaaaaaataaagctggtggggaagctatctcacttgcaaagtaaatggcttgtatgagattggcgaatcttggtcagatattgcatttttaaagcacaaaaccaccggccaccaatatcttcctgtgcatgcatataaattattttcttctaattcaaatggcaacagaggaatcctggcgtgcatgtgcatggagacacacacacatcactaaggagacaggacaaactatcataaactaagcagtatcccaaacacatcatcatctataggctgttttacaaaggtagaatacaaacgaactgaatgtctcaggtaaaaggcaaagtctatttctccatctctgctgcactcatttatcttcttaaggctttcacagaaagcaccgttttatgaacaggcaattcagtacccagagcttgactggagacactaatcaggattgaagtcttgatgcagttcataaaaacccatttaaaaaaaggcatcaaaaaccacatttaaaataaagctgtccatatataaagaatgaagtgtttagaagttcccagcttgtatcctaataagagtactgaaaggtttaatattagcagcctgtgaacacgtagtgaagagagagtctgagaaccaagttaacatccttattccactctaattccacccatgccatgggtaaaaacagttcttgcagtctagagtttctcctccgatggtttaaccatcagatttttacatcttgggattcaaccatcttggcaagcgtcttcttaattctcaacgctgtgagtctgggggctggattgtgggcccagcattctgacattagcttcaaaactgctcgtagacattcatcactgttccaccgattagacacaattggccgcaaacgtttgacacacacaacctcacgcatatcttcgtatgacggatcactcggtaccatgttgtaatatggcaattggtactcttccacgatccctcctgtgatacaacgacgagccatctcccaaatgattaggccgaagctgtagatatcagccatgatgtagggctggaagtggtttttgttcaggctttcgtccagcacttctggagccaggtagcgtttggtgcccaccctggtattcaagggcacatcaacttcatttgtgtcactgttgaatttaacagcaaggcccaggtcagcaatgcagcaactcccatttttcttgatgaggatgtttttgctctttaggtctcgatgagcaattgcgggctttccttgggtgccatacatttctgtgtgcaggtggcacagacccacaggcagctgaataagccaatttaagcagggctctggtgtccagcgtagcacatttcaggaagtcatagagagatccattttcatggtaatcagtaatcaaatagagctgagtccaggaacctgtacctttaatatctgccgctatgaaaccaagtatgttttcatggcgcattagcacagtttggtagatttctgtttctcgaaaccagctggcttcttcagtggtaaagaatactttcaccgccactctttcgccatgccatttgcccatccgtacttctccatatcggcctttaccaacttgccggaccatctgaatctgtttggcaatagttcgctgaaccaataaaggtagtccagacccactaccagaactttgtgactggtcaataaggtcttttagtgattttccaactggaataaatgcttcatcctgttccaaatcacgattgtaacgacgtctgcttgagatgctcttgcaataatgtttgtaacaaaagcagctggagaagatgatcatagcaattatgcagacagccatagaaatgagcaaaaccagccatcgaatgctgccatcaaaaaacggacctatgacaacagggggcatgtgggttgcaaatactggttacataaattggtccgacaacattctattgtccggcgtagctgggcttttggagaatctttgcactgaaaatcagatccttcatatttcatacaccctgaagctaatgtggtttctccctggtcatcttcttctatgatggcaaagcaacgtccattagttatgcatgtgttattaatagcatcatctgggcagtgccctcagcaatagcacttgaaaaaaggcaaggtatcctctggtgctaaggttactccattttctgactttttctggtcggagtctgatttcatcccagtgccgtggagcatactatccagattctgtccttgaacacgagaaatgatgaacaaataggctcccaataatctgatgtaaatgtatagctgagtcattgttcaattgtaatgtttcctgtgtactgtcacctttagtaattggtcttgctacttcaccaatttaaatgactgtcattcagtgagattttcttgtaaaagatcgcaagcacttgacaatgacttcaactcccactgctttcttacgactcctccaagatgtggctagataaaactgtacttccgattttctccaaacagctttgacctatgcttccatctcatgaattccaagacagtattaaactgatgcatattttcataagtcgctcccggcgtctcttcccgggctccttgccagcgtgccgaggcgcaggcagggtgatggaggcgccccggccgggaggatctgccggggagagcggctttcctcatcgattcgggagcacccaccatgcttaatttctttattaattctagtagttttaaactacatgctttagaaacgtacacataaacaatcattttacctgcaagtacattcaggcttacttcttcctttgcaatctttatgccaaggttaactaaaaatggcgagagctgacatcttcactttgttctgaattttaaagggaaacctaatatttcactatggagtatgatgtgaactgcatatttttttatggacaccctttatcagattcagtaggtcccctactattcctaagttgcagagagtttttataacaaaatggttttgcattttgtcatatgcttttcgaaacctactgaaatgaacataaggattttctcctttattctgttaacggggacaatttatgcaaattgaattttaaaatatgaaggcagctttgcatttgtgaattaatctccatttggttatgatatattatcatttttatatattggatgattcaattgactaatgtttggttaagaattttgacatcctctcataaaatatattggtctataattttattttcttataatgtttttgtcaggttttttattggggtatactggcatcaacaaatgatcggggaaatgcacttcctcttctgttttctaaagtaacttcagattaaaattaattctctttaaaatgcttgataaaatttcctagtgaaactatctgagtctctagttttcttcgtgcattgtattggctattttttattagacatagggttagataggttttgtattaatatctttagggagggtcaatttttgatatattgtatttttcaagtaatttgttcaattcatctaaattgtcaaatcattggcaattggcagttttaaaaattgccttattatcttcttgaagtctatagcatctatatagatatcccctgtgtaatttttaaaatgattaagttgtgcttttctccttttattgatcacttatgttaggggtttatcaattttcctaatcttttccaaaaaaacttctgcctttttattttttgtgtttttattgattctgttctatttattatattattcatttgacctgttttggttttaaatttcattttctttttctacctatcaatttggaaagttaaattatgattttacacctttcttcttttatcatataaacttttaaatatagatttccttctagcagttctttagctgtttctcatgaattcaggaatgctttatgttcattgtcatttatttaacataatttctaatttctcttgtgatttattttttgttaatttccaaatatttgagctttattaaatattatatttttgatttctacactggatgtttatgatctgagaacatactctctaagatgtcaaactttagaagtttattgaaatttaacttatggctcagtgcatggtctctcttggcaaacaaataaatgtggatttttccaatctgcgattatggattcctacctttctttcatttttttcagtatttcttcctgttctttgaagcactgttatgaggcacatacatatttagaatattttgaatctttagatttttatatcttataaattaatattttgataactgtgaagatctccacttaatctcagatatcactttttgtcctaaagtctactttattttttattaacattgccacagcagttttcatatgcttactctgtatggtatgttttttctgattttgtttaactttcaacctatctttattttcatttaaaagatttcttataaagagtaaaatagatggattttttatcctgacaattactgtgtgtttagtccctaaatttaatatagttaataatatgattgggttttgctatttgtttcccatttgtgtcacaaaatttttgttcccattcttccttttctgtctacttttatgttaaacaaatatttttcagtattccattttatttcctttattatctttttagcagtacctctttgtataattttccattccaacttttattttaggttcaggtagtacatgggtaaattatgtgtcatgggatttggtgtacagattattttgtcacccagataataagcataataaaattttcaatcttcacccccctcccacccttttcaagcaggccctggtgtctattgttgccttctttgtgtccatgtgtactcaatgtttagctccactcataagagagaacatgcagtatctggttttctattcttgcattaattcacttaggataatggccttctgctccatccatgttgcttcaaaggacatgattttattcttttttatggctgtgtagtattccatggtgtatatgtactacattttctttattcagtccaccaatgatggtacctaggttgattccatgtctttgttattgtgaatagggctgcaatgaacataggcatgcatgtggctttatgatagaatgatatatattcctttgggcatatacgcagtaatgggattgctgagttgagtgctagttctgttttaagttttttgagaaatctcccaacggcttcccacagtgtctgaactaatttactttcccaccagcagtgtataagtgttccctttctctgcaacctcaccagtatctgttatttttgactttcagtaatagccgttctgaccagtgtgagatggtagtattttaagctcatgatatagtgatatagtcctatcttttggactattgttttcatatattgcacataatttgtaagccagcaatacaatgttgtcatttttgtttgaagtcacaaaactatgaaaacaatcttaaagaaatgaaaagaaggaaaaaaatttacattaaccatacctttcccattttccatactctgtggttctagcttatatatattgccctcctgcttgaaaaatttcctttaacattttttttttggtagtgcagagctgctggtgacaaattttctcaacttccctttatctgaaaatgtctttaatctactttcattattgaaggatattttccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgataaaactttggcccgtagaccaaatctgactcatggcctatatttgtatgatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctttacagaaaagttttccaacctcagagttaaataaactatgatgtgtctatgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgttcattgtatctgaggcagtgctaagtaattttttttctttctccgttctttagattggatcatttccattcatctgtcattatactttggtctacatataatgtatctttaatttactagctgattttaaaatattctcattaggccgggcacagtggttcaccccaggaatcccagtactttggaaggccgaagcaggcaagtcgcttgcggtcaggagtttaagaccaacctggccaacatggtgaaaccctgtctctattaaaaatacaaaatttagccaggcatggtggcaggcacctgtaatatcacctactcaggagactgaggcaggagaatagcttgaacccaggaagtgaggttgcagtgggtcaagcttgcaccagtgcacttcagcctgggcaagagagcgagaccctatctcaaaaataaatacaaataaataaataaataaattctcattatatttacttttaacaatagtatcatgtttgagaaaactttggcctgtagaccaaatcctggcctatggccagatgactacaaaagtagtcattaggttgactactcttcctcctatcatctctacctgatgttaagcatatccagtgaattattaaattgaggtattttacttttcagctttctggagttcttatgttccttacagcttccatttctctgaaatactccataccttcactcattataaacattgtttcctttatattctcggacatatttacagaacttacgttgacttccttgtatgctaatttcaatatctgggtcacctcaggatctgcttttatcaacttctttttttaataaggtcaacattttcctgtttctttcctgtatatctaatacagtagtcctcctttattcacagaggatatgttccaggaaccccagttgatacctgaaatcacagatagtaccaaacctatatatactatgttttttctatctgatacctgtgatgggactaagtgactaacaggagggtagtgtctatacagcatagatatgctggacaaggggatgattcatatccctggtgcgacagagcaagatggcccgagatttcaccacactattcaaaatgacatgcaaattaaaacttttcaattatttatttctggagttttccatttaatattttcgaactgtggttaaccatgataactgaaacctcagacagcaaaactacagatgaggtgaggactactgtaatttatcatctctacaggacatttcggagaatacaatgcagacactggtttctgttatgttcctctgaagagtttgaattggttctaattagtaataaacttgctgagtgatcaccatgaagtcatgaaagtttactttcatactttgttaggacagattagtggaaaactccaggtattcatcaaacatttctaatgtagttaacttaaagtctgaattctctttactttatggttggtagcacctgaaaactcttctcaccttgttcagtttccagcggttgctttccactgaatttcctagaatctcctgagtgaatatacaataaagggatcagttaaggctgggaagggtattgttatgcaaattttgtgaattgcagtttaacagctaaagaatttatctctatgatgttcataaaattattgtcttaaaatttgattttagatttttccacttaatgacatttaatttatatgtgtatataaaatatgccttacctattctgtgcacagtcccaacttcataatgggggaatgaatgaatgtatcttaaacaaatgatgattttgaaactgacctgtgaacttagttaattgagattcagtgaggtatataaataagtctaattttaacactctgatttatagtagcaaacaagttttcatttgtaaattaagcctagatatatatacatatgaactatattgaataggtgggcatttcttgggcaaataatttagttttttttttttttcctattacatctggaaaataaatcttgtatatacagtatatgaacacagtgtagttttgtttaagtaaactagctttgttgatatactatgtatacaagataaaaaggaataaaacatgaaaatatcaataagtattgaatctaagtaacaaatatataggaatttattattctattatctttacttttgtgtaagcatgtaaaagaactggattttagaaattataaacatgtattaaaggtaattcttatagttttctcaataatttgctgctctgtattattaaaactactttgtctataaaagtttgctgaagtgaaaaatattgctgtttctattacacttcgttaaattcattttaatatttttgttaggtatctccaaattatccaaggccatgccagccatgtcattgcgatccaattggttccttaaatgaagtctgtgtcaaggatgagaaacatgctcgacgaggtgagagctgcagcagaatgtcactgctctgataaaaggacaactaaaagccaaatatgattattttcagaagaatattttgcagtaaatgttattcatgtaataaatttattctttaatctatcagtgtattagcgttccctccaggaagtagtttttaaactcatctcaataattactttcatgtttaattataatgttttcatagcaagaagagttgaattatgtattttgagatacacacacacacatacacagagataaagaaagagagagagtcaatcacaaatctgtggtatatgtaattttttcatatcgtgttatttattagattgtttgtagcttctatgagttctagcatgaaatgccagcgttcactgaggaatgtgtgtgctgtagtgggaaaagcaaatagaagaactcacacactgagatgtaggcaataatatagaaagcaagaagtgttcataaaggactaagaaggtagtagtcatgaattaatgaacagaaagaggctgacactaatttaagctaaagccttcctttgaggaatgaaattcatgaactccaaacattaagaaatcaaatgccaacataactccttgatataaaagcgtttgggagctacttccagggcagttgctcgccaagtttaagtaggaaattcatagaatgcactgggacgcttcttctctagaaagactaaaattaatcaaggctacaatgtagtgtttttttccctaatgactttagcgttaaaagaccagcaatgtttcttaggtacaattcttgttacctgctttctttataaaactgtaggattatcaatctgagcattacatgtagactaaattttgaaatattaaaaaacggatacgttttgatagtcgaatgatgaattactgagctcacttttcgttttaagccttttctctttgtgtttacaagtaaatcacaatgttgttttcattaatatcatttaactcttccctacccctttttgagtaatgagtatatgatcacagaataaaaatggaaaagtagaaaaataaatatacaattcagtggtaattcaggagagataccactattaacattttcatatatttctgtcataatgcatacaaaaatttctgatattgctcctcttaactttatgtgatgagtttccccaaaaatctatgaaaactttctctgaagtctggcttcagcacctaaataacacattattatatggtcgtgccataattatttaccctctcaactttatatggacattaagattgtttcaaatttttgtttattttaaccaatcctttaataatacttattccatataattacttttcaattattgtaaaaacaatacatagtaaaataaattcttaatagtaaagaaataaaataataagtgtcctcttcaacctatttatcccagtcttacttccaaatttaaaaatattgagccttttttccgattcagtttttattttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatagcattgttcaattcccacctatgagtgagaatatgtggtgtttggttttttgttcttgcaatcgtttactgagaatgatgttttccaatttcatccatgtccctacaaaggacatgaactcatcattttttatggctgcatagtattccatggtgtataagtgccacattttcttaatccagtctatcattgttggacatttgggttggttccaagtctttgctattgtggataatgccgcaataaacatacgtgtgcatgtgtcttcatagcagcatgatttacagtcctttgggtatatacccagtaatgggatggctgggtcaaagggtatttccagttctagatccctgaggaatggccacactgacttccacaatggttgaactagtttacagtcccaccaacagtgtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagttctcccagcaccatttattaaacagggaatcctttccccattgcttgtttttctcaggtttgtcaaagatcaggtagttgtacatatgcggcgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgttgttgtataagaatgcttgtgacttttgtacattgattttgtatcctgagactttgctgaagttgcttatcagcttaaggagattttggactgagacaatggggttttctagatatacaatcatgtcgtctgcaaacggggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattctgtatgatactggctgtgggtttgtcatagatagctcttaatattttgaattacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcctacttgatcatggtggataagctttttgatgtgctgctggattcgttttgccagtattttactgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgattttagtttgtatttctgtgggatccgtggtgatatcccctttatcattttttattgcatctattagattcttctctctttttttctttattagtcttgctagcggtctatcaattttgttgaccctttcaaaaaaccagctcctggattcattaattttttgaagggttttttgtgtctctatttccttcagttctgctctgattttagttatttcttgccttctgctagcttttgaatgtgtttgctcctgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcatgggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtttattaggtccgcttggtgcagagctgtgttcaattcctgggtatccttgttgacttcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacatgagatgggtttcctgaatacggaacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagcatcgatggtctttacaatttggcatgcttttgcagtggctggtactggttgttcctttccatgtttagtgcttccttcaggagctcttttagggcaggactggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctacatttttttcaaagttttcaacttctttgcctttggtttgaatgtcctcccgtagctcagagtaatttgatcgtctgaagccttcttctctcagctcgtcaaagtcgttctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttcgtgtggatgtcctttctgtttgttagttttccttctaacagacaggaacctcagctgcaggtctgttgcaataccctgccgtgtgaggtgtcagtgtgcccctgctggggggtgcctcccagttacgctgctcaggggtcaggggtcagggacccacttgaggaggcagtctgcccgttcttagatctccagctgcgtgctgggagaaccactgctctcttcaaagctgtcagagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatggcggcgcccctcccccagcctcgctgctgccttgcagtttgatctcagactgctgtgctagcaatcagcgagactccatgggcgtaggaccctccaagccaggtgcaggatataatctcatggttcaccgttttttaagcccgtcggaaaagcgcagtattccggtgggagtgacccgattttccaggtgccgtccgtcacccctttctgtgactcggaaagggaactccctgaccccttgcgcttcccaagtgaggcaatgcctcgccctgcttcggctcgcgcagggtgcgcgcacccactgacctgcgcccactgtctggcattccctagtgagatgaacccggtacctcagatggaaatgcagaaatcaccgtcttctgcgtcgctcacgctgggagctgtagaccggagctgttcctattgggccatgttggctcctctccccgattcagttttttagtgagttacctttagtatctaaataatattcttatcagtacttttatcaccattacatattgcctattgactctccgtcttgaaaggtgaagaaatgtatcattcacaacacctccctccttcattccaccatccatacatttttattatgtgtttcttctacgatatctttatcatgttcaagagagcttacatgtctatttcatcaatgactacatttagactttctcttgaggtcctactatataagatgtgataaagactatcatccctacattcttcaccacttgtcagtgtctgtcaattacatatctttgaaatcttttcaaagattttcacagttacattcagctctggaccaataattaatgcttataattcaaaaatagaaatataataatcaagattgtaatactgtaattagatacatattatttgatacaggctcgaattgcaaaattggacacatatttgtaggtcatttttatcttcatgcttgctctgataacttatttaggaaagagtgtaagatgtggtctcatggtttgcacttcttcatcagattacataaccagatagtagaaaaggatattttagtgtattactggcattcatttgattacgagggaaatacgatgtatttcttctctgatttttcttttagttttcttcattttcttttagtagaaggaagttttctcccttgtagatttgtaagagcactttaaatattaaaaacagtgatagtatatcattttttaataatcagttttcagatttgctttgtgtctcactactgttgataatttctagtgcacaaacttcaaaaattttatgtaatcagctgtcaaagttcaggtaaaattctttacttataataatgataccaacccatgattattatatattttgatttttttgtgtatttcttacatgctttataatcctagaactctcatctatcccaagattagaaaaatgtatttgttttcttcatttgtatgatttcattttataatacttaattttttattccatctagaatttattttgttatatttcataaggaaattttcaaactacattttgttttccaatactcttttttactcatctacatttaatattactttcagctctttagacatattaaatatatttattttattttcggaatctgttagaagcactctgttattgagtctgagtctgcatttttatttctcttctaactcttattcatatggacttcattttcttatgtttcgtaagtgtgtgtgtgtgtgtgtgtgtatgtgtgtgttttgtggatgtatgcgtgcatatgtatttcttagtttattctttcagaagccttgaatttacatgaagttatgtgataatgacctaccttatataggacctagaattttttgttgttcttctgtaaaaccatgctccctgaactgtagtctagtcatcagaatttgccagtcaactccaggaaagacattgttttaaagaatgacgtaagctttctagaagtcaattttgtagtttctcatctccaaggggtttctttatttcttgccagcgcaacgattctgttatctgccatctgtctttcgatctatctacctacctacctacctacctacctatctatttttctacgtttaattttattctgtatcttcaactgttctgaacaggaggggttttttggacatctagtctacaatacttccagaaataaaagttaagatagacattgtttaatacatgaagtacttctacatttagcctcaatttctggaaattttaacatcagaaataatgttaaactatttaatgcctttgcaaactttattaaaattatcagatttatttcccatttggtctattgggtaatctattagaaacgaacttactaatatcaaacaatatttattttaccagagtatgttctacttggacatcatagaggatccttttaatgtactttaggattcagtttggtgttttgctcatctggattcataagttaattgcctgtgactcagacacccaccagttgtgctcctttggcaaatcacttaatttctccatgccttagttacctcatctgtgaaacaggaaaaataatagtgtctatctcatatagatgttttgagtactaactgaattaacccctgtgttttgtgtaatgctaagtataatgactaccataagataagtgctatttgagtcttagaagttttgtttatttggggttatcatttgcatttgggtatcaagttagaatttgcttcataaattgaattacatagctctccatttttatatgaccataagagtttcaagttttgaaaacagtctgtaaaaattaactagcattacagaaaaccaaacaccgcatgttcttactcgtaagtgggagttgaacaatgagaacacatgaacacagacaggggaacatcacatgccagggcctgtcagtgggtgggggtctaggggaggaacagcattaggagaaatacctaatgtagatgacaggtcgatggctgcagcaaaccaccatggcacgtgcatacctatgtgacaaacctggatgttctgcacatgtattccagaacttaaagtataataataaaaaaaattaactatcattaaaacatgtttgtggtagttctttgataatttgtcctcttttgatacccttgattagctttgtttaccgtttccttttgcttgcttttctttttttcaaatctctttacttccctgtggtgtttatattttctcttttttatacttaaatgaattaaattttaatttatctatttttaaaataatggactatttaagcctataagtttacttttgggtacagtttttccatactcaacaaaaattaagttccttttttactgctattatattctacctagatagctatttatttttaattgaagtcttgattttctctttaacccaagagttattaaagagaaatatttaggcattaatttttagaacagttgaattttgcataaaattctctcatcatgtttgatattcagaactaatttaatcttaatttttgtggcatttgatacacatctaaaagtagtaatttatgttaagaaaataagccttagataatttctgctttgataattgagtattttttatagtcaatcacaaactatggtaaatatttagttatataccacataatatgtaatttgatattattagattattcaaattttctgttttttcttacttcatctgtaaatacttaagatgagtaagttagcatcattttcagccattgacttttaaagtttttatttccaatatattttgttgtccacatatttttgtactgataattagtgcttatttgaagcataaacataataatttaaatcatgtttttattatatttttatcaatgtaaaatgagagcttgccttactgaacctagtttatttgagttctactttggccctatttaatatttcacaacttttttttcttttccatacgctttcttgacacacattcattttcttttacttgtaatattttatttgcaatattcctgttcattttgtttatctcttgtgcacattacatgtttatgtttttaataagaacagtaagactgcttaactcattagtatgtatttagtatgcatttctgacactaattctgtcattctgctttttgctttctctccctaatgtttccttgcctttttttccctcctcctttcttctttctgatggactatatatattactgatttgcttttatctttctccagattttgaaggtctgttagttgtattcattcatcctgtattatttctattttttaatcaaagacatgaataaacattgtgttttgtatttctgtatgttaaaaaagtaaatttaaacttttcattcccctcatctattgcttcttatccccaaaatatcaattccaatgaacacctttattttctttagtaatactgccagtggcatgttcttagagtatcattgttaaactgttattttaagtaatatgtctttattcccaaggctactttgcacctgtaatagtctggtggagcaggcttgttccgtgagccactagttttgcatttgttactgcttattcttctcaatgtagcatcatcagcattagcgtttgtggaaatttctccttggtcattgttttctatagccatagtttggtagatgctttgagatttcatctttcttgtttacatttttaatatttctattgacacttagaagatgctatgttcacgtaatcatagaaagcttttaattaaaccctctactctttggttttaacttttctttattgatatatataaaaaatctatttttgtgtcaaaatagcattttaaaggttactgtcattaaaactttaacaactaaattatgtacttgttttagaaatgttgatatgtggctcatctttctttaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggtacattgtttattccagtaatgtcccactgtcaagacagaaggttatttttcttggcttctctgttgatttccttggcattaagcaattttaatgacttctggaagtatccataatctattctacgtgtggtgacccaccaggttcactgtagcaggatgtttataaggcacttatctaaaagcctacaaatgcacggaggataaaccacgtttaaaggcttgttattttataacaaaaacactttcaccccattgcccaactagtgtgttaatttaaaaatatacggcactagaaatagcaaccctttaaaactaaagtgcattcaaatctacctttgcatctaattcagtaatgaattctgtcaagggttttattctgaatttttaaataatcttctaaagtttgaacccagataagccttaaaatactcattatattcaaatttttctgttcaattataaaaaagtacaaagccctaatggaattaattaaaggctcaatattttcttccaagattacttttagaaatgcaactttatttgttgtacatgctcacctaataacaaatcatgttaacaccaagggatgcattacctctgcagcttataaacattatgaagcatacaggcatgcacaagtgaaaaatgaaaagactgatttactttacctatagtaatgagttctataacattctgaccagacggtgtataactacattagctgagagaatgaaccattctttgaaaaagttagcataccatacttatgtaaaaatgaaagttactacttttttctttattttcaattaaagagggacccttattaaaaatatttttattaacctgttagtcttatcttggcagctataaaatattatatagttatatttggtacatgtgagcatatgtgtacatatacaaccattaagccataatataagtagtaaatattagttttaatgaagtgtttatgaattgggacaagaatgtctggaaatatcaagctaaatataataataatagttacataataggtatatgttacatcaggggcaatttaggttcctattttgaactactgaaataataaaactcctgtggacacagtaagcagaaaagtccacaagcccatagtaaaaagttgccatgtcctggaatgtagtaaattttctaatctattacatttcattccaatattatctgaaatgaaaaattgcttgagttgaccaagattgtgtagcagtgtgtgagtgattgcttgcttaaggacacctcccctctccatcttgtatgtctctgtgggcaatcctgcaggctcttagtgcatcttctctagtatttatcaaaacatgtcttgtgtgtgctttattctcttttcaaaactccacagaaatctctaacctttaccacttgctcaaataaaggacagtcaaaactaagcttaaaatggaaaagaaacctcctgagtttctagaatatataaaatcaaacagggaagaaaaacaagtgcttttctacacctaccactcatacagtggtgatgtctggtatttgcaaggaaagggagtaataagcgagttaattttctttggtaaatatagcgagaaaggctggagcaagagagctgtagtgattagcagggctccaagggaaagccccttgagctacttactgcctgctctcagccgaactcaatattgtactgagaattattataatcctaataagaaagatgcctcctgtgtagacacttgaagctctacacagacaattaaaatgcaacaataaacagcaattaagaaatcataaaagagaatgaaaattaagtaaatagcattattaaaataaatgcctttctaccatgtgatatcttaaatagaaaactgtaagttcttataaactaaattgtttcaggattaaaaacttgcagaaagcaagtttcataaaacatctacataattataaaaatcacaaattatatgcatataacatgaattacatcacagaattatatatcacaataatatcacaatatgccacgatgagttatatcaaaatgtgcatgcaatgtactacaattaagtgcctacagtctcttgtttaaaaaataattaataacctagcatttcaacaaaatatgcatacaatttaaatactgaaaagacacttagtgtagtgtatttaaatactgaaaagacacttagtgtagtgtatttaaatactgaaaagacacttaatgtaacagttcatactgtttcacaaaaacatgatttgacatagatatgtcaactgattgtaaaaacagcatggatcaaaatgctgcttaagaagcaaaattttattgaaagactaaaatattggagatataaattcaaattaaatgacaggtttttagcagaaggggaagaatatatacataagtgtccatatatttctatccaagttagtaactttaaataagtatttatctgtaaatagaaataatataaatcacatatgaaataatgtgtatataagtattcatctccaaaatgcttattaaccttaaacatttgtacctttattctcttatactataacatatgagtttttaaatagtttttttttatcagaaagaaatatcttactgaagtgtgaagacatttttaaaaagagcttcattaggaagtcttgggcctaattgttttttgttttataaattttaaatgactgctctgtgatgagcccatttcagttgaggctgtattatttttcctgtgggtaaaatgacatactgagctgatatggacatcacttctcccacttttgctattttaaaaatacagatatgctgcataaacatagcaaatagatttataaacatttagattcaagaaagaaagggaaattcctagatgtcagaccaaagagggaaatctaagttaagcataagcaaaagctcaagctaaactgagcaactggggtcatggggtggagggtgggagacaagtcttagttctaagatcagggctaaagtttggagttttaatgccctcactaggacttgacactaggatttggacccacagacggaaattgcagctgaactccctgaagcagggacactagaaatgctttcagacagtgaaatgggggctagaaaattcttcctgcaagcctacagaggcagctagaaaatttttctcttaggggctctgggtgggtaaaagttactaccttgtgtaggaccgaatccccaaacctgtgtgccacgtgggaatgggatacatttttattctccccttatgtgctggcattcttcaacaagtcaaggaaatgatattcccataggaaaaataatacagcctcaactgaaaatgatctcatcacaaagcaagtaaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataaacaaagaaggaatagaaaaaagtaatataaaatagacgctatattaaaattcaaaagtaaccaggtttggaaaagaaacatgtataatttacttccagaaatgaaaaaaatatgcagtcattgaaattaaaaattcaatgattgggttaaacaagagatgagaaactgcaggatagaaaatcagaaatataggcctgaaaaaattacctataaattgacatagggaagtaaataaatatgatgctaactgactcacagaattgtaaaattgaacagaagtttagcagaagttgccaaagaagagattagaagaagttgagggaaacaatattcaaaaaaataatgaaggagagaagaatgatcatgagttaaaaactattataaatcctcagtttgaggatgataaaaaataagtctacccctagtagaaaacctgtcaaccagcaagacaaagagaaaaatattaaaactgggggcaaatatctttattgtgagtgtttaccactcacagtccaacttcatggaaagaatattaaataatatatgtcctttagtaagaatattgaacccataagacagtttcactagattatagtccagaagaatcaatctataaaaagcagtagtatttctatatgtcagtgacaagcaaataaaaaatgtaataaaaatacttagaatagcaagaaaaacttcatgatacctaaaaataagtgtttgtaaaattgagataatttttaaaggttattgaagaacataaaattctaaatgaggagacagctgaggatcaccaagtaccagtgaaaatctgtgaaatttgaaatgtttaccatttctattaatagagttaattagtaccacaatttaggagggcaatatggtattatctagtatctttgaaggtgataaaaccctgtcaaccagcaattccacatccaaacatttaccccaaaaaactcttacaatgtatagagaaaaaccatctaaaatgtgctcaacgtaaatgtacttactatgatgaaaatgagaaaaataaatagcaaaaataaattgtagtgtttcctttaatctgataaaagaaacagttaaagtggttgaaatagatcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatataaaatataaatattttgttacctctaggttgcatgggtaatgcatgttatatgtgctttttgaatgtcttaatataatttctaatttaaaatttctttaattgaatgtaaaaaagaattccagatttaaaaagaggagaatgaaatttttaatacaatgtcaactacattattacattttacacataagattttctcttcaacaatgatgttaatgaatattatcatcattatatttcaaaatgtgaaagcagtgctagctcaagacactcaaatgtttataatatttttgcattgttaaaaatgttgaaatttctctcacgaattacaagaggcaagtcaatctcagatatatgacaagtcattgactataagtgctgtctgactctcagtatttgtttatttcaagtaccatatgctagaaattggctcttttgcagtttggtgtcatattatttatgcaaaatcagttggtatgtagaatctcacacataatataaattgacattgatctagttaggaacatgtgcttttatttttatcaaagtcttataatagaaagataaatagtgaagtagaagactagaaatcaaagtctgtattttcatcttgttttgctttgtttttattgcattttccattaagtccttacaggcccacgagactatgtgatctggccttggcttacctctccagaatgttcttgagtttcagtcactgtttttcagctttgcttaaatttcttgagtctcttagttgtttgtagcatctggaattttataagttctattcagatttcttgggatacctcatttctagccctattcctttgcttagccaggcatttttaatggctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataacacaatgactcatacaaaagaaagaaggaaggaagagaactaaaatctcgtgaagctttgacagtcatttagcctttccgattctgttttataatctatgaaatggtgttattgaatcttttctgcctctcagtaggtataattatcacactgaagccctgtacaagtataaagtataaccataaatacctactggattactttttgttgttgtttatattgcttttcccaagtagagataagtttctgttctttttccctgaaaggatttttatggtgtgttaacatttttattggttttggatttccctcttctttttcatttgtgtacaggaatggtcacttcattaacttgtagacttgattcctgggcatttttacaaatggacttcaatgtgtacatttaatcctgaatctaaattacagatgtagaatttttggcataaaaggttcatgcatgaatgaatttatctcttgcaacccctacagttcaaataatattatgttagtcaattttttacatggacagactctctccttgaccaaattttggaaagtcttctctgagtcctctttttgatgaggcctcatcgttgacccttgtcctcaaacctagcttggttaaagcaagaattctgctaagtcagtgtgttaagaacaccttacccttgatatctgatccctctggcctgtcttcaacaagaatcctgttaatttggtttagcaagaatcccccctacctacccctgatgtctcctcttaatgattgttcgcccctgatccttgctcgtggctataaatctctacccttttccttggcactgaatccctacttgttcatgttgtattgggaatggaggctagttctttactaaggttgctttttctctattgccatagtttctcactgaagcctattttcatcgttttaactactgtccagctctggttctctttcacaatattaaaagctgaacttgtgaaaattgagaactaatgtttatgtatttccttctccctccctaacccatcaactattatctagccttggaaaagtgtgttttaggagtaagtcctcaacaaatactgctaattaactaattatccttcttttgttaacttattttaatactaggatgcattagtctaaaggtcataacagaagaaaacctgtaattaactacaaactaccaaaaaaccaagcatgactgagaaattcctgaagcaattatcacacaaaaaaaataacttaaatgtcactggagctattcctggtaactttgtcagtagtactcccagctgactaacaatcacagttcaatatgtactgctgaagttgtacctagtttataaagcagtagcttctatgagaaagaatacaagaaaactacggtgactatttctccagagaaaaactgtactgaggaaactatagcaaaaagaaaattgatgtcaacacaatagtatctcacttcaagaaatcaaaaacaaaagaacttagtaaaatttttctaattcaactttgtttttaaagggaaaagagaactaaagaaaaaaaagacagccatgattttttgtagcgtaggccacaacattgagctatgttcaaaggaaatagatgtctaaagcacacatttcttcctaaaagaatgaaaattggttctttgggaacaaaaatatcatattgattttatgtaaaggcaaacattcacatggtgcatctgtacataaaatatatctggagtattaaagtttcatggtggggatgattatgaaaaaatgactatataggctccatagggacatgatgataaaaaatagattaagtagattgaaaacactagtctaaagtgaagtgatgtgttttaatatcataatatgtgagaatataaaagtatttacgtatggattatttacaatggaaaaatgactattatagttcatatttcattttattaatgtaattgattagaataatggtatagaaatagcaaaagcagaatatttggttttaagaaaatatggtgatataagggaatgaatattaatttctagagtggaagtctgtagcgttctagaaattaccgtgttttataggctgtagtgtgaaaattatcattaaatacgcaaattgaaaagaatcactaatggactctatacaaataaagtgttaaaatgaatttattggatcaataggagcttcccagtaggaatgctgagaggtttaatagattagactccattttgtttagattaacagttaaaacaactttaaaaatttttattaaattatgtttttgcaaccattgaagtatagataaacaaaaaaagaaaaaaattaattatatgttaataactttttaaaattcatcagtacaaataaattatagaatcataaaggaaaatagaaatctcatgatgattaaaataacattcagtctggaaggtacaaaacttttaccttcatcattcgatatttaggttcaattatattcccatctatgctttagggactgaattggatggtggtaataaggtataatatatggtctgtgccaatcttatggatggcaagaaaagaacaaaattatggttttactgtgtgtatttatttatttatttatttcaataaatgccctttagtagatatttttacatctggagacattctcacatctggaagaggacactgcaacagtagcctattttaatcttgtcatgaaaatcttgggatacatcttttttgctcaactccctggtttttctgtcttatttttttcttcggggcatagtggacactggtgatgaatttggtgtcagatccagaacatgttgtctgtacccctcttacagcagtgattttcttccaccttgtaatataattatctgaagtccgcctcatcagaaagtacatagggaaactatcgtgactctatttctccaagtagaaactgtgctaagggaactaaagcaaaaaagaaaattcctacttcctttgctataatcctcttgagggcatttttatattccctgtgatatctcatatgtcttgtatatagtagttcagctatgagttgatgaacgaataatataaagaataaagcaacgataagaaataatgagcagagcatttattaataatttgatattgataacagaggaagttaaattattcaaagagctcaaccataaagcagatggcttcactttcaagctgggaatcaaaaaactttaagtgctagaatattcatgtcaagaggatcttccaagaataagccaggaatgcaattaggggctgactcatggatgacaatggtcgatgagtcacaaagaaattttgaaaaaacaatgatgtccctggggacacatagaaagaattggaactagactgtcaagatcatatatattaacaagctaatagaaggcgggaaattttggtctctatgaaaatgtgcacaaaagtcccagaacactatacttctgtgtttgaactgtgctactctaaattatataaaatatactctataatgtagtaaagaaagatttctttatgccaatgtctcacattttatagacattttacctgctactgtcaacttaagttactcaagtatagttctgttgatttatctcctaatgaacaaccgctaatgacttaccaattcctaaggaatatctcttaggatggactttctgagggcagggccctggatctcaagtaccaagtgaagttctagcatacaggaagtattaaatacaggctgagtatcccttatccaaaatgcttgagaccagaaatgtttccgatttggtattttttcggattttggaatatttgcagaatacatactggctgatcattcctaatcagaaaatccaaaatctgaaatgctctagtgaacattccatttgagcatcatataggtgcccccaaagtttcaaattttgaaacatttaagattttggattttctgattagggatgctcaacctgcacatttgtcttgaaaaataaataatgaataaacctccaacttttaaaatgaattcttgttcccaatgtctttgctaacatcggtctctcattctatctatgtccacaagttgaatttttaaaccatgcttcaaggatcaggtcaaactccactcctgtcataaagcttccttaagccttatagcaaaaattagtgcttcctctatgttcccgtaattatttatttctcagatgcacttaccatattccaccttgcattatagttgattgtgagtatatctttttacccaactagatattggcctttaaagacagacttatttaaagacagaccttgacttatttatcttcatagtgcctagaattcctaccctaatgtgttgcttcaggttattaaataaaattgaatgtgaaattatttaatcatattttttcaaggtcattttactaggctaaaatggagctaaggaaaatgtagctaatgtctgcaaatttctaattgttgaacttagtctgaatctcagaatagtggcattataagctttcaaattagagtaaatgaaaagtagattagaccaagcgcataagaacacagtatacagaacagctgtactgtgtcctcaacgggataaactaaatcataattacagatatgtttcatctttcttgcctttatactcttttgaagatgctctcaacttcagtgctttggggatttatttgtcactgtaagtctgaaattagtttgattagttttgctgatatctatcatttcaaaatgtctgaaatctgccttaaaaagtaagctggcacaaatcttggggcagtgcttattaaggttcccacatagaagtggctgagtttgtaaatgagtcatagaaattcagtatcaaaaagttaatttaaaacaaattattctcttggatataaggaggactgctttgtttattcttaaatttttctccttacttcttcatgctatttttctcttctcttctgattttccttatatgttctcagattttatcatccctatcttctgctcaatctgggtttgtttaaagtgtttttattcagctcgtactatgcgtatagcactttgctatgcatgaaaaacatgactgccaagagatttatttgaacttaataaattttatgaagctaatgctcagtgctgtaccaggaaccatgttattttctcagactataaagttagtaagacagaatttctacctctgaatagattatggtagatagctagagagaacaatctttgagcaatacttttttgtggttgtgatagggtaatgtatacagggccacgaaaactacatggagagagaagttagttgtccaagggaattttttaaaaagcctcagtattgataataagggaattcaaggaagaggggaaatgtagagaaaatgcgtatgtagggaatattacaaatctgtttcctggaaagcaggatgccttcctttagaattattagttaagattaaccactctttaaattgagagattatatccttccctgtttttcattatatggtcagctttcactggcctgagtccacattttaagctcaactatatacaaataatttttcagtatactgagagtaggattaatgaaaccagtctggagagcagtcacagaatgagaatagatctttcccatagtatcactatgtgactaactgattgtactgatgtgttacagaaaacactgtaaaaagttaaccagaggaaaactttgctttctactttatctgatctttaccccagtttctctacctgtcaaattcctatgcttgcctcaaatgtacatatttttaatctgaaatgtgaaaagtatttataactggtgtaatatcaatgttctattatacatccatgcattaatgtctttaattttaccatgaaattaaatgaagtacctcaataacagaacagtgaactttaaatgaagtagctcaataacagaacagtgaacctaactggccccattttagtcaatctaatgcattcctgcacaggtatttatcatgacatttactctacactcaacctacatgaagatcaacatagtcacttttacgagagtagatttgcatccatccaataatctttctcaccagtgtaattagaaaggatacagcttaacacatagcttttgagcagatttttaaaaatatcattatacgttaaatatagttgagagggtaaaatgaagaatgtacagttaatattttccttatacagacatggacgcagctcataatgttgaaggatacctctgttgctgatacatctctttatttgcaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaagtaagcaagcaccatttggttctgtttgctgccccagcagccttctttgttgctttcatcgttgttcttttgtatgaacagtttctgatagtgaacttctacataaagttacaggaagaagtaatggaattttcttcaaatgctgttgtgtatttttgctcaaagcctttgaggttgtatttgtaatattgtgtagactggaatttcttagaataggtagacatagtctttttagtgtccatgattactctatgaaacaataatgcaattaaggtttcaactccaagggtgcatgatttaagagagaaaacactacattgtgatatgaattatattttccattactagtatgttcgtatgcaagttgagaaaaactctgtatcatctgtatacataatacatattatccaccaacgctttagttactatttgatgttgcctaggctctttcattattaaaaggggacattaaatataggcaataccttcattctgagttggtttgaaaaattattacttaaactatttaatagcaactgaaattttctttctttaacgtaaatgtgtttacctttctaacttcactgcctacactacccactgccttttcaaatctgtgcaaagagcatgttgtctccctatacagaaaagtgtcagaggaaaatgggaccttctgggaatttcacacagcctgtgtggctggacttaagagtgcagaatggtaggaaatgggctggagagagaaagaagtctagacgggggaatgagaatctagaacttatagggttgaatatactaagaatttgagatattttacttggagtgtcattgaagaaatttaagctaaagactgacattatcagagttgtgttttataaagactactatttagataaactatttcctaaacacttcttcctttcaactttaatcagtgaactaatcctgaacagagctataaaatattttctctgcctgcagtgcttttaagtcaagcctcatattatgaaatattatctatacgttatcaactgtattgctttcagagcagacttcaaagaatcaaccacagatggacatctagtctaacttcctcttttgtttataaagtcccaccccaccctccagactgccccactgatagatcaaagtttcatagccagccaaggggcagagctggtactcaagctttgatcatcagatgctagagacacagaatcccattcaactgtcttacaatgcctcaagggtgacgttagaaagggaagaaatgcaaggaatatattacttgttgtccagaaagtcaacaggttgtacctggtttctatttctcatttaactaagggaattgcagtgattccacagctttgggataagcagagtcaaatagtctatgaagaaattttaaaaaatatttcagccacatagagtcacccttagcattctgcttcccatcacccacaacatgaagcagctcatgcatgtctagtaggttcctggtagctggtaccctaagccctcagtaatcagtgttttgtcctgactaggtaggatgctttaaattagaggtgtagctgtaggcctgaccttggctgaagcataaagatgtaaaaacaaatcattatgcattcccagattcctcctttaaggttccttccatttctgggccagggatctaggctgtaggtccccacagcacttctgaccctatctgaaggaatacatacagtattgccaggtgttgtcatagcaccaaggctggtgggttcaaatatccttaagcctcaaagtagaaattttaaaaagtgggaggggtggaaatactgaatgaaacaccacctttcaggtacttgcatagtttctttctttttccctctgcattacaaatacatacgcaatactttttcaggttgttttttccaaaagcaacaataaactactagtggagtaaaaaatacggaactgaaagtccaactgtttgattaagtgtatgttataaccattgtatgactttgagtgaatttctatttttaagaaagtggtatttggaaccacaattttttaaaaagcataggttcaatgaaaacagattattatagaataccttggaaactcctagaaacatcaaggaaaaaaaataaacaatggaagcctatgtgagtacatataatatgtctaatgatattcataatgctcaggtttttttctaaatgtttgtggtttggttttttttgtttttaatttccaaaagtggacacgaccaggaacatgaaagagaaaagcagctgatagatattttttaaaaattaatgatgactgtgtgttttctctaagatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaagtaagtccacgcttgcttcccgctattctgctttaactgactgatcgtgagaatgggttttagttggtaattcttttaaagaaagacaaaatcaaatacacactgaattggattgccagaaccagctaaatcacattgagttgggcgtttcttccatgttgcacaagaccttaaagagccacggcatccttaatatgcaactttgtatagctgatgttctatgtaaactttttgaatgggcaaataaattaatgaagccgctagtgtattttcgtaaagcaaattataggtattggaagaaactgtgttgtgtttatgtgaaaagagctgttttctggagttgtctgtggtgggatacttactaaagtttttctcatcggtttctatttcatttcaaaactgatactcaggagatttacttttccttctacctgatatgaatgttaattggaaaagaaatgtattacataactaattaaatgcttgccatgaggcttatgtaaacaacatatttgctggagctcaggcagaaactaccctaaaagtgccagattggaagcacgtttgttttaaagcccacacatatgtaaaaacatacacagataaacaaatgtagcagcctcagaaatacaggcttatttttttctgttgtggattacttctatctagatagatatcctggggtttagaattttattttatcttgcctaatactttgttggaaacaaaatttggtgacttatttataaacgtgaatacttgcttgttctgtgaaagttaataccttctcagctgatagttaaaatacctgatcacaccagaaggtgtgatgggaaaatcccttcctaaattaatgttgtttaagcctagtttacacctaacaaaatatagcattatttatgaagaaatcataattgattaagcaaataaaagtatgtttatagtcagtggttttcttgcatgacatgtgagtattgaaatagaaaaacttagtatctcatatgctactcagtgaatgggaactggtggtgttggctggttgaaacacttttaacttatggccagtttcttatatttaacagaactctgaatgctattacaaaaaatgtgtaaatgtctaaaagacattttcaatgaacatgtattttaagagacagagtatgttgcataaaattcaatagctgtaaaataaaaatcgaattaaacttttatttgcaaggccctttacagcaagaagtcattttatcctattctatttaggaaactctggtattcccaaaagaacaaaacagcacataagacttgaatttctactgcttaaaattgccaaaaaaatataaaaatatactgtcaatttaaaaaaaaaacaactgagagctccaagaagagccttaggtcaaaattggatgaatttcagaggccttatttcttatatgatggcaacacttaattaaagtagcttataatagaaatattctttaccagattttccatcctttcttctttggtcatatgcatttttttttctgttggctgacaatcaaactgacagaaggaaagcaagcaaatggaatattcggtagaatcagaacaaagaatttggacatcccattagtagttgttggttcccgaagataacttcccttatcctggctgaaatatttttcttataacccacagtgaagctcttcatattcccctaccgatcattttcacatcaaaacactgttcttgcctgtactgccgtttccattcagtgaacaaaataacattaacagggtgtgcaaattgtttgaatacggaggacatttttaatgtaacgtggaagcccttggtggtttactgtcaggcatctcagtatgaatgaaacaatttgccttaataactgaaccatgtaaatttttgatactacaataatactgcaagctctcagaaattaccacagtacatcttaactgtcatgtcacatcacgtaaattatagtcatgatgacatgcttagcttggttgatttaatatcttgctaaggaagtggaaaattgtagggccttgttggtaaattcaataaagccacttttctaaatagttgaggctaaattctttaccagtaattgctgttcgaatcagaaccattgccagaatctgacagaaatagcgtatcaagatacaagtgcatctgcttaaatattgaattttatttacatccatgaccaggagtctatggtacataatccttcctctgcttttttagtgttatttcctaattggaaaaaattatgagatgctattagcttttcctaaatatttatatacagactttcaaacattttccaagttgcttggttataaggcttcttctaacagaagggcgatatgctgtgcatgttctcttataatggagatgccacatgctgttattctttttttaggagcctaatcccaaataataaaagtggctcacatgggacacatttttgctaacatggatgtctgcctggttgtaataaaactcaagaatactagccaatttagcaaaggagtgctttgtatcctgtgaaacatttttcacatttttactgttttggaataatgaagtataagtaagtgattataagtgtatgtgtggataatggatgaggcctaggaaaacttagcacgtttttatactttctatttttgaaattcccacagtctcagctaggagttgttcctccaattttttcccctatgtaccagtgaatatttggcacaactggcagaatcaagtgttaattttcccgcctcgttcttgatagtcaaagagaattaaatcaggcacccacagggctatcctaggtgcatttcattttcaaaatgcttggcaaatgttaatgcttggttttagggcatttgtttaagcaactaggcagcagtggaaagagctagaggacaaagaatcctgctggtttgctgcaggctacagctattcagaaacagtttgggaatttcagagttgggataatttactgccctagtaaactaagtgctactggaacattgcaacagtcatttgcttaaggttgccctagtggtctgaaatagttgaggcagcttccaaaagcaattctctttgcatctgtaaagttctgggagaagctagcttggcttgtctgctgttcctgcattaccattaaggtttgaaattctctctctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaactgatatttgagatttgtaggacagggtagatctcatcatataaaagaagctcaacaaataccttgtaattgatgctacatgcttaacacaaacaaacaaaactctaagaaattgttttttttaggttgctcagaaatgcccattgagttggatttgtgggagttgaaagatgaattctgtcttgctttacaaaataattaaaaactcgctaacaaatatgttccactctcctttgagcagcatattttgtgacttctttgctccatagtcctcaaaattattcagaagtggagttcaaacccctcctcgccatccataacttcctcctatttaaatcttggattaaatgggttagttaagaagatcattatgcaagtgaagaatggtatggctataaaagtaaataggataaatcaactgtggttgattttttattccataaatcagatcccatcaagactaacttggcaatggagtagaaccaggaagaaggtttgctgcctagaataaactgaatgaatttgtaaaccaaaaataaaattctaagacccctgactgaacggacccccttcttggccaagggaatcccaaagaaacctaaagaaacctgaacatcatgggaagggacgattacacattcctcattataccctgctccctttggagtttagacaccacagaccaacagtaacattaaaacagagattttaaaactgactagacagacactttacagcaacaagataccaaattctaacctcactctggtatagcataacataacagatagcaggccctaaaagaaatcaaagtattttataccaaaatatatttatttgacatattctgaaatgaccttgcaaagctgtctcttggggaaatttgcattctatagagaatctccttcccttactaagtcttttctggagagtcagataccttttaaggtctggcaagagacattcaccatcagcctgctactttaccctactaccttgaggcttcatctacatgacaagaaccgtggcttccacaacccactctcttaactcaagctgacttcaactgttcaggcagaattttactctttcgaccaattgccagtcagaaaatctttgaatccatcaatgacttggaagcccccacctcgcttcaagatgtcctacttttctgggccgaaccaatgtgtaacttagtactggtgtatgtctttgcctgcaactttcgtctccctaaaatatataacgccaagctgtaacccagtcatctttggcacatattctcaggacctcctaaggctgtgtcacaggccatggtccttaaccttgccaaataaacctctaaattgattgagacctgtttctgatactttttggtttacaaattgttaaggataaatgagaaaataagtattaaaaaacaaaaaaaatcaaggactcatttatttcccatagctatgatagaatctgctgtgtaaaagtaacacaaatgcaggagctcaaggtcaaacatagaaacctctgtcttacatatccgtcataacattctcttgacgtttttcctaattaaatttataaagcattagttctaatgttaaaaattgttatataaaaagcattttaatattcacatgcatctgtctacagtgttttacattttgtttataattcgtcaactgaatgaatactagataggagaatgttccatttaataaaaactcttgagaaaaataaaatagcttacttaacagtaatttcaatgtgagttggtttgtgatgtggttggcaacaaaacttacgtaatctagggctacattggcaggaatttactggtcaggacaaaggaggtagtgtttatacagattctgcacaaaacgcatgtcacctaatattattattaaatattattaaatattattaatatttagcttacttgtgaatttctctttttatctttgttaatatacatgacccaagtcatcagctaataaaccaagaaatccaaattaggaagaaatagagccaggattacaatccagatgtgtctatagcccattccagttaagcattttttcaatcagttaagtttattagttcttgcaaggcattgatctttggaatagagatgctgaagcagcttattcaaaagaaagggaacgacaaagatatgaatttataaaaatacaaatgaatgagatgaataacaaatgtcaatagaggggacacaaatccaacaagttttttaaatggtttcaaagctctggcaagattaatcaagcaaaacgtgggtaaaacacaaataaacaattttagaaatgtaaaaatgggcataactgcaattacttcaaaaataaacaaataaggaagtatcagaaaataaacaaattaagagtattatgaaaatttacacacaataagaatacaatttagaaaaaggaatatccttctaggaaaatgcaacttaaaaaaactgactcaaagaaaaaaaatctataatgtcagataaacattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaactgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagtcaggctaaattggccaagtggattttatcatccgtgtttgaggttactttaaaattagaaaaccagtttaagtaattgaccatattgactgattaaaagagaaaaaaatcaattatctcaatagacacagaaaaagaaatgggtaaaattaaacattcttcatgtctgaaaaattttgaaaactagaattggaaaagcactttaactgatgaaggctatctacataaaaatcaatagcaaatatcttatttaatataaaatgttcaaagtattgtttaagatcacaaacatgaaacaattctcactataacgactcccacttaacattgtgctagaagatgtggacagtgcagtagataggaaataaaatatatagggatcagaaaggaagaaataaaactcacttatagatgatatacttatctgcttgtaaaatcaagagaatctacagacaaattcttaatcagtgagtcaataaggagactatatgcaaaattaatatacaaaagtcaatcatgtttctttatatcaacaacacttttcaaaaaaaatttttaagaggccatgtataatagcaatacatataaatagtaccaaggattaaatttgtagggaaaagccaatggccaagaataatcaaaagaaattatagatggggtgcgatggctcacatatgtaatcccagcactttgggaggccaaggtaggtggatcacctgaggtcagaagttcgagaccaccctggccaacatggcaaaaccctgtctctactaaaaatacaaaaattagccaggtgtggtgacaaacgcctgcaatcccagctactcgggaggctgatgcaagagaattgcttggacccaggaggcagaggctgcagtgagccaagattgggtcactgcactccagcctggggcatagagcgagaccctctccaaaaatatatatatacacgtgtatatgtgtacacgtatatatatgtgtatatatatacgtgtacacatatacacgtgtatatatatatacgtgtacacatatacatgtgtatatatacatgtacacatatacatgtgtatatatatacgtgtacacatatacatgtgtatatatatacgtgtacacatatacatgtgtatatatatacgtgtacacatatacatgtgtgtatatatatacgtgtacacatatacatatacacgtatatgtgtacacatatacatatacacgtgtatgtgtacacatatacatgtgtatatacatgtacacatatacatatacgtgtatatgtgtacacatatacatatatgtatatatatacatgtacacatatacatgtatatatatgtgtatgtacacatatatatgtgtgtgtatatgcatatatgtatatatgtgagtgtgtgtatatatatatatttagaaattctaaaggaaagaagtggggctttttggaaagggattaggtcatgagggttctaatctccatgaatggaattaatgcccttatgaaaatcttatctgatataaagagttaggacttactttaaaagatataatgactaaggcaaaatgctatcagtgtgaaaataaaccaatagacctgaaaaaatagcccatagatatcacatacatagatgaatacttaacttttattgaaataggcattgcagatcaatgacaatgggatagaccctatacagtaaatggtctggtaccactgattatctagagaaaaaaaataaaatttctgcatccttactccacattatacataaaaataaactccccttgaaacaaatcataaattttcaaaaattatgctaaagacaaacctttataaagacaacacattgagatttctgctcctgaccataattgaataatagtatctagatttccttatctaccttaaacaacaacaaagcctgagggggaaaaaatgtggaacaacagtttttagacactcttccacagatagcataaaactgtgatctctgaaaaagagaaacaaatggggtgaggtttacaattgccccaagattattgcctggggacagtctccagggtgaagtgcattggtatattgagaaaaaagccaaacacagcctggccttgccaaattgaaagacagaggttagggttcatggaggccaaggcagctagcatttgtgaggcagcatacaagggaagaggaacctgacctgcacagagagagagacgaggagagagctgcagctatctgcaaagagaaaccggagtactgagttgcaaatatgtgaaagaaaactacctaaggctaatgaaagaatcactaaaaagtagtaagagaaacaattcctgagctgatacagggctgctaatagtttattttcctaacacccaaagtggaatgtcttcataagagggactaaattagctccaaactacaagctactctaggttcaccccaacaaatcttgaaaacagccttaaaagaagtcaacttattccaaataaattaactgcatgccagaacaaagtccaatactatttaattacaacaaaatccagcactcaacaatgtaaaattcatgatgtttggcatcaaatcaaaaactaccaggtacataaacaagcagagcatataagccactaccaggaggaaaatcaatcaatggaaacagaaccccaaatggcaagaaaatcatgtcaagatatatcagaatcaaattattaaaaagacagataactggaaaattgtaaaagcaatcagaaaaaaactaacatggccaggcgcggtggctcatgcctgtaatcccagcactttgggaggccaaggcaggtggatcacgaggtcaggagttcaagaccagcctggccaatatggtgaaaccccatctctactaaaaatacaaaaattagctgggcatggtggtgcacacctgtagtcccagctgctcaggaggctgaggcaggagaatcacttgaacctgggaggcgatggtttcagtgagccgagatcataccactgcactccagcctaagcaacagagcgagagtctgtctcaaaaaaaaaaaaaaaaaaaaaagaaaagaaaagaaaacacaacaggtgcagaggaacaaagataaggaagaatagtttcttgtcagaccctatatgctatggtccaaatgttggtgtccccctaaaacttatatgctggaacctaatgcctaatgtgatagtatttagaggtggggcttttgggggagtgattaagtcatgagggctctaatctccatgaatgggattaacatccttacaaaagaggttgaggatgctgccttgccctttcctttacgtgaaggggcagcaaggaggtaccaccttggaagcagagagcaagccctcaccacacatcaaatctgctgatgcctggatcttggatttcctagtctccagcactgtgagcagtatatttttaatgcttaaaaactacctagtccctgttattttgttgtagcagcctgaatgcatcagtacactttgcaagccagaatacaatacagagatatgttaaagtattaggaaaaaacaacgcaagcaatcaaatgaacaaaacaaatactatcagtctataattctttaccaggcaaaaatgtcttccaaaactgaagaaaaaacaaagattgtttcagagaaatagaagttgaaagaatgtgtcacagactgatgtacacaagaagaaatgtagaaagttcttcaggcaaaagaaaaatgttaccagatggaaatttactcctacaaatagaaattaagtgtatcaaacaggtgaatagcaatgctttgtcactagtgctagctgtcacaagacctctagccagtcatgttttcagctgtagggcctaacaccatggttaaggaatggttacctaaatacacaaacttaaagtagaacttcaaatacttcctgtataaaattttccctctgaagttttaaaaagaaagactgggttgtaagaagagtataaaaaaggcttgcttctccagctctcatttctcatttcaaacttaaagaaagaaaaccagcaccaatttgaaagtgtttcaataaactctcaatgtaaaacttcacgttgttttctgtagcttttcagtaacttcttacactcatgttctatgtgcggctcagtggggaactatctgtatccagtggattgttggttctgacacactagcctacgtgcatatggggcaacccccaacatgctggcccctgccacttgcaatagatcagacccaccccttgtggttgagtgaggcagtattatgtcaattctaaacctggcattttgtttactgttgttgagtgttgttggtagtgggagaagaaaataggtcacagacagtgtgaagacacaaggagaagacagccatctacaagctaaggagagagggctgcaacagcttaattccttgtagtgttcataaagaaccaatcctgctgacagcttgatctcacatagcaaaataatacatgactttttttcctccttgatttccatgagaattgggtgaaagctattactcatataagcggatgacctgattctctcatttttgtggttacctttgattagtgttttggtctttatgcgtttcacagacctgattcaaatgctggatctctgctttattagctttgtgatcttggacatatcccttaatctagttgagccagattctcattatctgcaaaatgaggcttctagcacccctcagaattgtacaaagctctcgaaaatgtccttagcacacagaagctgtccgataaatgccaattgctttatgaatttctgtagttgtatgctgcagtaatttattttggagatcttccttatatcagtaaaagacgtttgttaaaaaacactttgtcacctgtctgacatagtatctggtggtagtaaggataagacatcattaaaaataaaaattgacaatcagagagagttaattttagcaagtacgtagattatatgcctttaatggcagctttgcagcaaagtgcaaaacataaataaatcagttaaccagatttgtgaaatacccgcagagtgttttagactttattttgaaggtgccaaattagagctaacatgcatcgcttcatgtcttcccaagaaaattacatgacaaatatctatctctgcttcactgacaacctggcagtgaaagggatttgaggtttgtgcccatcagtaactaattagagaagtaaatgttataactagtcagtattctgtggctacaatgtggcaagttaaaataatatccttaaggtgggcgctaacgcaatatgactggtatccttatgaaaaaaaaaaaaaaggacaatttggagataaacacaccgacagggtaaacaccatgtgaacatgatgatggccattcacaagcaaaggagagaggcctggaacagattcctcttagccctcaaagggaactaaccctgccgataccttgatttcagacttgtagcctctagaactgtgaaacaatacatttctgttgtataagccacccagtctatggtattttattatggcagccctagcaaaccaatacaaatcataaaacatcaattatttttaaaatctcataattttcattcttgttatatatatataaaacaaataaaaggtgactctctctaatgtataaagaagttaaagaaattgataacagaaaggccagcagtccaacagaaatgaatgagcagtttatagagaaggaaatttaaatggctcttaaatgtatgaaacggtactcaacccgactcatagtatgctaactacactgagaaatcattgtcttctaacatataggaaagtcaaccaaatgaataacacatgccattcctgtggcttcttcaggaacaaaggtcctcctaaattggtagtgtgaatatacattgatgcaatccaaaaaaaaaatccaaagttatagctgggcagggtggctcatgcctgtaatcccagcactttgggaggctgaggcagatggatcacgacgtcaggagatggagaccatcctggttaacatggtgaaaccccgtctctactaaaaaaaatacaaaaaattagctggacctagtggcacacgcctgtagtcccagctacttgagaggctgaggcaggagaatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatacacacacacacacacacacacacacacacacacacacacgtgtgtgaaatgacatatatgcaaagtgattcattccagaaatgtttgtaattgtcaccacaaagctgccaatcactgagagactgattaaatgagttttggtacactcgtgccatcaaacactataaaattattaaaaaaggaaggaagatttttgtataataatatggaatgatccaaggtgtattttaaataaattaaacttaggaggccaggtgcactggctcacgcctgtaatcccaacacttttggtggttgagacaggcagatcactggagaccaggagttcaagaccagcctggccaacatggtgaaaccccactctactaaaaatacaaaaattagcgggtgtggtggtgtgtgcatgtagtccccactaccagggaggctgaggcatgagaatcacctgaactccggaggcggagattgcagtgagctgaaattgtgccactgcactccagcctgggtgacagactgagactccatctcaaaaaaaaaagaaaggaaaagaaaaaaaggaagggaagggaagggaaaggaaaggaaaggaggaaggaagggagggagggagggaggaaggaaggaaggaaggaaggaaggaaggaaggaaggaaggaaggaaggaaggaaggaaattaaacctaggaacaaagtagtttatctatctaatctatatgtatgactactatttgtcttttaaagtggagaaacgaatatgtccttgtaattataaggtgacttagctatttagagtcacatctagcatttgcatcaaggtgagtttgtctcaaaagctctgttctagtgccccactcaagaacagatattgtcaaatttgtaaaagatattttaactggaatagacttgatttttattgctgatttaatctattacaaactattgcttttctattctaagctgttgtaaaaattattgctttaatatgatcacttaataagcattaaatgccccaatcctatctgctaaaaattgtttggcatgtttaattgatcacaaggatttgaatagcactcttatcttttcaagtatcttcaagaaattcttattttcagcagggcatgttgaggaaacataaagcttacattttttattcctgatgtcttctcatcacttccaacagtagccactgagtcaaagcagttgctctctttccttactttttctaaagctctccctctatattagctgtgtctgagattgcaggcagttaaaatccaacatttggcacactgaaaaaggggctatgtgatagggcctccaactgaaatgtgatgaattattaaacaggtagtttgttgggtgattgaaaattacctgtgaaagagtgcttatctccttgaggcacatcgaaagctgacggaattgagccaattagactgactgtctcttcaatgagttgtgacctatcaatggtaatagcttattatgatgataaatgaacccatctctcaaactgaagcctgagtacacacttcagcagttgccttgaatcatgaggccattgcctctcaacttcagatcgacagcagtgacagccacaggagcagagagcatgcatgactagacacagatgattgttttactcagatgaatatatttacagctatttccaaagaaacgggcccttcttttgcattgtgtattcgtatctgaaatagttaccatatgacgtttccttcattaggaagagaacccctccctggctgtagcattctgaaataactggattttgaaggtcttttttttttcttcactttttgtttattgtttacaatgttttaatttctcattcttgtgagtaataactcaactcctggttaagtaaaatttcagaataaaaatattgttttatagtaaagatgcttgtaatatcaaaacaagtatgtttttaaaaaattaatttcatcctattacatttcacattttatatttgatgtgggttggaggagccccttagagattcttttttctttgtagagaagttttgtagagatcaatagtgtaagaatcatacaagtgtaaatagttttgtttccttttaatttttcaaaatatttgaaaattctttaagtagttactgaaatttggtaagttccatgtgctgctatattgatacattttgttttagaagaattaggagcaaaagggttatttttataatgaaatacaatcttccagttcctaataagtattagacacctgttagctgccaacttcccaaaaatacccctgagaaaaaaaaaaacctgttggtcaagaaagttcacgaagttattacagtaaacaagaacatcaccttgatattcttagtaatgtctcagaaggtgagggtcaggggaagatatttacaggctttagggaaaaggctggttgatttcaaggcaaatcttgagtgagagggaactggttgggattctgcagggtttattatataatagttttggatttgtcaccagagtgaacaaacattgaagaacatgttatgagtctataaggaagttagcttagatggatcacagagcagacaaggttttcttggagattgctcacagcattcttaaaatagggggtggacatttttcttactcccagcattatttagcacaggaaaggaaattgtgttagcgttagaagaaattgtgtttgctttagttcttacagacaatatatttacttaatcttctgtgacactgtttcttaatgtataaaatgaaaataatatgaatacctactttatagtgttattttgagggttaaatgagttaacacatatgcagtactcaagatggtgtctgaaaatgataagcatttggtattagctattattattaactccaactgggcttaatttgaggtcaggcattattttgttgaaattttagaaagactcccctcacacataaacagacagaaagagagagaggaagaaagaagaaaagagagagatagagagaggcagaaagagaaaaagaaagaaagagagaaagaaaaggaagagaaagaaagaaagagaaagaaagagaaagaaaggaggaaggaaagaagagagggagaaagaatggaagaaagaaagaaagaagaaagaaagaaggaaggaagagagggagaaagaaagagaaagagaaggaaagaaagaaaaaggaaggaaggaaggaaaagggagggagggagggaaggaaggagggagggaggaaggaaggaagaggaagcagggagggcaaggaaaggaaaacaatggaaagaataaagaaataaatgcagcaggaaaggaaaaagaataggaagaatttgctcatatctgtctaatttttagggtattttgatatacaaagtaactgactgtcaggacctgtcttagagatgatctggtaggacagtaaatggcttttctttccagttttcatctgggactgggtttgaagtgatcatcagcctcagtgttctggaaataagtcatttataatgaaatggaactggaaataacccacagacaaaaagctttgcaagccattgaagttcccctaggccatttactgccttaagctcgtttttactcatactgcaggaaaaaaaagagtgagtagggaggtggtgttcttatatcacataattttaaattaagatgtgatggttttatataaaagcaaaaatgctttattttgctttttttgttcaagacaagtacagggatgaaatgtaaatatgttaatatctaatcttaagtctgctcttgatccgaaactcttttgaaactttacctagaaaatgatagagcaatttaatgtgtctcacaatctagcagagatttggagggtgatggatagaataagggcttaacacaagaaataatttctgttgtacaaagctcatgagcttcatgcatggtgaaagatatttaggctaaagaaaatgttaactatgcagggaatgaaactcgtgacagcttgatcccataaaactcagcaaggatgaggtttgactctgcatccctgatttatatagtacagtatgtttatttaaaggagataagccaggttaaggggttcagcaaaactgttaaattaactcctttaaaaatctagttattgctatgaaagtctctcaagtgcggtgctcaggcttttttgcatcagtcatctggagtctttatttaaaatgtttattattggccgggcgcggtggctcacgcctgtaatcccagcactttgggaggctgaggcgggcggataacgaggtcaggagatcgagaccatcctggctaacacgatgaaatcccatctctactaaatatacataaaaattagccaggcagggtagcgggcacctgtaatcccagctactcgggaggctgaggcaggagaatgacgtgaagccgggaggtggagcttgcagtgagccgtgatcgcgccactgcactccagcccgggcgacagagcgagactccatctcaaaaaaaaaaaaaaaaaaaaaatttttactattgacccttactctggattcacttatccagaagatctggggaaatctacgtttttaatcagctccccaagtgattatttacccataagaatttggggggcactcttttatgactacttttttaaattactgatgattaattatctgcagatagttccctagactttgactttccaaggctttaaaaaaacaaacaaacaaaaaaacctgcagtatgcttttagtctgaattcagggattgactttcttatccaatagtctatcctgtacaagggaaccctaaaataacctcgttagccaccaccaaagactatgtaaatacaaatttatttatcaatctcattagaaaccgaaccacgcatgtgcacgcacacacacacacacacaccacaccaaccacacatttacattggaataaaatgaatcttagaaagcagctatttttaaagaaacaggaagtctaacatgtactgccattaatttggaatgggagagaaaggagacttggcagaaccagaatattgcgtgaggattgaagatagcttcagattctagaagagtttctagctctttctgaatatgtgttaacagtttcgctgtttgagctctgctacccactagccagttataaacacaggtaagacccttaacttcacagggcctgttgggaagaggttataattttttagcaacagaacctgtttttcaaacaaaatcctaattagaacacccaaaaacaaacaaaataaaggattcaaatgggtgacatggccagtcctggttacagtatgagacagatgccggttacggtgggcaacagaacagatgctggctacagtggtcgacagagttcattttagttcaagcagaaggtagggctggtgcttgttacagtggccagtaggcctggtttctggttatagcacatggcagagttaggagctctacctacattatgtccccacggcctcatctgtggtttccccataagaaaactaccttttgggaaaacatgatacaaacagatcaggtgaattagaaggtctcctgcagatttaaaattttatgaatataatgccaaatataatcttacactcagttgactactaataataaataaccctacaaaatatggtaaagtgactccatgacaacaattgaaaagaaaataattgcactcagctgagctattgtccatatctagatgcactgatgatacacaaacccagccacagaaaatgtggcatgtgtcagagcaaagcaactagaatgattcaagacactgaacagccagtgttcaagctacgtaatttcttacctatattacaggaaaaaaccatctaactctttttctacctccaacctccctcctctgaaatgttattcacatacctggtggagaagaatctttataaaactcaaatttgattaccttagtcctctgcttaaaatttcagtgtctttcaatgaaagctcagagaccattctggacttataactcccttgcagctcagaagggacccgtggtccagtaattaaaatgcccgtggtaagtgttcaatgctctctcatgcttttcttctcacaatgtcccttcagtacgggatttctttctaccattttcctgagtaattaccttctagtcatcattcaaaaagcatttaagcattgaattctataggaaatgtttctaatcaccctatcccccagctctggctgagttaggccttctctgcacaattcccatgaaagcacctaccacccagcaggcagaaatatccctctttgactttctcactaaactgcaaattcctggtgagtgacaactggattctattcttcttctaacctctagaacctagcagattgctttggagaccttaggaacttaataattctttgttgagtgaataaagggatgctttttgtggacagcagttatttctgtttacacaaaagataagagaaaatacaggtaaaattatcctaaattttaaaaaatttgaaacttacaaaaagtgttggatttaagttcctttgtctgtctggatttccgaaatatttttaaaagattttttctgggatcatttaaggcctcatctgttcagaaccaaggggaggaccgaaatagtatgccaaattcttttccagccctcaaattttatgagcctgagttgcattgtgtgggtaaaagtcttgtgctctgtggatcaggaggaagttagatgttttggatatttacatagaaacaaagaatttgaagactggaaagaacttgagcaggactctattaaatgtgttttgtgtgagatggttttcaccctgtgttcttgtggttcctccatgctaggggcaggaggtaggatggagcagatagggagtctcttttcctcttaaaccggatgttttttttaaaatcagttttatatgttgagagtccatggaatggaatgtggaaactgagaccctgaaagattaagtcacttgaacaaagatatacagcttctccagagaccaggcagacactaggtttatgatttcctgacttccactgcagatctcttaccatttttctatgagagtcataaaaaaagaatcagctatttactttctagtcaaggtgggttaaaatcaagccacttgttttcaaacatcgatttcgggttcatgccatcaaattaaaaaattcacttaactgagtttaatttgctttcacttaggaagcagctgcctttcaagataataaaataaacagatacaataatatttggtcagctgtggcttttaatttaaatgtttgatttaatgttgtttagtttgctggattccaaaatattctctgcaagagaagcatacacattctaaagcatttcaaatgtttattatgatgtcctagaggtggctgtctttctgttgctgtgcataccctgagcagacttgacattgctttggaagcacatattttctgatagacatattactctcataatctaaaatttttcagaagtgacaaaagtggggttgaccattttcttcttcgctgtctccatgattttgctttttccaagatgtcatgtagttagaatcatacaatgtgttgtcttttcaggttggcttttttcacttagcaatatgcctgtaaggttccgccatgtcttttcttgccttgataattcatttctttttagctctgaatactattttgttgtctggatataaccacagttgaattatccatttacctcctgaaaaacatcctgcttgctaccatgttctggcaatatgaatcaagctgctataaacacttatgtgataagtcttgtgtggatataaatattcaacttatttgggtaaataccaaagagtgcaattactggatcatatggtcagagcatgctagttttgtaataaactgccaaactatcttccaatatggttgtataattttgcattctcaccagcaatgaacaagagttcctgtttctccacattctcaccagcatttcatattgtcaatgttttagacatcagctattctaatagatatgtagtggtatatcgttgttttaatttgaaattctctaatgatgtaagatgatgagcatgttttcatgtgcttattttccatctgtatataagctttgctgaggtatctgtttagattttttccaatttttaaatttattttcttgttgttgagatttaagagttctttgtatgttttggaccatatcaggtatatcttttgcaaatattttcttgcaaatggtagtttctcttattctcttcacagtgtctttcacagagaagatgatttttaattttaataaaatctaaaatgaatttttatttcatggatcttgactttagtgttatatataaagagttactgcaaactcagggttatttagattttcttctatgttatcttccaagagtcatagttttgcattttatatgatccattttgaggtctatgatccattttgtgttaatttttgtgagggtctatatctgcatttatgtattttttcacaagttatctcagtcaattttctgttgctataacagaatacctgagactaggtaatttataaaggagagagttctatttagcttgtgatcctgggagcttgactaggagatccaagttaggacaggtgcatttggtcaagttctggtgagagtcttgtgctgcatcttaacatggtggagaagtggaagaaaaagtgggcatgtgcaaaatgaccaaacacaagagggagccttcctttttaacaacccaccctcgaggtagctaatccagtcctacaagagcaagaactcactctaagaaaggtattaattcctttttaaaaacctaatcacctctccaaggcaccacctctcaacatcaccccattaggaaccaaacctcactatggattttgattgtgacaaaccatattctaaccataacacaaatgatgtccagtttttctagtgccatttgttgaaaacactttcctttcttcattgaattccctttgctcctttgtgaaagatcagatggccatattcatgcgggtgtatttctgggctggctattctgttccattgatctaagtgacttttttctcaccagtactatattgtcttgataactatagttttatactaagtcttgaagttgggtagtgttagctttacaagtttgttcaatattatttaatgatgtgttggctgttcttggtctttcctctccatataaattttagaatcagtgtgttgatatccaaaaaataacttgctgggattttgactgggattaccttgaatctacacaaattgggaagaactgacatcctaccttgagtcttcctatttatggacatggaatacctctccatttatttaatttttctttgatttctttcactggagttttatagttttcctcatatagattttgtacataatttgttagatttatattgaagtgttttgtggagcatgctagtataaatggtcttgtgtttttaacttcacattccaattttctttgctaatatataggaaagcaattgacttttataccacctttttcttcagacagatggaatcaagtgacttagaaattggctttgttgctctgcctgagtatcttgaaaattctcatcttccttctgagaaccataacctacatatctcaaggttatagataaaatgctacctacaaaatccttgtaatgcttacagtctaaaagactaaataaggcctcaagagattattcaaaatcagagttgttgattcccagtagagtcataaagggctatgttatgttagctgcaattctaatcctatatcaaagcttctgacttccactcccccatatctaaggaggtttccctcaacagttgaaaaataactgcagatactgctttgccatcccatgccacaaaaatgcatttctgaaggatgctgcagagagatatatatttcttaagcccagctcatatctatttctcaaggctgtgtgatatcatagaatgaatgatggagtcaaataaataaatatttatttatttatttatcagtcaaataaatctgatttaattttttagaacttaacatttagtagctgtgagatcttacagagatttcttcaccttgtatcctttgtcactttatctataaaatggagagtgtaaatactacttcttagagttatcatgattctttaatctaataactcatgagacactggatatgtaataggaactgaataattcttaacccccttgctttcccttgacatttccagaaaataaaacttgattgagtatctaagattatataacagatcccactagactaagtgaatctgagggaagatgtatttgtcacttttcttctcttctttggtttttaaaaagtatcattagaaatagaatcagtaactataaacaaatttctgtgtactgatccagtattaacagagaaaataatggttgactgtgccttactgtgcaaggcaaaaatgagctcaagatattatcaaagtcatgaatcagaaagagaatttcgttttacaaatgatggatagccacaaaacaactaggacatacaatctctgattacacaactgcagtctatagctacattctgcagattaaacaccacagtagagatggaaactttattgtttatattttatgaaaactgttctcttttgtttttatgtcagtttgagagtagaagaatatccttgagggcaaaacatgcctttcatacattagagctgcctagagcatagtctggcacattatataaatattaaataattcctataattaaactgatgttctttggaatgaggatggagacacatagttatctgaattgccttaagctagttttgcaataagtagatttttactattctagaatatgtaatgaatgaatcatgctatgttacaagtaagtattaattaatggttgaagtacaaaaacatcttccttgaattatatgataatctacatcacagtgaaaggaatttatcatgacaaatgctagtcaatgttgaatcacagagggctatatgagatccattttcattcttaaagaaaattattatatctttttattaatatggtgaatattaactcagtaaataataaagaaaactaatatgaagtacaatttgtaatattctacttatgatgcatgatttttgttgcacaattagaaaatacttaagttcttgagaatagttggaaagggttgtaatgatcagaaacacatattatacctaaacatgtattaagaccttgttttaaaaattagatcttggagcaagaaggtaagctgtatcattacgttcttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaaaaaaaaataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacatgaataccaaattatttggttaatcttcgaatttcttttagcaattatatactctcctccaggttagattgagctttcccttcaactcagagaaatcagtgtcaacaggctaccttctgtaagactaccagagagctatgcattactctgtacaaaggatatttctcctataaatagtgctttcaatagagaaaatctgttatcatgttgtcagtaaattcaaatattttctcttttggaatactctgttcctattaaaacaagagctgtttccttctttgaaacaagttatttatatttatgtggttaagatatcctatcttaaaccataagacctttttgaatacttcacatacagaaaaatgaaaaaaattaaacaaatatcagagttgctgggaaccccaggatataatctactgtggatagtcattcatagacaaagacacctcctatttataggcttgggacagttcagcttctccaacttgaagagagttttgaagatcaaatacaaatgggtcttgtgaagtttcaaaaaatgtttctcaaagtcctttgagaaaaataaacttgggcctgtagccaatagtttgtattccaggcttttaaaaaaaattcaaatacagaaacatcagattttcattgccataggggtcatgacatattttaacataagtgcagaaactatctgtaatgaatcaaaacttaaatcagatgacattaagaccagctttgctattaccacagatggcatcacaattaacttttaatatatcaaaaatgtgagtgtactcatatattatcagtcatttgatcatgatattccaacattaacatctcagtgtattgtgaaaatgattcatttgtacaatatttttcttcttctagacttttaatttcttgaaggaaggaacgcattttactcatcttgtagtgaccctccctgtacatgttgcctgagacataataactattcaaaaatgtttacagtattcaatgaaattatataaatcttggtttaaaaagcttgatatacaatgaaacatacttgggcaaattataaagctgttcctgagaatgagctaatacatatttagttgttaaaattctgaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgctcattttctatatgttacattgaaaaaagtaatatggaaatgtaatgttttcatttgcagatgcttaaatttagatacatgtttaatactgtaatcattttgatcaaacagcagctatcatttattattcaatatttatatgtaaaacctgaaactttcatctaccttaatgatggtattgtgataaaagtacccatgtatcaccaagctttgccaattctttttattccttaaagaatatccgacaatttgctggtttgtataagtttgagttaagacaccgtaataatgtcctgcagtatatatgtcaaaatacatgggtcaaaaagacactctaaaatagcagtctccaagaacccaggaagtatgtgatccataggagtgtacatattttattttctttaaaaaataagacagacacttctcaaaagaagacatttatacagccaaaaaacacatgaaaaaatgctcaccatcactggccatcagagaaatgcaaatcaaaaccacaatgagataccatctcacaccaattagaatggcagtcattaaaaagtcaggaaacaacagatgctggagaggatgtggagaaataggaacacttttacactgttggtgggactgtaaactagttcaaccattgtggaagtcagtgtggtgattcctcagggatctagaacttgaaataccatttgacccagccatcccattactgggtatgtacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacaatgagaacacatggacacaggaaggggaacatcacactctggggactgttgtggggtgggggggaggggggagagatagcattaggagatgctaaatgacgagttaatgggtgcagcacaccagcatggcacatgtatacatatgtaactaactggcacatggtgcacatgtaccctaaaacttaaagtataataataataaaataaaaataaaataaaataagaccattaaaaaaaagttcatcgtatggattgacactgggctgctccctggtggagtaccagctcaagatgttttgaggaaaaaatttgcatttaccaagtgggaggatttatagtggtgatttcacttgttcattgatttagacatatgaaatattatattttttgcacaactaagttggctttcagattatatgaccatatttttaactaaatgaagctttgctgaataaatacatgacttaatatattccttcaaaaaacatatagtgaaataatattaactacacaaagataagcaatgagcaaaaaaacactagtgcttaccactgctcttggtaagagctttccttcaggcacaaaatgagataaaagtaatgacaaggtaaaactggatgaaaattggtcaacaagtgaggaattaactgccttgcaaaagcagtttttattatacagaaaccattttgaaagcagttattcagaaagtttctatcagtatatgatttgtagctcaaattattgttggtctatcaatcacaaatactattttctgcataatatagctagaaaatataattatctaacttatttttaaagtcttctaaacatgaagtttcagtgagctttgaagctttttgttaaatatgttaaaatgtcatactttccaaatagtttccaattataaccaattagcatcagaaaatttattagccaaatttcaccaagaacctaatttgtgagagaattgaaaaatgagtaccataatttagtatgctcagccactgatgtaatgcttataatgggacctgtgtattttttgtctgtgctgtatctcttttcagctgtgaaaactattattactaagtattaaaacaaactgagggcaaggcacggtggctcatgcccgtattcccagcactgtgggaggccgaggcgggtggatcacttcagatcaggagttcaagaccagccttgccaacgcggtgaaaccctgtctctactaaaaatacaaaaattagccgggcatggtggcacatgcctgtaatcccagctactcgtgaggctgaggcaggagaatcgcttgaacctgggagacaagaggttgcagtgagccaagatcgcaccactgcactccagcctgggagacagagcaagactccatctcaaaaaaaaaaaataaaaattaaaaaaaaagcctgaacctagaaacggacctacaaatgtcaatacttagtaatatttttaattattaagccaagatttccaaaaataagaaaagcataattgattatactggtttctttttttttttttttcatttggaacatataattgagaaagctttagtatcaagcatatgtaaagactcataaaataataaggaaaggccaaactgcctgatagaccaaaaaaaaaaaaatcaacaataaacattttacagaggagaaacagagaaacatatacagctaaaaacatatggaaggatcttgagtcttatagcaatattgatgagcaaatcaatatgtagaatagcaaatcagtatcattatcaaagagataatggatatctctttatactcaatttattggcaataattaagaatttaaactacagaaatattgaaaagtatttgaatcaaccagatttcttatatagtgctaatataaattggttaaccacttgacattatcttttaaagtttaatattcacacaccctatgacccaacaattttctagatgtatatactaaaggaaattattacatttgtgcacccagataaacacataaaagtgttcataaaagtactgtttatattaagaagagccgacagcagatgcctatccagaggtaaacaaattgtaatatatctggaataacttgttgcaatgaaaataaatgaactacaggtatacgtgataatatgatgcttagtgataggttctcagatgatcacagcatgatggtctttataagcaataacatttttgagcaaacatatatttgctgaaattatctttttaaaaatgtaagaaaataatataaacacaaaattcagcatgtcagggttatgctgcagggtaacggggtggtgaggattgtatagatagttgcaaacattgctcatgttcaacttcttgggttgggtagttggcttttatcactaacaaagtaataagccagggaatacaatgggtaaatgaaaaaataaaatagagtcacgattagaccaatgatgatagtatatcataaatcaagtcttctcatctttaaaatggaattagtaggagtacttagcttcctagggttgttatgaaggttgaaattcttagaataatgcctggtacatagcatttttttttttaagttaagttctagggtacatgtgcacaatgtgcaggtttgttatgtatgtgtacatgtgccatgttggtgtgctgcatccattaactcgttatttacgttaggtatatctcctaatgctatccctcccccctccccccaccctacgacaggccccggtgtgtgatgttccccttcctgtgtccaagtgttttcattgttcagttcccacctatgagtgagaatatgcgatgtttagtttgttgtccttgtgatagtttgctgagaatgatggtttctagcttcatccatgtccctacaaaggacgtgaactcatccttttttatggctgcatagtattccatggtgtatacatgccacattttcttaatccagtctatcattgatggacatttgggttggttccaagtctttgctattatgaatagtgccgcaataaacatacatgtgcatgtgtctttatagcagcatgatttataatcctttgggtatatacccagtaatgggatgactgggtcaaatggtatttctagttctagatccttgaggaatcgccccactgtcttccacaatggttgaactagtttacaatcccaccaacagtgtaaaagtgttcctatttctccacatcctctccagcacctgttgtttccagactttttaatgatcaccagtctaactggtgtaggatggtatctcattgtggttttgatttgcatttctctgatggccagtgatgatgagcattttttcatgtgtctgctggctgcatcagtgtcttcttttgagaagtgtctgttcatatcctttgcccaattttgatggggttatttgtttttttcttgtaagtttgtttgagttctttgtagattctggatattagccctttgtcagatgagtagattgcaaaaatcttctcccattctgtaggttgcctgttcactctgatggtagtttcttttgctgtgcagaagctctttagtttaattagatcccatttgtcaactttggcttttgttgcccttgcttttcgtgttttagacaaaaagtccttacccatgcctatgtcctcaatggtattgcctaggttttcttctagggtttttatggttttatgtctaacatttaagtctttaatccatcttgaattaatttttgtataaggtgtaaggaagggatccagtttcagctttctacatatggctagccagttttcccagcaccatttattaaatagggaatccattccccattgcttgtttttgtcaggtttgtcaaagatcagatggttgtagatgtgtggtattatttctgagggctctattctgttccattgatctacatctctcttttggtaccagtaccatgctgttttggttactgtagccttgtagtatagtttgaagtcaggtagcatgatgcctccagctttgttcttttggcttaggattgacttgggaatgtgggctcttttttggttccatatgaactttaaagtagttttttttccaattctgtgaagaaagtcactggtagcttgatagggatggcattgaatctatgaattaccttgggcagtatggccattttcacgatattgattcttcctatccataagcatggaatgttcttccatttgtttgtgtcctcttttattttgttgagcagtaatttgcagttctccttgaagaggtccttcacatcccttgtaagttggattcctaggtattttattctctttgaagcaattgtgaataggagttcactcatgatttggctctctgattgtctgttgttagtgtataagaatgcttgtgatttttctacattgattttgtatcctgagactttggtgaagttgcttatcagctttaggagattttgggctgagacaatggggttttctaaatatacaattatgtcatctgcaaacagggacaatttgactacctcttttcctaattaaatacccttcattactttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttggcatgaagggctgttgaattttgtcaaaggccttttctgcatttattgagataatcatgtggtttttgtttatatgctggattacgtttattgatttgtgtatgttgaaccagccttgcatcccgtggatgaagcccacttgatcgtggtggataagctttttgatgtgctgctgcattcagtttgccattattttattgaggatttttgcattgatgttcatcagggatattagtcaaaaattctcttttttgttgtgtctctgccaggcttttgtatcaggaggatgctggcctcatcaaatgagttagagaggattccctctttttctattgattggaatagtttcagaaggaatggtaccacctcctccttgtacctctggtagaattcggctgtgaatccatctggtcctggactttttttggttggtaggctattaattattgcctcaatttcagagcctgttattggtctattcagagattcaacttcttccttgtttagtattgggagggtgtatgtgtccaggaatctatccatttcttcaagattttctagtttatttgcatagaggtgtttatagtattctctgatggtagtttgtatttctgtgggatcggtggtgatatcccctttatcattttttattgcatctatttgattcttctctcttttcttctttattagtcttgctagcagtctatcaattttgttgatcttttcaaaaaatcatctcctggattcactgatttgttgaagggttttttgtgactctatctccttcagttctgctctgatcttagttatttcttgccttctgctagcttttgagtgtgtttgctcttgcttctctagttcttttaattgtgatgttagggtgtcaattttggatctttcctgctttctcttgtgggcatttagtgctataaatttccctctacacactgctttaaatgtgtcccagagattctggtatgttgtatctttgttctcattagtttcaaagaacatctttattccagccttcatttcgttatatacccagtagtcattcaggaacaggttgttcagtttccatgtagttgagccgttttcagtgagtttcttaatcctgagttctagtttgattgcactgtggtctgagagacagtttgttataatttctgatcttttacatttgctgaggagtgctttacttccaactatgtggtcaattttggaataagtgtgatgtggtgctgagcagaatgtatattctgttgatttggggtggagagttctgcaaatgtctattaggtccacttggtgcagagctgagttcaattcctggatatccttgttacctttctgtctcgttgatctgtctaatgttgacagtggggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttaatgtctgttttatcagagactaggtttgcaacccctgcctttttttgttttctatttccttggtagatcttcctccatccctttattttgagcctgtgtgtgtctctgcacatgagatgggtctcttgaatacagcacactgatgggtcttgagtctttatccaatttgccagtctgtgtcttttaattagagcatttagcccatttacgtttaaggttaatattatgtgtgaatatgatcctgtcattatgatgttagctggttattttgctcgttagttgtttcagtttcttcctagcatcgatggtctttacaatttggcatgtttttgcagtggctggtactggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcaactttggtgaatctgacaattatgtgtcttgaagttgctcttctcgaggagtatctttgtggcattctctgtgtttcctgaatttgaatgttggcctgccttgctaggttggggaagttctcctggataatatcctgcagaatgttttccaacttggttccattctccccgccactttcatgtacccaatcaggcatagatttggtcttttcacatagtcccatatttcttggaggctttgttcgtttccttttactcttttttctctaaacttctcttctcacttcatttcattcatttgatcttcaatcactgataccctttcttccagttgatcgaatcagctcctgaggcttgtgcatttgtcaggtacttctcgtgccatagttttcagctccatcaggtcatttaaggacttctctacactggttattctaggtagccatttgtcctatcttttttcaaggtttttagcttctttgtgatgggttcgaacttcctcctttagctcagagaagtttgatcgtctgaagccttcttctctcaactcctcaaagtcattctccatccagctttgttccattgctggcaaggaacttcattcctttggaggaggagaggcgctctgatttttagagttttcagcttctctgctctgttttttccccatctttgtggttttatctacctttggtctttgatgatgatgtacggatggggttttggtgtgggtgtcctttctatttgttagttttccttcttacagtcaggaccctcagctgcaggtctgttggagtttgctggaggtccactccagaccctgtttgcctgggtatcagcagcggaggctgcagaacagcagatattgctgaacagcaaatgttgccgcctgatcgttcctctggaagcttcgtctcagaggggtactcggccgtgtgggatgtcagtctgcccctactgggtggtgcctcacagttaggctattcagggctcagggatccacttgaggaggcagtctgttcattctcagatctcaaactccatgctgggagaaccactactctcttcaaagctgtcagacagggacatttaagtctgcagaggtttctgctgtcttttgttcggctatgtcctactcccagaggtggagtctacagaggcaggcaggcatccttgagctgcagtgggcttcacccagttcaagcttcccagccacagtttgtttgcctactcaagcctcggcaatggcgggcgcccctctcccaaccttgctgccaccttgcagttcagtctcagactgctgggctagcaatgaacaaggctccgtaggcatgggaccctccgagccaggtgtgggatataatctcctggtgtgccgtttgctaagaccattggaaaagcgtggtattagggtgggagtgacccgattttccaggtgccgtctgtcacagcttcccttggctaggaaagggaatttcctgaccccttgtgcttcccgggtgaggtgatgcctcgccctgctttggctgacacttgatgggctgcaaccactgtcctgcacccactgtcagacaagccccagtgaggtgaccctggtacctcaattggaaatgtggaaatcacccatattctgtgtcgctcatgctgggagctgtagactggagctgttcctattcgaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattataatattgtaaaaccaaactctaaagactcctgttctaggtaattgattagtccagtaaatgtaggcataagaaaaatgtatgaaatagatgacgttaatctttcatgcacaataacacctttctccagctgtggctctaactgtcctgatggattctttactgctctcagctaatccattatatggttttagacatccaggatagacactgaaaggaataactattacaaaagtaattttaagaggagcatttgattgactgatgctcctcttatgtattcattgtgtgtatgtattgaatttgtgtattcattgtatgtattcaatattcaatgtatgtattcattgatcctgcatatacttgatgatttgattggtggtttgattccagttatattaacttgccagaaactttctagtttccaaacagtgaatacaacttagacctcatgaagcttacattctagttagaagagagaatattaattagataagcacataaaatatacatgtgttagatagtgataaatgacaagaaaaaaagtagagcatggagggcctaggaaggatgatagtggttgaatagactttaattttatatagaatattaggtcagagatctgaaggtgactaggaaaaagttatgtgggtatctggagcaagagcatcttaggacaaagagaaagtaagtgaaaaggccctaagatatgaatgtggctggcatgttcaaagaccctcaaggatggggtaagagtggggaagagttgaaggatatggggaaggggaaaatatcgtaggcctttggcacactgtagttaatgtcttcacatttttcttgcaatgcaatgagaaacacagacatgtaatgatctgagttatgttttaatagggttagtatgattgttactttgagagttggttgaatgaggacaaacagatagaccagttaagagacttggcattcatccagtcattagctgtgaagtctggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacaggagatcatgaactcagcttagctaattatataaagttagagatgcctattatatatcgaggtgtaaatgttaaagtgatagctagtatacaagtctgaagttcattgggtcaggaacatctgaactgaagatgtaaaatgtttgaatcatcaatccatatgtcatttaaaccagaagactagatgtgataaccaagaaaatgaataacgagacaaagtatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataaggtaagaaatgagaattgaccattggatatagcaatgcattcgaccaatgaccttgagaagagtatttcagtggaatgaagggcaacatggaaactagagtggatttaagagagaataagaagaaagaatatggagatagcaagtgtagacttgtctttttctagaaagaaaataagggcatagatacttttatgggatgtggaatggtgctgggacatgtggaagtctcttctattggtctgtatattcttagaaaatagaaaataattgagtatgagaacatgggaggaaaatgctgaagattcaaggagaaaagagaaagtatgaaaaagtatccaggaacatagcaaagaacatggaccagacagcattagggatctatgtgagtttagtaatcatgaatttgaagcaaggtcagtcaacaggtactatgagtttcttcagatgtatccagctcagcagttgcaggtacagagaagatagaggttagatttaactgacgttgtggttaagccaagtgaatacagtaaaactagagattaaaataattgaccatggaatctaagacagtgatgagaaaccctcaagctacagcgatttcccattgtctccctaaatgctattggtactgtagccaagacaagtctttcttttataggactatacaaggccttagaggatatttagtatccttggcctaaaggataaaggtaaagtggtacagtacacatttagtgtgctgtacactaaatatcagtagcactttgccacaaattaaaggaacagtatataatccttgacagtgctttaactccattgcatttccttcttttttagaatggaatttttttctatatgttccccaaagcaaggctagtttatataacattaaattacttatgcaaatgcaaaaattaatctgaacatctatttattatatctagcacaaaacatagaaacaaagaaggcataggttattattttgaaattatgctttactgaacacataggaattgctaccaatcgtttaaatagttgccttatttcttagacaaatagtaactgaaatgtatggagcattcatgcatatatttggaatgtattaagtgttcatgtgtatacctggcgcagagttaattgttttgcctgcattatctgatttgattttcccacagtgccatgaagtatgaattatcattatcactattatatagtaaacagtataaaaatgtgtctatgacttggagaatggaaaaatgttttacaatattacattctggttgttcacttcccttccattcatgttgacattgaattgttctaggctgctaaggcagcactgtcagaagccacgttttttctaggcatacacacactttattcctttgtcctttagttccttaaactacccatgcactttcctcctctttctttttacattgatgattaaaatagtgagcctgaatttttttaaataaaaaccaactaagttttttattatttattatttggaggaacatatgccctccaaaatatcatttagtgcatcttagacataaaacaatttaactgcttgaagaaaatgtccagcttctgaaatggcatgccattagatattagtgacatttgtttataaacaaataaatgtcttcaacctctatgtagttactatcaatatagccatgcaatatatatggagttccaaatacctttcaaaaagtaatgttgatacagtagtgatcacttatgtccttttgattgaaactgcattatacgaagttctttcctttcagcacaataacctgaaaaatatagctgtctatttaaagaagacattttcttgtttggcagaatattatcatcatacagcatatgtacaatatggtcctaatttgtgtcgatatgtgctaggcttagaaaactcactttaagttttactaaatttattttggagtttaactcttacttttgacatgatttatattctaaggagatctcagcttcttcctgcttaaatgacattacatagatagaaaggtatatattcttattatagcagtgtctgccagggctgcagtcctgttgttagaaggctgtcagaattttaaatgtaagccttcctttcccagatgttataatttaatcttctaactcctattaatttctgaagactgtggggccatcctatatcttagaacaaaatatagatacgtacattcctgatttttttctccatatttaccttcccccaaatgttttaattttattatttcaaaattataataatagcaatggatttcaaattaaaattctggctagtgaatccctcaggtatttctttatattgactgatttgtatgttgtaggctaaataatgccctcctccaagatacccatagctgaatttccagaacctgtaaatatgttccctcttacatggcaaaagggactttgcaaatgtgactaagtttaagaaccttaaggtgggaagatgatcctgcgttatccaggtggaccgaatccagtcacatgagaccttaaaagtagaagagggggtcagagtgatgaaacaatggaagaagaggaaggagaagtttgaagcatgaaaaatatttcattcatcattgctggctttaaagatggagagtcccttgaaccaaggaatgtgaatgacctctagaacctggaaaagagcattggctgacaaacagcaaggaaatgggaacctcagttccacaaccacaagaaatgaattctgccaacaacctgaatgaacaaggagatagattctcctctagagccaccagaaaggaatgtatccatgccgacaccatcattttagtcattttagctaaaggagacccatattggaatattcgcctacagaactgtattccaacaaggatgcatatgttggaatattcacctacagaaccatgagataatatatttgtgttgctttcaattgctaagtttgttacggtagcaataggaaactaatgcaatgtacagttgacccttgcacaatgcagggattagggatgctgacctctacacagttgaaaatttgtttataatttttagctccctaaaaacataactactaagagtctactgttgaacagaagccttactgataacataagcaatttattaacatattttgtatttcatatgtatatatgctgtattcttataataaagtgtgttagagagaaaagaaaatactaagaaaatcataaggaagataaaatatatttttgttaatcaagtgaaagttgatcatcttaaaggtcttcatctgcatcatcttcatgttgaaaaggctaaggaggaggaagaagaggaggggttggtcttgctgtctcaggggaggcagagacagaagaaaatccgcgtataaatggaccggacttgcacagttcaaacctgtgttgttcaggtgtcaactgtatatgaaggctttcttctttaaacagaaaggaagtattttgtgcccaagatttggagaaagcaatgggataaaaatatcatagagattttatggtatttgtcctttttttccttttccccttcactaagggtcttgaaaaactggtctgaaactccgctccagtagagcaaaaagaagaactgaaagttaagaagatatttttgtgaaaaatgttgtgagacaaattttgacacagggttgaggaactctttttttccgcatctgaccaagggcaggcttgatatcctgaaggttaagagcggctttgcctgaagcaaagttctcactatgggaagttgcagccgagtagtgaagagttatcttgatgggaggccggaacaaatttgctttggagacgtaaagggaactaagaactattcttactggactccaatatgagactttatttctatccattggtttgcaaggcctggagatatatgcattagataaaaagactgtatttgtaattagaaaagcctccagtaattaatgtccaaatatgcaaccaatttaaatgatgtctacataataccacacatagatgaaaatccaaaaagtcaaacattcattataataattcttccaatctagttgttgttatatagaagcccctcagagggcaccccattttgctgaatttcttgagttttttacttatatcacagaatcaggatgttcaaagtataacaaagatgagaagtaagttgaaaaaagaattattagtgatatttcttctaccatatacatgttatcttggaattggaattttttcgtaataagaaatccattagcataaatacagtttaaattgaataagtaaatttcattaaaaacaaaatatttatttgggggtacattttataaatagctgcaaaatcaaaactgcatttttgaaatgtaagccatattgatgctagtaagtcaatatgctcattatcaattgtgtatgtacttttatgttatttagaaaatttaattacacgtacggtgtttcaagtattcaatagataaaccacctaggaatataacagggggcataaaacatattatcgactctgtgtctttatgaaactagataaagcaaagaaaaatctgtcaattactcagccagtttcatcttagtagcctactgtaaattgaggtctatgtttttgagtgaatgaaatctagtaaattaagttcaccaggtcttattctagtttattttagatggaaatgtatgatttttaaaagtgggagtaaaatcttacacatatttctgaaatgttaagaagataattttataattcaaacctgtacaagaacttagtttgcctatctgagcaaattttacattcactagtgaatgcccatgtgaaagacaagcaggaaacttccaggggccaaggggcttagaaccaactgaactggtacaaaataaacattaggtatttcagtacgtagagtttgtggacaaaaagaataggctcttaccaattactatgctactagaatatccaattttgcttttaccaagccttagtgaaaagtgaatgaattctaacaagaagactcaaagacactggtgctccccctgtgtctcccttcacttattctgcatggtcagcacctcttcaaaagaccaataataatggtcccctacaagaagtatacaattgctcctctgatgtgaaagcatatgaagaaaataagtgtccaaagctgcataaatatttgcacccctttgagagtatgagaaagtgtgtgttttatgttgtgattgataggacaactttcatggcccactttgaactcttagcaggaactttggaatgtcctgagggtctgtctgcctttgtatggcaggaactctgttttcttagaaaatagtaaagaacagtttgtactcctttgttctaaagggtacctatagtttatgggaattggggaacttagtagaaaaatcaccaacgctctcatgtttctcataaaaaatgctcagctttatttggaaactttggccattgttttctttttcttctttcttcttctccttcctcttttgagttaaaaaggccacagtctgacctacttatatgtgtgatgaaatgtgcagactctgccaaggctatttattctaatgatttatctactcaagataaaaagaaataaagtgaagacaaatctgaaatactgtgcaatgtacttacttgaaagcagtaagttctcatgttagaaaatttccctattaagcaagaaatcttgaacacttcattaaagtcatatgatctgatttttattatcatttaagtcagggaattttagaactaaatgtgtcaattataaaactgtacatatgtatagcctccaaaatgtgttaaacattagttcatatgaatctcaaaatactgtaacacagtaaaatgagcaagaaaatttttgaaatttgcacagtagagacgatgctgttaatgttcaccgaggtaaataatttgtccaaagttctatttctgtgagatactcaactgagacataatctcagcttttttcactttcatattctatattttggttttcattttgttcttaagaaacaagtatttttaaaatgaaacatctggtttcggcagtgctggctaatgctcagaactcccttcccttgttttcttcaatgtcacccttctataaaaacctctgaatatctgaatacgttttaagagcaccccttataaaacactttttgctttgttatgtttcattttgcaggtgccaaagtcacaaatatttcacctcattcagatattccaggtagtaaggctgatatttttatgagtcatttcatctgacaaaattaatttaagaataaataacattgaaatagtaagtagcatgtattttggacttaactcttattttccctatttctattcttccatgttttaatagattaatatatactcatgtgtatatatgtacatgcacactcacacacatataagtatatatatatttatttttcctcatcttatacaagtggaaacatactatacacattataagagcacagtataatttttatgtaatataatttgaagttaattccatattggatagtttcttcattatatgtgtaagtatatgtaatatatcatatgtatctatgattgtgtatttcattgaatgaatgcactcaaacgtgttcagcaatcagcacagaggttaaacattgactctagtactagactgtgaaggttcaaatcctgctttcaccacctgccatctttgtaaccttgaacaagttatgtaagtactcaatgcttcaattccctcatctttaaaatcaatgtaacagttataagattcttaccacataaggttgtgtgtggtgttttgagaatgtaatgaatgaacatatccaaagccacattgtagagtgcttagcacttgcaaagcataatgtcagtgtgagttgtcatttccatcatcatttttaacatgtttaattgcaacccctattgatggacgtacggacattttcaatattttttactacaaacgttgttatacattgtttttctgttgttgttgttgttgttgttgttggagatggagtcttgctctatcacccaggctggagtgcagtggtgtgatctcggctcactgcaacctccacctcccgggttcaagtgattctctgcctcagcctcccgagtagctgggattacaggtgcttgccaccatgcccagctaatttttgtatttttagtagagacagggtttcaccatcttggccaggctggtcttgaactcctgaactcatgagtcacccttctcagcctcccaaagtgctgggattgcaagcgtgtttcagtgaatagccatgtgcccagctgtttctcacatgcacccttataactgtgggataaatctctgaaggtgaaactgctatgtcaaagtatatatgcatttataattttaacagatattgccaaattgaacccatatattttagacatgctaccaccaatgcatgagagtacttgtttccctaaacccctctctaatagagtatattatcaaacttttgggtctttggcaatccaatgggtgaaaaatgacattttgggctgggtgtggtggctcacgcctgtaatctcaccactttgggaggctgaggcaggcgaatccctgaggccatgagttcgagacctgcctggccaacatggtgaaaccctgtgtttactaaaaatacaaaaaaaaaaaaaaaagccaggcatggtggtgcacacctataattccagctacttgggaggctgaggcatgagaatcacttaattgcttgaacctgggagacagaggttgcagtgagccaagatagtgccattgcactccagactgggcaacagagcaagactccatctcaaaaaaaaaaaaaggaagagagacaattatatttttttccacacaagcatttaaaatctaattcaaaaatctattctgaacttactgaatcccaagaataattaggagaggaaaagaaataatgtttaaataaattctatctgcctgttactatagaacatgaagaatgggttctgtgttcctcttatgaatttctttttaaaacccttcaaagtaggtattttcatgcccttttagacataacataacgtataattcagagttgaattaattttcccaaaatcacacagcaaatatatagactacaattagaaagtgggtaagtctcattcttaaacatatacttttgcattatagtcacatgaaaccactgagcgtgttcatgtgtgtgtgtgtgtgtgtgagagagagagagagagagagagaaagcccaagagtgagagtttgtcttgaggagaagtgtttaaaaggaatatataaatcaaggatgcactatagtatcaccaaagtaacagtgtgaacttgaacaatttaacctcttagagccacgattgctccatctatacaatagaataataataataaacctacattatacaatttccggagattaaatgaggataaagagtacttttgaaattctaaagttccatgaaaatgttagctttgattacatatggttcagcaattgggtctccttattttttgagatctaccttttttttttgtattatctgtagcttgctaaaataacataccagatgtttttgttttcaaattttaaaaatccagatcatactgatttgttgccatggtatagtagtcagagaatcttgctctgggcagttacaatattttggagattgttttacataatagcaactataacaggaacaatgataactgctaacttgtttacatttacaaaatgtcaaatactattctagattattcaattgaatcatcacaacaacgctatgaggtagttactgttatattgttttgatttccctgatggagacttgacacaaagagagactaagtaattcactcctgtcacacacagcttaaaagtggcagagctgagtgttttgccccaggtagtccagttctagaactgtactcttttccactatgctataccatcttcctaatactatctgtacaagaaattttctcctaatgaaatgtattgctgtaccctatataagctttagctctaaaattgcagagcaggaagcaggtggataaagctaattgctattctattaccctacaatagaaatttcagtggactaactctaatatttaaataacccactgttaataaactggcatggtgcaattgcatgtttcccagtgagatcagatctagtccaatgtctcagcagatataggaattccttttctatcaccccagacaggtggatctctactcatgtatcttcagagaaatggataccctacaaagcagcacattccattttcaacagctctagatattattttatttatttattttagatgaagttctgctgtgttgtccaagctggtctcaaacccctgggctcaagcaatcctcctgcctcagcctcccaagtagctggaattatagttgtgtgccactgcatctagctccagattttagaagttaattcttacacagggttttctggagggacagaactaataggattgatgtatatatgaaggggagtttgttaggagaattggctcacatgatcacaagatgaagtcccacaataggccatctgcaagctgagtagcaagaaagccagttcgattcccagaacctcaaaattagggaagccagcggtgcagccttcagtctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacagtactttgcatacttcaatcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcaactactctcttaaatggtggtgtcatgaattgatcacagtgctctggatgtgctctgactagctatgactgctcctggatcgccgtttcctttaatctatacactatgtgtcttcctaatacagagagtatgttgtttgcctatatatcataacaaattgaaaatgcatttataacttacaaagtatatattactaggtgctagaatttacactattatcctaatatacagaagctgggaaaagtaatgccatagagttgatttatgtgtgtaaatgtctaagtgacttaaatattgatttttctccttcaactgcagatcaaacttcccaaacactaaagcttccttattttaaaacaaatgcatttgtggttcaccagtctgcagtacagtaagctttttataggtaagctcaaatcacagaaaagctcaaatagatacatctcctttagcctatttttaggactgataaagctaagaacagagaaaccaataaagacatattttaatgatggcagggtatctcatggggtagtacaaatttatcccagttttttatgccttctctatgtgtaatacattgaagtgatatatggtgttgaatgtgattaaaattcagcagatacttatgcaagatctactatctataagatgcttatgcaaaattccatagggaaacattaagacgtgaataaaatctgaattgggccatcactatgatctctccccaaaacgtgggattttcaagtgcatttagaattatgaaataaaccactaggtttttagtgtgaaatgtttacagtattttaattttgaaaactatacttattaaaacagtatgacaacatttattgaatacatgttatgtgctaggtaccaagtgaggagttttatgtttattttctcatttcatcctaagagcaaacttcggaggtaggtgtgattcgtctcattttagtgaaaattcactgatgctctgaaagcaaaattaactttcccaagggccttgtagtgcttaaaggcagaatcaaaatccacaaccagctctggaaaatctccagaaatgagcttaattttttgtgtgatttatatatgactccaatattaacagacatgtcaaacaactaacacaaccctttacctgtttattttggaagaagacacttaaaatgtattttattaccctgttgattctcctctggagtgtgacttagtatccattgcacctttgggattcttatcttctaaaattcacaaccactttctactgctgtaagaaagaatcacctgcagagttcacgaatgagggaagagtgaaaagggaatagtggcagatcaataccacttggcatcacatcaaaatagtattccaaggttggtgttctggcttctgcttttctgggaaatacgttgtctgctatttcaaaatgccctccatctgaataatgtaacctgaaattcattcaactcatatttagcactttaggccatatccagggttgtggaaggtgtacgtaagcaatgaggattgcctacaaggcaagatgagaactctgttttctatactttctattgttcctccctttgcaacagaagtagaaagggccataccatagccatctactgtccaacatgatgaatatccttaaagacaaaatctttaagcagtaagtgaaaggttaactacaattctcatttaaaaagaaaattgcattgctgatatctctttgttacataaattttccacaaggattatacattttctttttattcatttgttatctatttgacaatagcaagcctgtttctctttagcttaaaggaacttggattaaaattttttctgttattttaatcagcattgatgttgtatattatgagcgtgtggctttttgttttcttggcagagaccttgaaaaaattttgaaccctagtcaataagaaatctctgtattaatataaaactataacttatggtttatttgattagatcaatgtttaattatggataacatgtattttttgcactgaatatttacacacaaattaatctagcccatagtaaaagtgctaatggaatgtttcatccaaacataagttagtaaatggaaaacaaacagctgttgcaaagaccctgtttttgggtctgggcctaacagcacgaagcacttcagagaatttcaccactaccatttactcacatctgttgagattgtactatttcaactcaagatttgatcagtgtatgtcataaagtaacaagtagtacgctaagtcagaaaacttaaaggaaacattaaatactcatttcctatatggaatgttgcctttctaagcacatcatcttcttctatgtgatgttttgcaaatctattcataggagatttatattttcaagtgtgctcaaatggatctgtgttggggaaagatatgtgaaataagaaaataaaagctaatccatttgttttaaaattttgtctgcctaccacattttgttggacttcttgttatatgagaactcctaattgtctggttttcaattgcagccaaaagcattcttacctgatcaaactcttcaaattctatttactttgaattatagctgagtacatggaaagtataattgggccttactttgttacacagcagacaaaacatatgctcaagataggtcagtgctattccagtgaataaacattttaacaaaaatttgtatgagaaattcatgttggcctctcattcctctctatatgcctttcacagttactctttttccccttgccaatcaaaacactataatgaatatctcttggccttaacgataagaaacactgtatataaatattgtctaggctgtattttatgagaatgtggagttatatgaaatgtaggaagaaaaaatatgagtgagtaatcctgtgagcagtggacgggctgagcttctaggacactgataagcaatcagtgttagttacacttgaggcagtatctctggtggtctgttccagaactatgtccttgactctgtcacattcatacttttcatcactactttttatacttctgcaatttaggtcacccaatacacgttatcttatcaggttaaactgattgtagtggtcacattgaaaaagaaaaaaaaaatcccaaattcaggacttttcccaaccagttctaattaatgcacgtgtgaaaggacataattattgtgaaaagaaatgctatcaaaacagtctaatggctacaagaagaaaaagaaaagaagaagaaggaggaggaagaggagaaggagatgaagaagaaagctaaggagaagatgggtaacaggaaaaaaagagggcaggaaaagcagataggaaggaaaaaaaaggtggaagagagaaatgaatgcaggcaggcaggatgttttcctcgaggttttttatttatatcccctggactgcataactcagtttattcccttctaaaccaacttttctagaatgtgttgtctctgttcgacacctacaactctggttcattttctatgcattaaggatgatgtaactttaaaacctctcatgtaaattctgcctgttttctaattctacaatcctcttgtttatgttctattctaataattatcgagcttttaaagaagagaaatctgttcttaactcaaatttatacatacactgaaggaaataacaaaaccttgaagtaaaacactgtttctatgataaaagagagctctacaaatagatgcatgaataaacacttctatgggagggataccttttcagagtttaaggctcgcgggctttgggatctaagaagatgaatcgcttgccctgtttgtgatcctaaatggaaattgacagatatgtttaatttatcctgctcagtattataaagcctttttctcatttgatttttgtgtatccctcctgaaatatttgctctggtaagcaaaagcaaatattaggttttacactccatttagtgaaataacagtgatgataatctgacatcagagaaccaaatgttccaggcttatttcatgaaaaggatttcctctccagaaacattatcctcaataggttatcccatccttcattcctcaattcatatttcttgagattgagagggaaaaaaaaagaggccagaccacaagtagcctactgctaaattcttttatgaagcttagttttatgaattaccttttagccttctccagtcatgtgggaaaactttcctgcctcattaaatctttaatgcaatgtgcaccatgcacactatattgttatttgtgacattaggttatatattgcatagtaactataatattacttgcaaacaagctggtttttccccctgaaggtagaattaaaacaggtactcatgggaaacagctacttgtgttcttcttttcttaatggggtgaagctgaagaacaggaaattgaatggcttagcccagaaccatctccaggaatggaggtaaattttttcctgcagtgccttctcaatttgatatctgaatctccctgaagagaatttgccttagtagatatggagaaagagggaaaaggccaagcctttggagacccttatgaaatggaatgaaccgctctcactaaattcactttctctttgtattgaaaagagatataattttcatccctagtaaatatagtcgaatccatccagtaatataagaattgcctcaaagtgaactaaaattgcacttactcctacctgtggaaaaccatatttctctagccaagagaacaatgacagattagttcctaaatagcaggagaaaatgaaatgttctattggctgaacacacagtgctctgtaaaatcagagaaatcaatattgtccccaaaatgaactaatttgaaagtctcaaagatgttcaattttatgaaagactcgtaaaattaataaatgagtctgcaaagtccaaaaatgtggaaaattacagttatttgcagtacgtataacttaccaagaccacttatattttgttagaatttttcaatgaatgttaatggatgaatttttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcaggaaaattcatttttaaaaatccaagtaacagaatggataaatataaaaagaggctagatcagacatacccagacattctcagttcagaatgttcatagcgtattcataattttttcatagtgcctccttgaccaacagaaataagccacagttctatttcttaagtagttagtgccaaacaacttaataaatattcatgttttaacaacctagcaattgtttaaaaagaaaatggacagaaaataataatttttttcataaataaccagaatcacttactgatgggatgtggtacctttggggtagtatataccttctcaaacttgagtatcagattggataatgctatccttatttccttttccacattgacttttgtgcagttcttgcttttaattacagtctcttctgaaaacctttcttaataaagatataaagtggcctaaagtacaagtaagcagaaacatggctcaaaatgttgagaacattcttaagtggaatatagcatgttctaaggtttcaacttgtgaaccaccttgaattagttattgcagtgcccaacagatatttagtattgctgtgtgtccttcaaatgtttacaatattccactgtgcctttgtgagttcactgcagcacgctggggcacctctacacacagtttgtgaacacaggggtagatagatcctagaggcattgaaactacacggaaacttgaatgacgttagggatcccagagccactggggaatcttcattagggaagtgcaacaacatatgaaatagctcattaaactttccctatcaaaaaaactgaagtcagagagatgaattcagatgcttgatgagaacctacttggtaatggatttgaaggagagagtaaacgttaggatactgaagggattctaagagagtgcagaagcgagggcaaggaggcacaaaacgaaggcggcacctggaacatggaggagtggacagatggagaagaggcagagaattctttatctaaagcaagaggaaagggcaacgtatactcagaatattctcaaagctttttccctgaataatagcatccttcagaaaagaagtcttgtaactgactcattgcaaagtctcttacacaatggtatgtactctttggggaagacacaactggaaacaacaccaggaaaagcttgattttacagcttatggaaagattgtggagttgaaggaaaaatagaaggaaagaaattttaaaaagaataagttaatattcctaggggtgcatcctctaaattgcagagtgatatcttaagcaatccttttaagaattacttaagagcctgagcgtggtggctcacacctgtaatcccagcactttgggagacggaggtgagtagattgcttgaggttaggagttcaagaccagcctggccaacatggcgaaatcccatctctacaaaaaatacaaaaaattatgcagtcatgatggcacacacctgtagtcccagatactcgggaggctgaggcacaagaactgcttaagcctgggaggaggaggttgcagtgagctaagatggtgccactccacatcagcctgaatgacagagcaagactctaggtcaaaaaataaagaaagacagaattacttaagtaagtacttgactaactggttatataaatgtgatcataaacgcatacctttagggtaaatgaaaaagacattgattctaatattgtgtaaatgggtaactgtggcttgggaaaaaaacatctagtaacagtatcctgaaaattgtttaaatggtccgtgtttcacacaacttaaatggaagtaaaacagcttcgctcatgacaattttcaggcaattcaaaatacgttgtaataatggcaaacatgagtatcagagatacacaaaagagtttagaaaaaaatcattttatgaaatatgagctaaaacaatgttttactattatcgctattattattagccctcagcagaatagggtaaattatttctattccttagttcatgttttatattatcgctgacctgcatgaggagcccctatttttctgcgtatttatttgttcctcttttcccccttcccacctctaattcctctctcatagtattttagtttatgtcagggatccccaactcccgggctatacaggtctgtggcctgttaagaattgggcggcacaacaggaggtaagcatcaggcaagtgagcatcactgcctgagctctaccgcctgtcagatcagcggtggtattagattctcacaggagcaggaaccttattgtgaactgcgcatgcgagggatctaggctgcacgctccttatgagaatctaatgcccgatgatctgatgtggaacagttttatcccaaaacccctcctctgtgtccatggaaaaattgtcttccacgaaacccatgcctgatgccaaaaaggtggggagtgctgcaagtttccattatatgtgactttattataaataggtatgaaaaacacattagcaaatcaagtatcataggtgatctttttctacttcatctatagtcgtaacagctttgacattcaaattatacacactttgactctttttattgacaaaatggaaaattatccttaattcaaaatgtattttatttgagcatatgtggtgatttcatatattaagttgatatttttctttcctttttagagaagccatattcaagaaaaatagcatgtaattcaaattttaaataatcaaaatagatttgaaagctcaaaattttggaacattataggcctatgtcccaatattcttcccaaacctcctttcaaacgtatttattaatttagaaaattctaaatagttcagtccttgtttgaaatatatacaacataaaacttttttttctcctgcctttctagaatccttttattgagaaaatgtgtagctgatctgaagaagcatgctgtgtgaaattttgaatgtttatcttaatagaacctaaaatcttccacataggttcacccctcattactcacaataatgccaagtgctgtagtccaggcagatatttattattttatatgtgaaaagacattcgaataaggccatttctcagtggattaggggaatcagagttttctgaatttaagttccttatagagccccatgtaatgagctcttagaagacattgcagagctgcaatttaaaatcctgtttaatcagccgtagcgagctatgtgccattctctgtggaacactaagaggaatcagggttcttcctcctccatccagtacattcccaaccaggaattgctgtctggtcagggttggacgtgaaaggccatagagagccaaccctgcgaagccaagtctctgcatgtcagcacagagcaagcagcagaatacagatcatcagctttgttttatgaatatctctatttacagtgctggagtggaattttaaaaaaaggattgcagcatttgcattgaatctgtcactcacagcttcaattttgattcctgtcctataaatgatcttgctttcctatttttttctgaatttctacaaggtgactgtcaatgtcagaaaatgtaaacctcaagtgtacattgcatggggcttggcatgtatattagaaagaaagaagtttgcttaatgaaaagaggataatatttattcaaactaagcctatttaattgcacagaggaaagtataccttctttgcctgttttgtttgaattttaatataaaataaaatttgctgctaaccttttgtttttctttgaccaataacatttctcagcttagtgtatgggctatgtaaagtgcctgtcaaatggagggatgtctttgttgaaagaatccagactcacagaaagtgagtgactttctggtcagatggttagaactctcccaattttgacaaagatcgttctctgtttgggatttgtaaagctcaaactgtagactaagatgatgacaggaggatctgctgtttggcttcatggaacttaacctatttcagcaagcctgcaatactggggaaaataatacatatatttatgtttatgtcaggcttgcagttgatgggtaaggttcataaaaggttactcctaaataaatgcctatcattcccactccgtactccagtgatttctgcgtcttgcaaatactgccctatagaacaataaaattcgtatacaacagtaagtaaaatatgatttaatagcccatctcctatcccgtaatgattatgcatcttctgtcttgtagctcccagcagtaggaggacagttgacatttaccatatcatatgaccttgaagaagaggaagaagatacagaacgtgttctccagcttatgattatcttagaggtagagtactgagagcatgttcacccgtgttacttcctgatgttacttaaggttaccagtactgtattttttacctgcctggtttgacactgacttacaggactactaaaaaaaaatataccttaggagatttttgtgccactcttttgtttcactctgagacatatctagaagattgagtatatttgttgggtttgaatgataaaggagaactttagaccagacttgaaattaaatttcaaacataaggaccatatttccaaaatttaaatattatgaaagtgtttaggtacatgctaatttacatggttgtgtttttcctgttttctcttgcttccagatagattttattgtctactcccttgtttatattagataaaataaaatgaaacaggaaacttgtttatttagctatagttaaatcttgacttcagaatcctgttttaggtaagaaaggtacaggagaaactgctttcaagatttgaagggccataggcaacttcaaaatgctcaaagcctgaagtttccttagaggctctctgccaccctttcttatcatatccattctttccaataatgtatctcctccccttgacactgatacgtattcagaggcacacacatacatgcatgttcattattccaaatgggtagatgttaatttagcaccaggctctgttgtttcctgtcttgaaactttcatgcatgtgaatctatgacaaaatgaaaaattcttttctcaaaatggacattttccagtattggatgaagtggtctgctctctctctttctgtctctctctttctctctctctctgtctctctctttctctctctctctctctctctctctctctctctctctatatatatatatatatatatatatatatggcaactagatgtatactttggaattcctttaaggtgaaaagagttctctaaatgtaaagtgttgagtgaaattatttagcattcatgtgaatgaactaagacaagaaggattacctaagtgtcataggtcattcaatatactccttagatgccattgtcctattttgagaattagactgcagtcttttttgttgtttgttttttcccatgtagtaagttcctttaaaataatagcttaattcagttttaagtttctttccctattgttctacacaacccacatccatctacagtttgaaatatgtaactttcgtgcacttttttcaattcaaggtgtttgtaatcacatatatgtttatgagttgtcaggtagctattattttagttaacagggaactaaggtcatgccaaaccaagaagcatatgcttcataatgcatttggctaaggctaatattgaaattgcattgccttcccttcatgtataccacaaatatattccctgaatgacagggaaagccaacctgaaaataaaagtctactaaggccgggtgtggtggctcatgtctgtaatcctagcactttgggaggctgaggcaggtggatcacctgatgtcaggagtttgagaccagactggccaacatggcaaaacccccgcctcttctacaaatgcaaaaaattagccaggcttggtggcaggcgcctgtaatctcagctattatggaggctgaggcatgagaatcgcttgaacctgggaggcacaggtggcagcgagccgagatcgcgccgttgcactccagcctgggggatagagcgagactctgtctccaaaaaaaaataaataaataaaaaataaacataaatttttaaagttaaaagtctattgagggtggaggatacaaatatagatatgtttgacacttttgtaccctcttttcagttttactcttttttatttcttttttttccccctttagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggtaaaatcaagaactgcagctccaacgttcacacatttactttggggccaaggtgcaggagccgccccaggagtgaattttttaaggcacctaggatttgctgtcttcaaagagcagataagaacggagccctagttttctgaaagatttttctcttaaacctttacagttttaaatatgcagaataaatttgtctcggtttttattattattgatgattctttcacaattgtcagaacatgtgatcaataacgattcctatattgagaaatgttatattggaaaataaagtctcctttatgatggctcatagcgtgggaagctaaaaagatataaattccagggcacccctatttggaaagtggtttttaaaatatttccttccagtagttgttaactagtttctggcttaatagtatatagattgtaataagaaaagtaagtcttttcatttaagtgaccacccatctcactataaaacactttaagactataacagccatatggtataaaggaaagaatatgaactttggagccaaactgaatagaaattcaataagctttattgcttattttatgtgtgacctttggcaagtgattaagccttgaggaacgtttcttttcagtgtaaagtggatatagtaatgcctacttttcagggtctttgttaacatgatatgtgatcattaggaaagtactcatcacctagaacactttcagtttttttcttgttctccccgccccctttttttaaaagagtgaactacctgacttgaaccaaatatgctcgggtctgattaactgctgtaaggcggctttgttttttttatttttaaaacaatgacatttttatctgacagaattttaacttcaactgtgtctgaatgagctctttacgcttctcgttttctactctaataataaataacacaaggtgtcataggaacttccttctaaatcaggttaagttagacattcaaatgtgaccccagcctgacaacccggtatacctttaatgaaagcaatgtctccaatattggagtttttattgctgacaccaccacctctcacctccctgtccctcatcatttccctgtgctgcctagtttgcctttcactggtaatatttcaacttagtctaatcatcattaccatttcccaaaggagagaactgcagaatcataaacagaaccattgccaaacaatgtacctcttttgcataggcaattcttctagaagctgggttaaaatgccatggagatgagaagcagcacttaggaattaattatgtttttcacatttagcaaatagaggttgtcatgatgtttaaacagtacaaagaaatgagtcctccagctttcaaaatgaatgacaaccaaattgacaaaaaaagtgtctggggggcttatatatttttgtcagcattgcttttcaggctagttaatacaaagacatttccccctgatttatgttggacagtttcagtgtctacccgtcttaaaatcactggtttcatttgcagtcttctgaggtttcgccatacaggaggaatgcattcacagcgcggctctgtgaaatgacacaagagctaatccaagtaggtggctactttctgtcacctacattacctaaagcactgtggttcaataagtaaaagccaatgtcaaatttgaaactcctacccactcaggtgagctgaaagtcggcatgaatctggagtcagtcagtaagcttgttatattttatctttgatctactagtagattgagtcatatttgtaaaacatcacttgaattgatttcaacttgtcttgcacagtaggctttcgacttggtatactgtttgtgtacaagcacaagtaaattgaagctcaacaaaaattcatattcagacttatttacagtggatttacttccatggcagttctttcagcaaatgggcttaggttcctccagttagttatatgattagatggaattgtataacagaaggagaactggactgcgggtcaagaattttgacttttgttttcaactcagctatttaatagttgtaaacataagtatggctttgacctctttggacttcaatcacttcatctgtaaaataaggaggaggacaattgctctgccagcttcaaaaagtcaccgcaagaattgaattagagagctgcaaaagcacttggctagtggtaacccagcacacaaatatgaagcatttctatcttatctacttcatcccaaaggatcacattttctccaaataccattaagacttagagacctctaaagaaaggcacatactggcatttccatacatatgacagttcttactatcatttttatccagaatgctgagacccattagataaaattaatttattttcttctcgctgtcttcactaggaagatgaaggcacaagtagaaaactcttcattcttcttttaagaatataagagaaatcaacctaactgaactgtgcatctttcacctttaaattatccaagacttggatttagtaacatccttggtctttaaatcaagaaaggcttttatgaagcacctatattagatatagaactctgcacaaagtgtattttcctctaactttacagtagacattagtagagttcaccaaatttccaatctcatctataggggatattgcatttctctaatcctggagggtagatgtgtcacatgacttggtttagccaatgaaatgtggtagaaatgatgtatttttttttttcctgaggtaaacattgaatttccaatgtgagactctctgcagcttactcagcaatcagaagattaaaaaacagcctggggccgggcacggtggctcatgcctgtaatcccagcaatttgggaggctgaggcaggcagatcacgaggtcagttgttcgagaccagcctgaccaacatggtgaaaccccatctctactaaaaataccaaaattagccagacatggtggcacgtgtcagtaatcccagctactcaggaggctgaggcagtagaatcacttgaacccgggatgtggaggttgcagtgagccgagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagccattgagattttggagttgttaccacagcataaccgagtccatcgtgacttcatcacgatataactcatgagtattgcttgaaaataaatacagaatcttttcaaggcaagatatttttacacaacttttagtgtaaattttgcggtttgggatcaaaaaagattatacagaatttatataataaataatctagaaaaattcctttgtaaacaaaggagtctttgataatcatagaaatagtattgataggtacacagtatacctctgccttctgaagttaatgatttgggtaactacattttgaagacattttactgataacactaggacttaaaaagatttttgcagctcacttggcatccggccattggtaagaggtgcagccaacattttaccctacgtttccttcccattatctttgactacctcccaatgctattccataagtgttggattcgttcagtctgcaaatatttactgagcaccttccatgattatctctgtaaatctcagttcctcttgtatacaatggcagaaacaatgtctaaatttcaattggcaattaagtgaaaacataatgtatgttaagcacctgaaatagtatctaacatatgttgggaggcaatgcagggtaacaaggagatctttggttttggagtcatgcttgggtttgaatctatgctgcaccctttgctaatggtattatgttggacaaggctctttactcctctgagcctcagattcttcatttgtaaatgtgaatagacatgggttgttacattgtttattgatacttaaatgaaatgtctttccagcctgtatcatagtacacagaaaatagtagacagtaagtagtaactattaaaaagcagtcattctaggctaggctataaggatacaaaggtggacaaatgatcattcagttcaaagaaggcattgtacagtagagaagacagatatacatatacatactgtacatttatgataatataaatagtgcagaagaagtgtgcacaatgcatataaatagtgcagaagaagtgtgcgcagtgcatactggtagaactaagaaggaagcaatgaattcttgtgttagcatttaatacacttttaataaatagctgcaaaagtatcagtttctgtcagttactgctcttactcgatgtgggattgaaaatgtttaaagaaaatatcttgctatatatatataaaaaacaaattatatagcatatatatatatatatatatatatatatatatatatatagtgggtagaaaaaagacaattgtaacatcaagggtatttttgttgttttaaagtgtcatgttttgtgctggttgttttagtgtaatatagcatatcttactctggtgggaaatgtagtaaaacaaaaatattgagaacaatctttaaggcagcaccaagacaacgtttctgaaatagttccaatattattcatagtggcttgtataattatgtcctctctcttcatccatcatcttttctgtattttcaaggcataaaaataagagggaagagtcagctaaagcatttgacttagttgacaattctttgatagctcatgcatctctaaaatttagtactatattattgccaacattatgtatttaaatgaatgcagcttgatatcaagagaatgaccatactgaaggggaaaaaaaaataaactgcagccttcttcatgagtaacacttgaaactgttaaacacattaaaatcccatttaacaaatagcagaacctaatgaacattgggattgctcagtgagtactaatgtggaatattactgggaaagatgtttgagtgttgaagtttctcatagctcagaatggttacacagattaaggagaggaatgtctgttgttcaaaagacaaatgaaatttgtcagttcactgaaaatatttttgtttttgtatcttttttaaaactgtttcttaaagtagtcaactgctcattcttctattttgaaatttccagaactctttgtttaagttttgcatgtcaattttatatgagaaattcttggactgtatctagatacagttaatcaatctgctgtttagtaaattgtggtgatctattgtatgataatcaactagtgtatcaaccatgaaatcatctaattctgaaattaaaaggatcagaattataggtttatcaagtgacagtccattaattccaggcagttagatttcacaatacattcaggcgagttctggtctctggcctcaagttctaatgataacagtttccatttatcttctatgtcaaatcaaacaagtaatttgtcttttacttttctgattttattcatctgaaatgtggctagtagtctttattgtatcctttgccatggagtttgttagtcattgtttgtaatagaactgttttccattcatctattcatttattatttaagtatttagtcagttacttttgtatacatttatctgtctatctacccatccgtccacccatccatccatccatccattcatcaattcacccattcgacaaaagtctactgaacatgaacatgtatggagatgatcatcctgcatatatagatggcaagataggtttctgttctcaaggagtagcccataagctcatgccaacataagtactggctttagtaactcttcaaaaccccgttgtgttaaggagacttatcaggcccagaaattctgtttctagatatatatccaaaagaactgaaaataggtattatgtgttcatgaatatgaatagcaatattatttatgatagctcgaaggtagaaacaatccaaatattcatcaactgatgaatgaataaacaaaatgtggcatgtacatgcagtgaacattagtcattaaaaggaatgaaatactgatacatgctgcaatgaagttatctagaataggtaacttcatagcaacaaaagcagattgttagtttacaggggttagaggaagaggggaaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccccaaatgtcaaagttcctctctatgtacaacttgaaatgcttaattttatatgatgtgaatttcatctaaactaatgacaagaaaagtaaatgcctgtgacactgcatttttcattgacagggttcctcagtgaggggggaaaaaagcatttaatgattttcaaatgacacatgtaacctaaacactataggacagtgatatttgcctaatctagaaccttctaccaggttgtccaagatgtgcccctagagaatatagcactcaattaatagtgttggatgagtttatttacaggtaaagataattgccttgtgtttagagggtgccatctggcactcagcagccaggatgattccatccaactgcctatatctggtgatttcagggttaatttccttttctgcttcctgatcatatatgagctcatacatattcaaaagtactgtcaagtgtctaggattagcaaagtgggggtaaaagcaatgaaaattttagaaatctattgctgaaaagcttacaatttggataaagatcatcacttttgaagatatgtttacaccttgtaatgagccttttagctttgctctctggcttgattcccaaattcccagcattgattcccaaatctaacaagttatttggtaattgtgaatcactgatcaacaaaaatctaccatcactcctgagaaaggaactgaaaaatgcaggccatagcgagaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgttttgtagtaatttttatttggtttcaacagtcaatgaaaataggttaataaaatgtctagtatttcataataacctactgtgtgttacatattataccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaagatgtccttttacacaaaaataggaaaagcaagtaagataccaataacatttatttaaaatgtgaatgcatagtaagaaaagaaatatgtgtgtgacagcatttttttccaattttccatttggccaaaccagcttttctctaaaataatgagttatgccaaatcactctgctaaaatcaccagattgtacaaaagtaccaataaaatgaaggccatagatacagagaacaatggatttaatttaggccaaaaacaaattccagagatcattctaagtcagtcaactgagcactttgagaaagtttagcttataccaactacaaacaagcagatttatctctaagaaaaagaaaacaaaattgtttccatcttttatttcaatttaaaagctaagatggaatattaatattgcctacttctgctttccttgtttaagcactaaaagaaatcaagcagtcattggaatgttttcttttttaaaagaccctttaactatatgattttaaaaatgtctgtctccaaaaaatgaaaatcaaaacacatagccaagagccaagagacgaggaagaacattctcatatcttttcagcatttggaggtggtggtgattgtgagcactttagactgagccaacttgacctaatatgacaaaggaccagagcttttggttatggtattcatcagcttcctttctcagcatgcataattggcttatatttatgtcattgttgctgtacgattcctacagctgtataatacctaagaactttacttattcaccatctcttttttcctctgccataggttgagctctgttaaccttgaatccgctgtctcctatcctactgatggaagcattgcagcagctgtagaagtgtgtcagtgcccaccagggtatactggctcctcttgtgaagtaagcttgcaagaatgtatccttagtgctttcaaagttccctcaacattgctttcaataacctattctaataagagctgttttttttctatcaataattacacaaataatgtgtatcacttaaaaacaaaacttgaatatctaccaaaagctgtggctttcaattagagtattaaccacataatttcattttgtaactctttctctctgagatattttgcctataactgaaaatctgatgtttctgtctttgctacatatttgatctattgtatgctggatggtagcagaatagcacttcaaaatattttctcttcattttcatcataatgttatccaaaatttagcactctattttttttttacttttctctcattttttaattctgtatcacacttttcctctacttcatttctaagaatacaaccaaatcacaatcatctgaagcatataatcttcagaatgtcaagaatataatatatggaaaaaataccttgatatagaaaactgcctacaggtctttgatttgtttagcacctaatgtttgagatatttattgttgtctcaatatcctagatttataataagattaatggttcttacttaataccgcagtgtgtcatcctaaggtaacaatttttatttgcttctgtgtattttcttttacacagaaaactggtgtgaaactggttttacttgaaacctggtcaaaaaatgtgaacactatttccttgacagagcgcatggctagcagataaataggagcttagtttctttaaaatggtgcctttaaggaatcatttgagtgtactgagatgttccacttcagaacactacctcattatgccatttatagaaatactctaggcattgctttgtcagttctctcgtacttttaaaataatgcatacatctagagatacgcattatagtcatattcatgacagctgtgtttcctttaactgagctcagattcacctttctagaaataaaactagatataacttatagaagtacttgcttttccaaaattcatgtagatgagagaaaaataattatggatatcaattagctatgtcaacccaaatttgattttacatataaaatacacaatgtatttgatgaaacaagagccttttgctcttgattccaaactatttgaacttttaagatcctctctcaattggcataataaataacttaattctactcttgttttaaggcttgtttccacatactttgttctcatcctttgcattatcttttatacaaattctaagtgcccactgaatataaaattacttgaatattacaattgcttaattggctatgcttttagtctcttccttctctccttcaaaaatattttcaatacattctagatatgtttgataaattctgtaaatttacctgtataaattattaataagtacatacaacataatccctgtcctatctgtttagggagacaataaatatctatgaaaaatgggatctcagcactgtataattaagggagaggtatgtgctacagaacatacatgcaataatcattcaaagggatgagctactgcagtggagagagatgcaaagtgtcctggagtggagaaatcttaaattggatgctaaataatggtaacagatagatagaagcatttgagtgtgaaaaaaaaaggagagataataaaagcttcctgtatctgtcacacaataattgtttgataaataaaattactttgtaatccataaaagaacttaattgaatcaagagacaatgaattttggaactttggattttctctctgacttcttcatttcttctactctctaaaattcattttttccttatcaaaactttctgtccctaaattcactattattcagtcctatcctttcattatttcatttgcttttcaattaagtgtagtttgtaaggccagtcattctagccttgttatcactaatatcctgggatcccttaaaagctgagtaaacgccaaagaccattaatgtcttaattccagcttgctgagaacctctggccaaaaaaggatcaaatgactccattgtagacattctcttttacttcatttggggccatagtgttgattcaggatcttttttctcatttctacttgacttcttgtgaagtgttctgcagttaaatctttcaaaaattttcttactttcatagtgctgtcatcatagatttcacttgacagatgagacaggggatatactattaaaaagagtgttatgcaatctcagtttcttcttccatgaaatgaaaataatattaaccacctcatagaattgtttgtttgttcgtactttcatttagctgactagtatttgatgagcgtgtattttgagacaaacaagaccctacacagggaaaatagtgccattaacaatacagatattgtccctgtccccaaggacgttgcactgagtggtggcattaacgatatgccagaaagcaaatagaaataaacgtgacaaattctatgaaggaaataaacagggtgaaataaacagggttctatgataaagttactgcaagtggttgtatgaaggttagaaagtctactttgtaaaagtttgtcaggaaaggcttcctgaggtggtgacagctaaatcgagtgttgaagaatgagagggacaacgatgtaaaaccagctgctaaggaagcagcatagatcgtggagtctgtaaggactggaaagaaggagcgtggctggagccttgtaagcaaggggaaaagtgggacaagaagtgattggaaaagcaaggccatgaggagatttgcacatatgataagaaatgagcattttattctcatggcatggaacatcattacaagcctttcagcagagtagtggagtagtgtaatctgatttacatttttgggttttggggtgttttttgttgtttgagacagggtcttgctctgtcacctaggctggagtgcagtgatgctgtcatagcttgctgcagcctcaaactcctgagctcaagtgatcctcctgcctcagcctcctgagtagctgggactacaggtgtataccaccatgcccagctatttttttttgtttgttttaatagagacaagatctcaatatgttgcacaggctgatctcgaactcctgagctcaagcaatcctcccacctcagcctcccaaagttctggggttacaggcatgggccaacgcacccagcctgagttacatttttttgaagaaggcattatggctacagtaggaagaatgtgtcttaggagggcatgaataataggaaggagaagggttaatatgtagttgcagtggaacacagcaatgacagtagttgctgttaggatcatggcagggaatataaaaagagttagcatattctatatatattttgatagtagaacaaataggacttactgattcgagactgtatgtcaggggagagattaaagaaataaagagtttaagaatgagtcatagatgaccagtttgaatgattgatcagttggttgtggtgtcatttactgagctgaggaatagttggtgtgtgtgggggggtgggggcatggaatccatagtccagtttagaaattttcgatttgaaaacgctgtgaagtgtaaatgtcaatgtgtatttataatattcaggtcttaaattcagcatgtctgtctggtctagagatatgtttttggaaggcgtcataaactatggaactgaataaaattacccaggagaaagtgcaattgatttaaaaaagagagaaaaatagcccagcccaagccctgaggagctcctgacgttaagaagcagggtcaaagcagaggagacagcaaagaaatatgctagaaatttgggaagtgtgatgtcatgaagttgagaaaagaaattgtgggaggaaaaggagtcagctaggcccaaggctgatgaaaggttggataaaatgcaattgcagaattgtccatcgaatttggctgcatggaatttggtgacaaggacaagagcagttttaattgagaggtggtgacacaaaacagattagaatggaatgaagtgtgaaaaagaggtgaggaatataatacttgttaagagtagtgttactgaaaagaaaaacatagatgactagaaaagttatatgaggctaagaggacagttttgtcatttgtgttttgtttatttttgatggagacactagatcatatttttttgtgctgatagtaatgacccagtagaagggaaagttattactaatccatcagagagagtgaatattgagaagataacagatgctggaatcagatgacaagtggagtaatatttctttaggaggaaggaccccacattccccacatcacttgtttggaatgggaatatggcaacaaggtttggagatatatgcttagatctctggacttgttagtgcaaaggcagctttaatttttttctgtgagtaataagttaaaatcactggctaaaagagaggtgtaaggagttgggaagtttgaagaaagaagacgtggtatgagtactgcatttgcagagtattaaaacaaaacaaaaaaacttattaaggaaaacttcatgaatatctgtctgaaaacagtagattagttctctcccttttctcaacatccttaatttctacccccttatgaatatgtagcttcaccagcttttaaaaatgtatattacagaaggaaatcacttctataatgaatctagggaggcaaaaaatgtaatggggagaaatgggaagggatttaattgggagaaatggaaacggaacaggatagaaatttgacaattttgggttggttgtgggggttgaaaaatgagaacacatggacacagggaggggaacattatacactggggcctgtcggagggtggggggctaggggaaggatagcattaggagaaatatctaatgtagatgatgggttgatgggttcaggaaaccaccatggcacgtgtatacctatgtaacaaacctgcacgttctgcacatgtatcccagaacttaaagtataataataattttgaaaacaaatttgacactttttttggtactgttcaaattaaggggaaagttcattttattttattttcagatataaagtatcagtacataaatttttttatgtgttcattattgatgttcaaatttgagagtcctcatatcctgaggcagaaggaacatttccacggagcataacacaattctatatcctttattacttcagtggtttctcttctgttttctttttcaactggaaaagaagggcttttcatgatatatgatgttgtactcgaccatccagaaatatagtaaataacccacaagatgcaatttcactggagggtgatcataagctcttagagggcagcagtatttgcctcatgcttattttgcatctcatccattttgtagtaatccccacagatggaaaacttaattaaggatgatggggaacttagagcaggcactgacacagggaatctaagactaaaataccctgttttaatcagaattcagtttttatataataaagtgtttcacattttaaacaaggaatgaaaaatacaagcaaagttacagaagaatgccataaaataagctatcaagaatgtgagaaataaatcataaactttttgtgtaaatttgagaaagcataataggatggaggaaatttagcatgaaatacatgaattatatatgtgtagaaattagctgtgtatgtggtcaaatataagtgtgggtgctgcctttcttccaaatcatgtcaaagattttctggaaatgatgacgttaagggcaattagtatatgggcaagtgaacacattccagagaatcaaaattgcttgggatgacatcgggtactctcttaggctaagactatatgatgagtccttttatatcagctgccttttttacagtactttttcttctactttcctgtctgtgcttttttctttgagactgtcacatttcaattctttatatctctgctttattttaccatttcagaagaaacaccaagctaatgcttcctctaatctcatacctgccaataacactaaggtcagtgcaaagccccagtgtcaggaggaatagctctgttgcaatgtttcaataatggcaatgctttgacaagcacatttgatgagtttcctacctgttattttctgttatcagaaaacaaacacaaacaaacaaaaacacctttttgttttaatctccaagactgactaaagccttatctttctctcagtcttgttggcctaggcacaggcgagttaacggcactatttttggtggcatctgtgagccatgtcagtgctttggtcatgcggagtcctgtgatgacgtcactggagaatgcctggtaagtgctctcttctttggggatgctgattgacaaggctgaaatcacctcgacagatgctacaattcagctactaccctggggaccttaaacacttgagtcaagaagtgctttgacaaagatctttgtattgaactgaattggaactgagaatgctctttcatatgtgatctccctaatgaatatgaggaagtgtttattcatattaaatcaagaattaaattagaatcagatatatttttataaggcataacttctgattggaagtataactaccatgaatatatatggtttcactttcttccataaatctatgaaaagtacagtgtacttttaaaatagaaaataatttatatccccataatatgaaaagtgtaaaatataacctttatagtaaacataattaagttttcttcatgttgaaaatgaaaacatactacatatttttatttaaaatgttcataatttaactaaatgcatagtgtcatttgtagattaaaaataaaaacaatatgtaatacatattcaccagagctgcttctcctttgcaattaagtctaagctttaaccagaaaataggctttacaaagtgcaaagcactttccatcctgctaagaaaccttaggattggagaattacactgaatagaccattctgattaactcaagggcacattagttttatattgtctgacatggcatgaagcttgaaacaacacttctcctttcattagtcttgcagaaacacaatttaaaatggtgccaattaaggaggatattatactctcatttccctgaagaatttaaggcggattctgttacctgtaattcttaatgttctatctttctcttgctcattttcccccatttctcttctacttaaaagcttctgggaaaaatccaaaatgaaaattcagggcttttgtttcagtgtaatttggcatttaggtttgttgatgctctttcccttttctctatataagattttgtttaattgcattgcattatgaagcatgagagccttaatttgtggatcagtggatttttgaaatgacatttttatgaatagaaagactaagtgattttcattttaattatgccataagtcttttaaaatgtactttgggaaaaatattgggttacatttaaacacttcactaacatgcagtaggaaataatactcagcccaaaactgacatggaattgttttacttaccctaagaagacaaaaataagtatgtcataataccaaactcatgatgttccatatagtcatatttcatgaattcattaggataaaatcaaatcaaattttcatgctgaattcattaggatgaaagcaaattagtccatttgttgatgtgatatttctaaaactagaagccttttttaactaataaaacagtgtcattcagcataattttgagagaaggaagggagagaacagaccctactaatgatgcctagtttactgattttgtttcatgaacagggagataggaggtctccttcaaataacagagcgatcttgaggaaacagtggacatcttgatgataaagacagaatctggtgtttcctgaattttccatcatagctagtaaataggtgatcatgtaggatatactgactttcaagtgccctttctccaaaattgtattgataactaagtgctgatattccattttgagtatatgggttctgatacaatacacaaagaggagaatatttgaatgttgctcatcaagggcattcttactgttcagctgaccctgcattttagcttcttgtttatttttcatggttttaacccaccattaagtagcatggtttttagcatgaaaaataaatttataaatttataaagcttaacttgctttaaaatttgattataaattatctgaaaaatatttttggcaccagaacaaaatctaaacttctgcaatagtgtaggtctatatttaaaagacattttaactcaaagtccatttgaagtaagccaggaagtattcaatgtcacatgggaagatttcatgcttgcttcttctcatagttcttgtggtatgtaatgtgagcaaaattttgtaaagcactttcgtaacaggacacctgtaaaaataaccaatccatcagagtgaagcttccatctttttttttttttttatttccattatataggttgtctgatgcagttttctggtttccactacaaaaatacttgagttttaagatgatttttatttgatgaaacgtgacattagaaaatgtaagaactacatgttatttgtcttttaaatcaataattggaaataaaaaaccctctcaattatgcaagattttcagttgaatgttagaaataccattttcaacatgtttaaggcaaaattaatttttgattcaattttttaaaacccttaagtatttgaagacataattttagttgtatcagtgagataacatgcaaataattttacaaaaaaacaagcaattctttagtaatagcttagtttagctaaacttaaaaattgaaaggaagtaaaacaaaaatcaaatcggggaaaaaatctttcttcaaatggatccatgttttgcacattaaatcccaatatactgcattattaaggcaactattcatagtgaagctgaccttaatgctatcttttaaaaagttttgttaaaaataaatttgagaaagaattttaaataacttagagaaaagactgttttcaaatatcaccagttactacagaaatacatatccacatttagttgatgaaattggcacgtgatgtttaaaatttttcaattttctccatgtttaattatgagtcaagcaagcttctcacagatgtaatacagtagtgcattgtccaaaccatcagagtccactgaggccaaaattcatgtctgagctaagaggccatagccccggaggatttctatgattagccacagttcccattaaatcagcaatttcaagctgaacaattgatttttacctagaatcagctacaatttccattaaacatatgttattagtgctctatgactacacacacacacacacacacacacacacacacacacgcaatatcatgtattttcttaaggaaaataaagaaaaaatgaagtaagatttgcataatgaaaaacattaaaatgaatttcaatcatctttttgtaagtatgcatatgctgaaactactgtgttgtttataagctagatattaaattaactttcaatgctatttctctgctgtaaaattgaccatttaacatggaaaaattattcttgctggcagggagcagactaatgacttcgtagacctatttttggcaacatgttgatccctgacaccaaaataataaactctgatgctcatttctttctcagaactgtaaggatcacacaggtggcccatattgtgataaatgtcttcctggtttctatggcgagcctactaaaggaacctctgaagactgtcaaccctgtgcctgtccactcaatatcccatccaataagtaagtaacaaacttaccccatgaataagctcagcatccatttctgcaagtacacttttcatagcaaatatacacttccttttatcccatgtaaataaataataaacacagacatgaattttttcaggaaaattatatgaattttttcaaacctaagatatttaaaactatgaggatttctaagaatttgtaatttttttagctctagttttggtgatttaatttctaagagtagaactcaaatagaatttctacaccaattccaaagaacataaatattttatacaaacacatacatgtgcatgcatgtacacacctacacacagacacatacccatcttcataccttaataaaaggatataaatacagctaatttgggttctacccatacactatttttttgtgaatcttgggcaagtcgtaaacctctcaaaaagtaaaatgaagggactgatttaactgacttttaagtacccattctatcccttctttttagaaaaattcgttgttcacctagaacaaccacctcttagagcagatttaaaaaaacaaacaacaacaagaaagaacacttgacttcctcatttccttaccttttagaggaatgctatatccagctgcttgaattcacattccctcagggcagcctctctcagtaaacagctaagcacaccccaaccaaaaatgttgttttgtttttaaattgggatacttttttttttttttttttttttgagacagagtctcgctctgttgcccaggctagagtgcagtggtgcaatcttggctcactgcaagctctgcctcccgggttcaagccattctcctgcctcagctggactacaggctgtgttgaataaaaatcaacaatttttactcaaaagtgattataaataactatacttttaaataaaaggaaattcttttctgaagaactctcttaaaggtgagcttagtgcttaataaggttcatatcgtattgtacactttccagctatctctaggcactgtgacaacactgacagagcaaaaattttcaatgatctttaagggaaatctgtcagctatagtcttttaatgtgtagatgtgatcaagtaggtcatacttcaaactcttacccagaatgcgcctaattaaaatggtcttttgttagattcaatgaatactataagctaaagactttgagataattctaacattaagtttaaatgttctccttgaaactgtgcttcctactgttaatccacatgaaatgcttatcctcccaatgaccttctttactcagaattttttaccttactcattgtttggaaaagaagagaaagcactactatttaataaaagcagactactatattctaggccaaacactgtatttggtattatttcaccttcaactataactcagtaaggtagatattattatcctcattgtatagattaagaaatgaaggccattagtagaaaaatggcattatgatgccaattctggagccagactctttggtttaaatgctgggttccatactttccagctgtgccactttaggcaagtcactgaaactctctgtgcctcaattttgtcatcattagttataataggactctcatagggttgatgtgggaaagacataattaaaatgtgtaaaccacctaaactgtgactggatatgatgaacccaatctaagagctgattgttattaacctgctcagagtcataaagtattaaagtatcagagttggaattttagttttaaaatccatgtgctttccaaatctctacggtctacaatgaagacttctttaaaaaaaaatacacactgcattttaagtgataacactaaaagcagtaattaattcattggataagtcaatttatctagcaaggttttgagaaaataagacattggtttaatgcaggggtcctcaaccatctatagcctgttaggaaccgggctgcctagcaggaagtgcgtggttggcattaccacctgagctcagcctcctaacagatcaggcaggcattagattctcatagaagctcaaaccctattgcgaactgcacctgcgagggatctagcttgtatgctccttatgagagtctaactgatgcctgatgatctgacgtggaacagttttatcccaaactcctcccctgcgtctgtggaaaaattgtctccaacaaaacaagtacctggtgccaaaaattttggggaccactggttaatgtatgttagtgatcagaacatttccagggcctaaggcatgagcctgaatgggctcaaaactgaagattctttaacaaccaaggatgttagagaagaggaagaaggcaagagagaaacctgttggaaaataattactataggagaacaaatgaaatatattccttcataattaaaggctactcaagcctatgatagtcataacatgacacaaaacctgcactttggtatatatgcgaagggttagatcacccaatggaagacctacttgtttgccatggctgaatggcattctcttaaccatcttcatttacatgaaactcattgttcacgactaacttgcatttgaggaaagcagaagtattgcatctggccactcgtattgcatctccttctcagccaagatgtcatgagcattagcaccactatcaatccagcagagctggctgcccattgcatcatgtgaattccagctgaatacatattagaattatataattgattgagtatgcaaacccgatggatttaccctcaagtctgaccaacattactataaatgcagaggaaacattagggagataattttgcttggataattataggcattcatgacccattgttgtctctttatttattgtgcatttacttggataatgggttctaattgttgttcctgaaaaagaaagaaagtctgcaagcattaaaacacaatccatcagtgccaaagggattgggtttccagtgtccaataatattatttcctaaaagatgtatattctaatttggtataattatgttgatcctgatttttaaaaatgcatataacacagtgataacaataccagtaacaccaagtatttaatgattctttcattttcaaaatgttttcacttagagtaagcaattaataattattagtaaatattaataattaccaaattatcaaatattaatataaaatattaaaattagcaaattactaaataataattttacttctagcagtagaattgggactagaatagcaatttattttaaattccagctttcaatgtggtattttaacaagtagaaagagagggcagtgataattcacttagtttataaatcctagaagttttgtgagagggttataatgtcttttacatttaaaacaattttacatttaaaacaactagaaaattatcatggtttagttgcacaactgtgatgagaaaaatccattttcatctaacaacctgaaatgtttaaaaaaaaaatcactaaacaagacacttaatgacctagggaaactatcctttttaaaaatattttataaaaaacattactgttataatgtgagctagaaactctgagatatgaattgaatctttgcatacaatcctgaagacgagattttaatttccacaggttattcagagaaaaaaaaaaagggagctaaaggttgacgcaaccttcatgggaagtctaaagcttagtgatagttttaccttggtgatttatctatttaatccctggtcataaatcttatagatcacaagcattttggctccaaatttcttagataatattgctaaataaatcaaatatgtaagaagatagagatagattggtataattattatgatgtatgaatacagagaagcatataatatttaaattatacatatatatcaacttcatcaactatttatggtgatcactatgcttggccttctcatcttgttgatgtatatattctagctataggttgtaactaggcagtaaaagttatctggagagaagcaaataacaatgtaactatttcgaatgtttatattctttaatttctggcatcacatagcttataggttaaataaaatatgaaagagacatgtgaatctcagcctttgaatacttaggatgtgtttgaatatataatattattgaagttgttatagattttcatcagttatataataaaatatattattggcacaaggctggacagagataggacctcaataagttctatctactaatatcactgtaaatactactggtttgtgtgggtcaggaatgctgaaatttaagtttttgaaagaatgaaactcaaatttgagttgacctttgggctcactcaagagatcatattgaatgcacgttgttaaaattaatatagagaaatgtattccaagacaataggtaaatttaaggaaacattcaattcagccatattctctagaaaattgagaatgctctagatgttttagtgctctttcctacacattgttttatgtgcacatgggagattatgatgggtcttcctggttccatatgccaaaggaaaaaactaaagttcagagaaattaagtgccttgatagtgattatacagcttgcttgtggcagaaccaatattggaactcatatattttgactcacctctctgtgcttcttccaatggggctacagtaatagaaacaattacagaaacattgaaaagaagcaaaaaaaaatcaatagaatttaatgtcagacaaactgtaaatgttcactgtaaaaatcagtaaatcttcactgtttggcaagagttatgttaattatgctacatagttacagttatattaacagctatgttaatataagggactagagcaggatgagaaaactgcagatttaattctttaactattaactaaatacctttcacgttaaatcaacatatcttaatttgtttaaaaatttgtaaaaaaaaaaaaaaggcaaagttttttaaaaaattaataagtcgtatctataatttattatggcaatatgctttcatactttttcagtataaaagggtttatcaaatcaatcatattattccattttgcagaatgggaaacaggtttagagaaatatatcgttcaaagacatacttagaaaataaatcaagtctaattaagaaatgcaattgtggagattaaatcagatttcatagtacttaaaggtaattaaagaaataagtgtttgcttaatgattctcctgagaataagtaggagagatcattgaactgaagaagaaaatacttagaaacttcagaaatttatgacgctaacaccaaaatcatgaagtaaatgaattttttctttttctcctcttcctctcagtccctgccccttttcagttatgtgtgaatattctcattaccctcatctccagcttctccactgacattgtgtagccactcaaaatggtttctcttatcctacccaactgttcaagataataattagttgaaaggagtcctgatcccctgttgtgtatgcaaatacagaacatgccctgattttctaaccctaatgatggaagttttaattttatacccatgattaaaggagtgcttgttttatatcacatacaatcccaagaagcaattcattatattttatttcaaatgcatgacagttaaagacacacaaaatattctcacacattgacttaatatgtgtttaattttattttagagtattggattaactctctgtgggagcatttaacgttagaactgaatttcaggacccacagaaggacccacagaagaagtttccctaatgtctgataatcaggaattgttgagcttctattgagcaattgttttgcttttggcttctggctgctctgaatcatttacctgttgattgttcccttttgcattagctgtgaaaaacctcaaagccaaatgttgatccacccttatcaaatgaacatatgttataacatgcattttgaattctaaatacacccttaagtttatcttttttttagtatttttttctctttaaccttgctttattcttaatgcacatattttgacagatagaattaaattctttttagaacaaggttaattgtttctctatgtatgcattcacatacataaacatatatagattgttgacatagtcacatgtatacacatgtatgtacacatatatatgcatacatatatacatgcttataagtagattataaaaataaaagtatatattcagccattaagagggattattttcatgtccagctttttattggttatcccaataacagcttcccctcctcccctatttgtggaaaatgcccgctgctcttggctttcttgtgtttcctgtggcgtggtttggataatccgggatgaagaacattttctgctggtgtggagctagccaaatagagttaaatgacataatcttggaatcacttgaggtcaatgatgatctcacaatttcctctttgtgtcacggaacaattagcttcatgtcttggccaaaattagtgctaagtgactgcatttgccaaggcaaattctgtagatgttttttattgtgcatgtttatttctcactctaattttatttttgttgttgaatgccatcttctgccatagctgtaactgcaattacagcaataagagagtgaatcttcagtttatgttgttgaaagaatatcaaagcacaaatacagatatattttatgagaaagttttatttggatgcgttatgttgagtatctatattactagaaacttaaacttacttaattcttaccagtaggtttcaatgacaattggttataggaagaagagaatatcacattaagaatctaaagtcctagatcccatactaaattctcctggaaattttgtatatgaccttggttaagaaaaactgtgcctgccctaaccagctcataggattttgtgaaaatgtgataaaattgtaaaagtattctgaactgtaaggagctagtcaaatttaacatatttttattgcctaatttttttctcgaaaaagtgttgatttttgtcagtgagcaccttttacttatgttggttttaactgacatgtgagtgtatttaagaatctgaaatctattttatgaatagctttaaagtgtcaaggccaggtgcaatggctcatgcctgtaatcctagcactttgggaggccaaggcaggtggatcacttgaggtcaggagttcaagaccagcctggccaatatggtgagaccccatttctactaaaaatacaaaaatgggccaggcctggtagcacctgcctgcaatcccagctactcaggaggctgagacactagaatcgcttgaacccagtaggcaggggtttcagtgagccaagattgcaccactgcactccagtctgggcaacagagcaagactctgtctcaaataaaataaaataaaatatttttaaaaatgtcagaagccttgtcaaccaccattgacaagagttatgataaactgatttaggattataaaaaacaattggtatggttttctttcaatcagtgtagtcccacagaggtgggaaacccagtgcttctggttggagtcagtttctcagtagatgatgagatagttacagaatgccaattttcaaagaagacatatatatgctacagagatgcagttctcacttttatgtctgaaaacagtaacagcaaatcaccggatgtggatgagaggaaatcctttttttttattttattttaacctgtgcatcttcagtgcaatcacaatcccgtcaagaaaatcacccatagtgaactgtctttgggtcatgcgtagcaaagtacaggatgctttataaaaggagattctttactcgcagtgcacacgctgggtatgtcttgtctgctgttcatcacagctaccagaactccttaatgtggaatctttgatccagataatatttataaattcaaagcatcccagaccagcctttatctccttgacccagcagattcatttagactttccactgagttgaaatgtttaaaatgatagacttacctggtcctaatatcttgctagtatcccaaaaataggaagaactattaaatctttacagaactaccctgagttaagccagagaaatactattcagaaatagtgttcatgatctgatctgcaccaaagttaagaaagtatttcaaagtaattcaagtgtcaggagcaggatcaaatcaggacttggaatgtttaatttgttgttatgtctttaattcatttagccgtcaagcaagtctctattgaattgccctgtcatatataatagaaaacaaatctacttagggaaaacataataagagaaagattaattgagggcatttccctttaaaacggtagcgcaacagaccttacagaattcaaaatggttgatggcccttcagagagccagtcgagaacgcattaccgtgtgtcaatcttggggtaggggttcatgtatgagaggtgcctctcacaaggcaaagaagcatggctggagtgaaacatgttgctgaaagctaaagctagcacctgagttctctgttggttcttcatctggtgttcagctctattgtttcagacccaaattagaaatatgtgcaaagagagaagtgaattttgaaacatgccagagggtatgagatggcaaggttgcttttgtttggttaggtttatgataagtttaggtagaatatgcacacttgatctcttctgaaagctttcctgaggattccatcagtgtgagggcatacctgcaaggaagcacatgccgcagcctgcacacaggcacgccccactatggcagtagctgaagaaggaagcactgccaccaccactaccacatactgagatttccaaaatcactaacaaatttctccaggctgcttcaaattcagagggatttggctacagaagaaagtatgtgaggctgcatatgtgccaggcctggaggaatttctaaaaagcagctatacatttccacttgttactgatgatcactactcagagcagtcaaaagtcagttaataacatgtcacagggatactgctctccactgggctatattcacgtctgcagaaatagcaatgtcatttcatcctccattggccagaccctaatctctgtctctggggtgagaatgaccagcctgtactcttttgtcagagcagtagtggagagagagaaatgagaaaatgctaatgactttgtgtatgtccttcttccttgtccctgttttccgcaacaacatcaacatagctttagcccaacgtgccatttagaccggagtcttggattgatctgtgatggatgccctgtcgggtacacaggaccacgctgtgagaggtaagagtatactacactgtcttgcaaaatgatttctaccttgggagttataaaaccgcagatacaatcatcctttgcatcatcctttggagaaaaaaggccacactcaatgaggtgaaataaagtttctcaacgcacttgtcaaacaaatgcattatatttttgtaatttatttatttttcagaaattgcttcataaatcttcattcactcagagaatatctgattaatgttttaatcttaaaggttaagtattaacctacaatctttgtagaaagcattgctcaagtggaaagtcatgcactttaagatttatcttactgtctgtgtaggcaccatttatttttcataattagctttttgtccttaaaatgtagcttaaatgcatagttcatagttcagcaagtggttcataatttactttaaatatacttgaaaatagaaacaaaatgtaatttattatcatgatttatatcctcttctaattgctcctaaaccagtattttaattcctgttgattttactgggttgctttgcagcagaaacaagagtattattttatgtaatttgtgtgattatatttccttctgaaatgtttttgaagaaataattcttctatatattcagcctcagcataaaagtgatacaaacttcccccttgacatcattgccaaaaacaaaaacctccctctggtttcagcactggaaatagtccctgctgccacccttcctgggagggaggggtgcaaaggaagtgacctactttcactcatcatcactgaggctaaccctgaagagggctgtttctgcccgtcttttcctgtcatcttggcagctatcacccctgtttcaaccaggatgcataaaattaatgaagcaggagcctatcacccagagagaatttagctagcaactagcagtctgtggacaaagtgccaatgacagttcctagcagcaacaagtactatttgtgagtatggaagcatctgtaaattaggaatgaaagaaaaaaaaatgaaacaagcagcatttatttgcaatcaagaaactagatatctttaattgtgtgtgtgtgtctgtgtgtgtgtttaaagaaaggcatgtgcatattacttactataataggagaacatatcattgccaagacagatttacatcaagtgcctaaaccccccagttcactacaggcaacctttttttagcaactggaaaatgacagctgctctgtcatacaaggctattaaatccacttatctaggtgagcataatctctgatgtacttatattgctttgctttatgtactatactccctatacatgttagacaatagtttctgaaccatctataatttaaaaccctacattttatttaacaaacatctgtttagcaactaccatgtgctgggtacaaggctagacattggatataaatagatgcattttcccatccttgccctcagcacctcacatctttctttaatgcaagtgaggatggttgcttgtattcttgggagaattccatttgaatagtaaaaatcaccaaggagagaaatacctgacagaaagtatgatttcctgtctaaaatctgtattaatctgattcagaagatggcaacatgcatatgcagtgtaatgaatggcatattttatctccagctcaagtttttccacagttgataccatatttttctagccagaatttagattagggttttccaggaatatttaagatttataatttcattgtatttatgtaagccaaaagaacaccttagatagatctaaaatatgagggaaacattttttgtttgagatgtgcctgttgaagtagaagagagggaagataagggtcagggtaaggaggagatactggttgcattaaaaatcttgtaatcaaaaccattctgtaagtgatttgtgtgatcagcttatgcacatcatctaaataagaccagaatttaaaaactaaatcaacatttcccaaattgtagatgttcctggaataaagaattctgtgatcacatgagtttgggaagcatccatttgcatgttaaaagttctggcatgtcctacagtgtgtaattaagaaatctgttcaatttgtttagctcagcatttcctaaacttatgtggccataaaccctctgctttaactatatagcaagaatatatctcagactacagctcaggtgggacaagagttataactttatagtctttatcacaatttaatttctattttgagacccctttctctatatgtgggaactgtgaggtcttagaaacataatctgagcccatttcaagttgttttcttctcctctctcccagcttgaatcaaagttctattaagcttacctagtaccaaaggccttatatgcaagggtagaggggagggtataatgtctgtgtgtatatgttgagcaaggggacatgtgatagggccagccagtactgagtatttcacccaagcatgtttctgctgacctatccctttttctccgtcctcctaattacctttcctttcaggtctagaaagtctctcaactactttcattccattcttagaggcacaggaatcattcagcttctttcattccatgctaagacccaccaacatctctaccatcatcatttttccatctgcctttccaaatccatcccattttctatttgaaaaaggatgagctacatttgtggaactggtggctttcagagctcggggtctggcagattcctatgtctctgccttttgccctgtcaaatcccttcattcaaacatgtagcacaagatggccttgcttcttgaatcgagggggtgaagagaaacagtgaacaggggaatggccaaacaagatacaacaaaacatggattggtattctgtcacaagttgaacactagttacagcttggaaaacattcacttagggccaaaacaccactatttttgaggtatcactgctttgctggggaatgatttaaacaaaggaaaaaaaagagtcagagagtgaggggagaaggtattcatgatgatacctttgctaagattctagacttttatcatctggacaagaggagaataaaaataacaaagagacagaatcttgaagggctaaaagagattaagtaagcaattggaatatcaagagcaattaaaaagactgttgagctaaaagtgagtcaaatgctgaggatacctgcctgatcggacactaagttactttcagaataagtttgtaacctcagcaacatgtcatacattatggagaaggcatttcaaaaaggcaggcaagttcatctggtggattctataggacaacatgaaacttaatgggatacatagacttcttaagccctccccgctccccagctggcaaatttttaacaacttctccttaagtgatgagagaggggtcaaaagccaggactaatctcacaattgccactgaaaatgtggaaggtgtttgaacctaattgcttaatattttgaaaattcatctacagttttatcctcaagattcatactagatatcaaagaaattcctttttgtatcttaaatttcagttccaaaatcccatttagattttgtctgcttcagaatgtctgaattcgaatcaagtctaatcacccctctgcttactatgctcatgggaccttctattcacttgtgagtctccttgtgcctttgggtcctgaatgcagagcatgggctacagaaataacagaggaggggcagttatacctacctgtagtactgttagcagaattgtgactccagttgaggtgtcaagaggccactcatatgtggttgtgcagtttgtacactgcacaaaggcactcagggaaggggaagattgagggcttgaatccagtttaccctcttcttttccatgaagtccctgggtgtctagtctgtttactttttctgcatatgtctagaaaggacaatttcttccaacttgtaaaaggcaccatttgagcagggaaacaccctcagtcttttgctgattatgtcaaatgggaggaagtaagaacacagcattacagccacgactctttatacagcagccaccctcttctgtgcctttgccaatacgttccctctgcctggaagattgcagccctttcactcctccacccgagactaactaatccctgttcagctcccaaaagtcagcactatcatcctgaaaatgtccttgattgggcctaatctgagttggttgcccttttgtgtgctgccataatagcatttgcatatctccagttgttctactgctacgttttaaaatgtgtgttcattctccatggactgtagtgtgaagactgtaccttatttgtattagtaccgtgtaaaagtgctcagctgattttttttaatgggttgggagaaaccagagcttttctaatttgcttggctagattaagccagcattatattgtttcattgttttcagtgtatagataatagaaatgtaggccgtgattttagccaaaagttgctgaaaaaatgatggggcagaatgagacaaaagtctcatcagtgtggttgctttcttctcattgttgcttgtctgcacgtccgctctttttctacctctccctctctctcttcctctctccctccctccctctaacattgttcctaaattatcaatagcagcaagtgtaacaaataactgcatgtgttatctggagtcttatttacatttaaacggccctttttcaaaatattgcaatttgatttgaaaaagttaacagatgtggaaaggaacaatgcctttgttatgtcaagatgtccgtttctagcaaggcattcattcgataaactatttttaaaaatgcactcattctgccttgcatatgaaaatgagagggcttgacatttcacattacaattatttttggtggagtgaaaaaccaaaggactgtgatttaaactaattttaattaggtgaatccaacttgatcagactctaacacactatttttattaataaaagttatatgattagcagtattatattctctgaccctcaaattactttttaattcctaacggaacaccttcagaaatctctaatactgttctctgtatagaaacacacacccgtacaccagtaatgtgctgaagtgttgcagaaaatagtcccactttcagtaacatggcatatgaattttctatcacgtatattcacaaattttccttacatgtcctgcaagaaaaaataaataaaagacagatgcttctttagttattctatttaattatagttattttcctcctgaaatgagtttttttattatggagaatttcagtcttattaattgctatctaagttaagaaaaattcccagatctcgttatataaagctatctctccaaagggcagtaactcatcttgaggaaagtgagctgaaaataataggttttcgtttgctgtgataatgatcattgtatatccttattccagtggcacaaagtcactctcttagtggtaaacaaaatgagatgtgaatatatgtggatgtgatcataagctctgaatattaaataagacaagaagaatcaggttaaaattcaaaagaatctccttcttatctttatcaaatgcctctcttgaagggattttgggggaattttgtgcactcaaattttattgcatattttataatacagaattaacaaacaattatatctgtggttggcaatattcttctaagcagtatttatacaactcataagtgtataaaatcttttgtgaatataagtaatttcattttaaaaattatgataaaacatcaaatctatgaattatagtacctaagtacctatacattttctagaaaacttagaatcatcaatgtatctgcaccaaattaatggctctgccccagaattgggatttgttaaagtactctcaatataatgtactggatttaaaccatttttatttcaaatggtagagagcctttctctaaataatgactgcatatctgtgagtagatgagcataaaagtggtgtactactgaggaaattatattctcccacattgtttttgatccccttcaattttgacacttgctgcaaaagactttatcttgataagatggcaaagataacagagctagcctgaccataagattcagatgccctgttctgtttctcctttggcaaatgtggcttagtataaagtgtgagcaaatgtcattgaaagagaagacagagcagaatataaataggcgctgcctataaggacgtttctgcacacctgtagcagtaagttgcattttaaaacataacatttaggtcagagaaaatttgctgctatcgtttttaaaaatcttctttgccatgccctataaacaaacttttgtttttccaataatataatatattatataaatagttttatattatattatatattatataatatatataataatatataatatattatatttatataatatatataataatatataatatattatatttatataatatatataataatatataatatattatatttatataatatatataataatatataatatattatatttatataataatatataatatattatataatatataatataaatagtttttggtaagaaagaaagagcaggagacaaagaaagaaagagagaaacagagagaggaaggaaggaaggaagggaggaaagagggaaggagggagagagggagggagggagggaggaaggaaggaagaaggaaggaaggaagggaggaaagagggaggagggaggagggagggagggaggaaggaaggaagagagagagagaaagaaaggaagaaagggagaaagacctggagtttgctaatagagttggcaggcacagttcagtatcaccttatggcatattcctataatatgcaggcatgctttctcagacttccctttagtaaagccttcaatgaaaatttgcctctgaattcatatgcaaatacatacaaatagattattaattcagatatacccacagctcccatccaattaataagaatcttctgagtcacagtttctagttaataaattctgaactcttattactgaatttccttgcgagcctgtttcctcataacaagttctggctgcaacaacaacaaaaaatgtgaaccttacatatttgtagagaaaataaccaattggagtagagacatatgatgtgttgtactacaaaggctttccaacatggacctggattcctccagagtgccagcagcagattcttattatgctttggtctcattttcagtgccagtgacaagattatatatttttttcgggctgaaatctaattactagtgggctggcaggatatcatcttgtatctacactgcagttgtagaaaaacatttttttaatcacgttgcgtttgagaaaaggaacacttaaaaggaaaatccatcatcctgggagaaggggagaatgaaaaatatgtaaacattgccccaactgaggtccccccaaaggctcactgatgaaatttcttgccttaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagcgtaagtcctgaactattgatgcccctgacagaattgatgtattgtacctcaaagtagctgatgagttcttgagtgtggattgaagagtaggaaattatgtggaatacatggttgatagatgcatagaatatacagagtctgcatattccagaacatttccttgtactaactaatagagtaaatacctttaaaattgctgtggtattgaagcatcactgttttccaaatgataaacatgtttttatttacatgcggaaggaagatttttttaatgaacttatgtccacagcaggaaagaagaatttgcatattagatagacaccatgtatccatttttttatctcaattctaatcacttgctttaaataattttttctgcccatgatatttcagtagtagccatcagaaggtgttaatcagttatgctttcatatgttaactttacagtgtcgtattttgtaataggtataaaattctgccaatattttcgcacacaggcatttgtcattgttgaatgattaacctcattttagtttcataatagtcatttaaggactatttctagaatgctctttcagtgttttccttccacaaaattagctactctagggcttcatccatattagtataatacatttctcccctctttaccttttttgctgtattaatactacatagaatttccaaatccttaatgtcagtgggattagaatatgaaggcggatcttgttgcagaagatcaaatggaaagtgaatccaatgttagcatttggccatcatcagcttcatttactatcataatgtttaagcagagtaggttatgagaccagcctatccattcatttctgtcaaatttatgtgagagactcttccaattattcaggtgggtcccaggacatgcagaattatagaaaccactgtaaatgtagcctattatcaactctactgtaagcaccaaagacccagtagggtaccctatttcattaagaaatgtgtctctctcatcacaggtttagaagatgagttctagctttttgttatttaataatgataattcgttgaatcaaaaccaaatcactttctggaccaactggcagctgttaatataacctgtaaattgatctttttttaaagcaaaatttccaacagctcagtgcctttaaacactggattcctgacaaatgtataaaatcatagaaagcctaagaaattcttcctttcccacagatcatctaggatctacattttctagctgtgtgctcctgagcaagatatttgacctccttgagacacagttttctagtctacaaagagagtcatgaattttctgtggggactaaaggatttggcacatagagggtatccagtgagttcccaagtcctggagatgctcacacatggtagctgtctttggtagcagtgctcatagtagctgtgcatatcagttgttcaccagtgaattctaaggctaagttagtcatttactgacattttatcctgtcttccaataacccccacccccataaagttagggatattattccactaattttattatggtaatttattatgggattattttattatggtaattaattattattttattatggtaattaattattgtagaaaattattatgggattattttattatggtaatttattatgggatccatggcatgaagtcttaagaacataaaaaagaatgtgagaataaaaacattttgaccattaccagttttcatactacttgccgtgagtatagatgtgattataatttttaatgctctttgccatataatcacaattaaaagtataagaagcacatttattacttatttttataatttttcatggatacaatatcacttctatgcataagtggtaaaacctcaaggaaagaaagttcctggaaatacattattttggttacctatagatttgttcaagaaaagtacaccactacaaagaaatatattttgcattttaaatttgtgtatatcgttggtgtcatatttttccattaaaatgacactttagcaaaactttatactgctttgttgtttttacgataacattaattaattaccatcatatttatggtaaatttaattttgtagtttacactccaagaaaaagtgactcctaaagtctaaataatttgatattttaaaaatgtatgatatgcataagaaactttcataaaataataaaagtatatacaaattcgataaatcagatgaaaatggatatttaaaggaaaaattttcagcctttccttgtatttcagctatagactatccgtaggctctttcagtttctcaatggcccttactctagtatccccttggcagacactgaagacaaactttgctggaagataaattaagcagtttttagaaaagcagttcttttgtttgtttatttgtttgttttttaaaaggagaacctagagccaggagaataaaatattagcataggctgatagagtacctgtttatagcataattttaggttgtgttcaaatcaaaatattcagaaatttaacaaaatcatctatgagtagcctaaattcccatgtcatctcctccttgtatttttattctgatataaatgcaattatatgtaccattaaaaatatagggtacatagtaaacaattaattactattctatttgtgaaaaggtcacttaagctttagactgatttactctacgttttagaataacctcagacagctttataacaaagcaaaaaagacaaaagattacttaaatgaaatatgttttgtatgtttggagatagcatataaactgtaaaataaaagtgattcttaaatgttataatgctatagtcttaagatacttgaaatgatgtttttgttgtcttttaaacttctgaatcttaaaaaaggcataaatatttcacctcaaaccattttttaaacttaacacaaaaccggcacacagtaaatcattaaatcaaaaaaactaactaaatttttctagattaatagtaacattaaaattttgccaggggtgctattaattttgaaaattcctcaaaactattttagttctaaagtcagtatgcattacttacaatgggataatagtattttaagtgttaccctgatgtatctgtaaagaactaaaacagcgttacaccttgagtcaagaactccaagttcctgtcacgttctggactcacctatatgacacagcaggcatgtggacttgtataagctatggcttctttgaatttcagtgtcttcatgctcaaaattggaatgatgatgatgacattaatattttaatggcatatgatgggccagacatgatgctaaagcctttatgttaattatccctacagcttgtagagttgttatagggattaaatgatagaatgcctaacagggtacttaacaaatcagaaaacattctgttactgaacttaggcgtccatgttaccatgtggggtatattattatttaacaagcctattaagactattagaaagttttcctgatcacaggtctctcttctctttgcagcctgtcgctgtaatgccggtggctctttctctgaggtttgccacagtcaaactggacagtgtgagtgcagagccaacgttcagggtcagagatgtgacaaatgcaaggtaaggagtagaggctgacccataaattactttctccttacagattttcactggcttttcatgacatgttttgtataccttcgtatattaaaaggaaggtttgggattatctaattctacaattgaaatgactgtgatcagtgaaaagtttttttcaaactagaacaaaattcattgtacattaccatttgaccttaaacatttttttttggcagtgaatgtgtattatattcgctttaattcagacatttctgaaacaaatagcaggcgaatttaatcttaatctgtggagatactctttcctttgcctttacatttttggcagaataaaatgttactcttggggctgggcgcggtggctcatgcctgtaatcccagcactttgggaggccaaggcaggtggatcacgaggtcaggagttcaagaacagcctggccaagatggtgaaacaccatctctgctaaaaactacaaaaatcagccaggcacggtggcaggtgcctgtaatcccagctactcaggaggctgaggcgggagaatcgcttgaacctgggtggcagaggttgcagtgagccgagatagtgccactgcactccagcctgggcgaccgagtgagactccatctcaaaaaacaaaacaaaccaaaatgttactccctttgctttttagcaaacaccttcttctagttccatcatttaaaagctacttcctgtgagcagtctacctaatggaagtttcagtagagaagttaatcaagatatttttaaagatgcattattttgctaaaacaaaatattcaattaaaatacagcatgttgttctcagtccctgaacataccgattgccctgctttcagtatggcaagcaacttcagattcctccatgagggtggacagatttgctctagcgctttcacaaaaatacattgtatttgtgataaagacagctaagcagaagcaagcatttctccgatgtcaaactggccttactgtaggaagtttgaaaatatcatctgcttctgtctcttgaataatatcattgctctgttttgtttttattttattttatggttggtttttaaagcccaatatgtggcgggatccagagaagcgattctgtgtgctatgtgactgcgatcccgttggctctgtgtcaccgcaatgtgatattacaggaagatgtgtctgtaaatcaggcttcgtagggaaacagtgcaacctcggcaggcaggtgcaccaacaggaggagcagccgcggagagcgcaacgggtgctgggttctcctcagaggtgggctatcggcagctccagcgggtgccctcggggagcctatcgggccccagctccggtaatcccagaggcgctgcatggctcatgcctctgcatgttgtgttctgtgtgctgtggctgaagttccctggtggcattttaccaaataacagttgctaagtgtgcaaattgcaaatgcaaagattagacaattcctaattgaacccttgcccttttaaaaataaccatccgtatgctttaaaaagcatattcaagttcatagggtcataaaactttcaattaaccaaactttcaattaaccatgaatatgtggaaatcaaataaaaatctacttgagagaacctataatcttagaaatggaagagacttcaggcaacctttggggaaagctaactttaataaatgaacaaatgaaggaaaatctagcagagaaattgatttgtccaagaaaactcagcccatttatcaggcatttcatcataattaagaattttgttaatttccacatcaattgtgcttatgtgtacaacaaacgcaagaaacacattttcacacactataaatggacaaatacccaaaacggggaaagttgtttctaattacaaaagtgtggttctcatatcacaggacaaaacaaaacaaatgctggggaagaaggaagagagggagggagggaagaagaggtcccagggagctgcagaagagtaggagacaagacttaccagtatagagtcaggacctgtagagaattgaggatagggcatagaagaaggagagatggaaataaaaagtaaagaagaagaagtaaaaaacaattcatggttttatttcttggctcattatcacacattttttaaaaaacaaattttgatgtcagactgccttagatcaaatcctggcctcattacttcctagctataaattccttgaatctttctgtaattcagcttcttcatctgtagtaagatccacttcagagggtttatgtctgcttacgtactccaagaagcaaatgccaagaggtttcctgggggaaaggccaacgaagcatgaagtgggagacagcatagccttctgctgcaatggggttctgactcccgggaaaacacagaaagaaagactgggtaggaaaagccttgtttggtgcattttgtcaaatcttaaattcttggccaagccaatgggatatacccaagcaaattttacccactaaaggaatcctgaattggtcagggaggttctagtatcttacagtaatcagcctgagagaaggatactcttgtggaagctcatcttaattcattcagagtgctataagagcataacatagactaagtggcatgtaaacaatggaaattcatttctcacgattctagaggctgggaagtacaagatccaggtgctggcagatttcctatctagtgagggccctctttctctagacagtcatttacccactggaacctcacttgggggaggaaactctctgaggcctcttttataagtgcagtgatcccattcatgagagctccattctcatgacctaatcacctcccaaaggccccacctcctgtctataccaccaccttgagggttaagatttctacatatgaattttgggggacataaacattcagtccattacagagcacctctgatgggtccaaaagacaagaaactggaggctttcagtcagtaaaattccacactgtaggttgtcttgcaggtagatcggatgaggcgcctccaaggctgtctcagggtagcagtgagaacagtgcatcaggcaggagcatagagagtttttagtaaatgttaggcctgattactattattattaccaatgttgttaaatgaagaaatgtttaaaataattttttttcaaaaacaaatgcatacatttacaataaaagaaaaagataataactgattaaaatgtctccaaaatataaatttagcagaaagtcaacgttcattcaagccctacatatcttacagtactattgtatgaagcagggttttgtcccgagactattttttcctctgcagcagtatgtgtgagagctgagagctcagactctggagccaacctagctgatctggaatcttgactccacaattggttagctcatgaccttaggcaacttacttaacctttctgtgcctcagtttcaccactcaataaaaaagtggtgagaatgacaactgtctgccagggttgtcctgaggagtaaatgagtacatatttgtaaagagtttagatttgtaaagggtttagaattttagaattgtgctttgcaaaaaggaagcacaatatatgaatgctagttcttattaccccgagagagacacatttatgggaacctatccagtttctcactgggtctggatagccactctctcccatatttattttacctcattaatctcaattactgaccatgaatgtctgctccttaagtttgtttactagtggggttttctttagcctttgaaacaaatttttgaacaaatttgtaaacattttattactgaaatttggtagtatttattttgctacaacttagcctttaaagctacattatttaaatatttgaaaagtgaggtagaaccgtttcttcttgtatatttccttacataatcgactttggaatttttaaaatgatagctataatttggaatctcatttgatatttgattgatttaaaggggtgtacacacacccctttaatgagtaaatcaatatgagagtgtggatatatagatgtaaatatatatgagtaaatgtatatatatatgagtgtgtatatatatatgtgtttatacatatatcggcatagatatatgagtgaagacaatttctgaaataaagatgaatacaaagtattatttctatgactcagatatttttcaataccgttttaatatattatgtttagtctttttgtctatgtatttctgtttctgtttgtgtgtctggtggtatgggtatgtaattgaaatttacatagtatttatatagtttcatatttttgtttaatttctatttcatgctatatcctaagcatatttatatcattaaaactgcttcaaaacaggattttaattcttgcatattatttcataatgtggatgtcatcatttaatttattcaacaatttttataacattgtacagttaagtgcctgcatagttattcaccatgataaataatattgtaataggcatgcttttgctttaataatattccaatttctgattatttctctaagccaggtatctaaaattttacatgaatttcttttactaataatgatattatatggttagttttttttatataggtgaatttaatttcaaagtcatgtcatctgttggaactgttacatgcttttttctttaatcatataccacaatctgaattagaactagaaataaaaataaaaccaacagtaaatgtaaagatgagaatgatcgtcaaactcagtcaacccattttacattttaaaaataaaactattcttagctacggtcattttaaaaatctaattttcagtgtgatttcacttttataacttatttttaaaactactaacaataatatctaaaatatataatgaggcttattaatttctctttgggtggctcacgttaagtggcaagatttttttttaccaagaagcaattattaagtctaattttccaaaataagaattatttttacaaagaagtaattaccgagaataattttccagattaaaatatcataataatgtgacatgctttatatttttaaaaaataaccctgaagtattttaagcaggatagatgattttcatttttctgctcggagtgattttttaatccatcagcattttctaacgtttcattttaagcctgataacatgcatttcaagaaagtcagccgaagctggtaatgcaaacttgaccgtaaaagatgatttgttatagatagataagagatatgcatatgaataactcatcagagaatgaaagtttacttacctgatctggtgctttaatacgtgttctcactaatcaatttcaattgttagaatgaaacctaagaaatcaaatgtttgttgaaccaattatttgatcagtgtaagcataacctgaaaattatatttataatgtgaacactatagcaatgattaaaagtatttatggatatgtgacaaaattctatcaaatattagggcaaaaaggattattttaactttaggctgctggtcaataatgttgaaagtatttttaccaagtaggagtccatagatctgaaagtaatcaattcagattactaaaaatgaagaagtaaaattttaaattaagactagaaataccacctataggtcctttccatattgctattgaaatcttgagaagtactgggacaggctggtgaaaatacaacagacagtaaaggaagcgcctaattctgcagttaattttgataaaatttcagaataattgaacttttctctttggatatcatagaaaaggtccatttgattgaatgaaaacccaattgtcataacatcagtgaggaatcctgataactcctaagttcctctgttcccacctgatctttggtattgtgcatcttgcttcacttcgagttaactgatttaaatttaatttttctctcctcttccattgccaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacaggtctgtaaatatgacttaagtcctacatattcactctgatagttttagggtctgacttctgtaacagtttgttcttttaaaggaagcacagattgatacaacgtatttaacataatgagtaatgtctacttatttttacgttacttaaaaaatgaaatacatgtcagtttgaaacactgccttaataactgtgtgcaagtactcagtaaaaatcagcagatgctcgtttggttgtgtccctccctgtctgtgactttgattcagccagtcactcaaacactgctacggcttgaaagttaaatgttcgatttttctggtaccagtcttatcttagtttaagctcaaaccccacgccaatgcatttcaactttccctttttcctattgcaaaattggtatccggatcaagaaaagtcaaggtgttttttttttcctggtaccccaaaaacatcttttcatctacttttggctgccttgaaaactatgatgttctaagagagaaataggttggctctagatatttagttcatcaaaaaatgcaggcagaggtttctaaccatgattccctcaagcagtattcttatacatccagccacagccttcacccaaatcatgagctaagaaaatatcacttagcattctgcagatgaaagtaaagagtgaacattagccttgatttatatgctgctaatttcgaactgacccttattccaacaatcactagtttgaatattacctttgcttactaatgtcatggattcaacctggataatgctcacatactctcagcaccatggtaagattttaaaacattgttattcactgttgtggcaaatttaagtaggaagcagtaggaataatatttaaaactatttaaagaaccaatatctttcagacattctccagcactttagatatgtggattttaccataaattaagccatgataagttattctaattgataagttttattataagttattctaaatgataagtttataattgtagatcctctaagaatctgtatatctctaagccaatatctgtataacttaaaaattataaagctgtattttaaaatatactctgttctttaaatccaaaactcactgacatttttacttaatatgaattaatgaggtagtattatacatttaaatacatatagtaacaaattataaatgagaccaagaatattattttaaattatagaaagatgacagcatttaataaatgcagacctactagcattctggcccaaagcaacaccatagaaaaaaaaaagcacaaaacaggaagaatagtaatatgactgaggacatgacttgcacaaaatagcctggatttgtctaaatggctccttcagtaactagttctgggaccttgactgagtaattttgtttcattttccatctgcaaaattcatctattaaattaagataataatagtatctaccacacatggtttttgttacaattagttgagttagtggctataaaatatttagagtaatgcctagcatgtaagtgctatggaagcatttatcattattattattatctttattagttttattaattgtgttatacattgtgctttggcacaggaaaactagctaattactcaggttttctttctatttagtgttatgattccgctgaagaactacttaagataatttctatttgcaagtaatgatttgcactgtcccatgacattttttagcatataaatttaaacataatggtaactatttttcttcttaatgaaggacacatctaaaataaatcatttggcttaaaattagcaacaacagtaataaccaaaacagcaatgactaacatttatttagtgtttactcggtgtaaagtatttttctaaacaccttccacagctggtgtgtaatgctgtgagcaatgaatattgtcatttcataaaaagtgaatttagtcaaatattctaaatatattcagtgaaaatgatttagtcatcatataaccaattaaaagtttactcataacattagtcttccatttgaattcaagtatttgggtttcttccctcacttacatttctttgacatgaaacgctgcactagaaatattcttagtagctgggtcaactgccgctatgtggcatgcattccttgtcttggatggctttgaagatattctcaaacattatttttgcaatctttgaaaaagtacaaaaggtagataactttgtactctttgaatattgcatgatagcaacaaaaatgaaaaatctatagaaaaaagtcaggtggtaaataaaaatcgaaagtatctttatatataaacagtgtccataattcaaccattttaaagtatttgcaaaattggattattctgttgtgtgcgtttctaactatatacatgatgtaccgaatttaagaagcttattaagcttattggtttttactgcagatcgggctcatcaaggaaaaactaatccgtacagcataaacaaattagaaatgaacttaaaataaatatacaaacaaaatagtaaactttgtagtacccgaatataaggtgttacagttaacatggaatctgataacaccaattctttcctttcttaaacttcataggaaagctaaaaatactttaacttttgaaattaataaatgaaatacatcttatatttattgaacagctcctttctgaaatacattgtactataatataaaagatgaatgaagtaagtttttatttccaaatatccttaagtgtagaactgaaaagaaaataagacaaaccaacacaatataaaactcaacactttgtgtcaaatttttactatttttccccttctttgttttccctcttataccggtgaagcttgtgaatgttctcatctgggtaataattgtgacccaaagactgggcgatgcatttgccctcccaataccattggagagaaatgttctaaatgtgcacccaatacctggggccacagcattaccactggttgtaaggtgagtgaaccacttttttgctctgataattttttggggagatttttgttttgtagagctctgtaattgggcatttcaaaattcaatattacatcacaaaataatgtagaagtattactataatgtgattacagatattaatcaatatcttacagtttacttgtaggaaagatgatgaagtaaatatacatttatgcagctgaacacttgaaatctacaagaggggtaaaaagaacaaagattctgtaataataccagaaaagagctataacctcatacctaggcacaaggacatacatgtgcaaagtatgaggatatgaggaactaattaattttccaaaaatctatagaaattgcccctgaattatgactaggttttaggtttcaggaagtagttgagatcattctgaagagtcattttaacaacatttagcttggaaaataatcattttttcccattggtagaccatagaaattgacatggccagagtcatgttcagagagatctatctagcatcagcagggatggtaacaatttataaggctgttgaagaaatattaataagagatgccaaaagcctggacccagtcaatgagcgtcagtgaagatatatagggcgcgagttacattttagaactcaggctgatacagcctggtgaattcattgatttggggaataagaaagagaagacttaggatgactcctaggttttgctttgcaatggagtagatgataataagtaccatgtgcagctataggaattataggaggaggagcaagttcaggaaggaaagataatcactttgcatttttatcagctttttgtgaggtattaataaaataaaattcacccatttatagtaatgaattttaaccaatgattacagtggtgtaatcatcccttgtgccccattgcagtgaagtccccatcaccccccatgtgcctactgttttgccttctagcattataattttccaatttctacaacttcttaaaaatagaatcgtagtctgtttttttgagggggggtttgtttgtttctttgtttggcttccttcacttggtgttacgtttttgtaattcatccatattgttgcatgtatcagcagtttgttctaaaaattgcttaataatattccatttgtgtaatgtacagtgacttgcttacctgtttaccatttaatgggtgtttgggtcatttctagtttggggttacaattttgctgtgaacattagcatacaagtcaaaagcatatttatggacaaatgttttctcttttttttcttaagaacactccacatctttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacatatgttaaagcttgcttttcatatagattgctttttacctagtttcatcatctaatttttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatcctttttcccattgaattactttgactcctttgtcaaaatctatcaactatatatatgtttatgcatttctggactcttttctgcttcaccgatctattcttatgttaatactagttaatatgttaattattgtagctttccagcaagtcataaaatcaggtattgtaaattcctcaacctcattcatcgtttccaataccttttgagtactttagctcctttacatttccacataacttttaaatttagcatgtcaattctttaccaaaaagcctgctaggatttggctgaaattatattgaattgatagatcaatttgggaagaattgacatcttaaaagtattagatatcccagtgtatgaacatggcataactctgcatttttttaggttgttataattttttctcagaaatgtttgtagtttttgatgtgcaagctttgcatatatattgttaaatgtatccgtttcatattttttatcaaaagcaaatgctgtgttccatttcagttttaaattgcttgttactagaatagaaaaatacaattatttttataccttatccttctatactgtaatcttgctaaacttattagttctagtttctttttggtccatttagtgagattttcttgtagataatcatgtcatctgcaaagagagatttacttcctttctaatctgtgtaacttctgtggcattttcttgtcctattgtagtaaactattgactagaagtggtggaagcaaatatccttgccttgttccttagtttaagtggaaagcattgtcttttataattgaaaatgatgttggctatattttacctgtaggtgctttttattgttttgaggatgccccctcgtgtttttagtttgctaagagcttttatcaagaatatgtgttcaattttgttaaatgacttttctgcatctattgagatgaccatatgatatttctttttaagctgttaatatgacagattatactgattgattttcaacatatcaatccagtcttacaatcctcagattaatcctgcttggccatgggggattatccttttaaaattatgttgaatcctgtttgctagcattttcttaatgattttggatctacgtttataagaaatattggtatgaacttatttttcttgtagcgttgtcgtcgggatgaggtactgcaagcttcatgaaatggattcagaagtattccctcctcataatttataaaagcgttttcacaatcaatgaggtagaaaacagaaatactttagaggaacccaaaagctcactatttgaaaagatcagtaaagttggtaatattctagaaaggttaatcaagaaaaaagagagaagaaacaagcaatcaaaatcacaaataaaagggggacatcactatagatcctatagacattaagataataatatggtagtaataggaacaagttttgcctaataaatgtgataacttgcatgaaaagaacattccttcttttgcttactttgagtttaattttctcttgtgttccaagtttttttgttttttgttttttgtttttgagacggagtcttgctctgacccccaggctcgagtgcagtggcagatcttggctcactgccagctccgcctcccgggttcacgccattctcctgcctcagcctcctgagtagctgggactacaggtgcccgccactacgcccggctaattttttgtatttttagtagagacggggtttcaccgcgttagccaggatggtctcgatctcctgacctcgtgatccgccagcctcagcctcccaaaatgctaggattacaggcgtgagccaccgtgcccggccaattgtgttccaagtttcttaaggtgaaaccttagatcattgatttgtaatcctttttctctaatatgggcatttgatacatttttttccagaaactactttgtttgcactccacatattttgatatgctgtgttttaattttcacttggtttaatataatctttaatttattttggggataatgtttagtttctaaatatttggggaattttcaaggtatcgttactgttactagtatctagtttaattctaaattgttctgagaacataatctgcattatttcagaccttttgaaaattattgagatttgttttatggcccggaatagtgttcagtttgtttattataacatgtgcacttgaaaataatgtgtattctggagttgttggatgaaaacttctatataggtcaattatccttaacggtttttagatctacatgttctctcagttactgagagtgttggactataactttgtccgtttcttctttcacttctctcaggttttattcacatgtatttttgagcagtgatactaggtgcatgaacatttaggattgctatgtctttttgaaaagttggtgccttttgacattgtgaaatgtctctctttattcctagtaacattccttgttcagaagtgtactttttctgatatttatatagctattgcaactttctttttaatggtgtttgtgtggtatatatttttcacaccatcatctatttcatctccctttttagtattttaatgtgtgccttttttttttttattctgagacagggtcttactccattgcccaggctagagtgcagtggtgtgatctcagctcactgcaccctccaccttctgggctcaagaaatcctctcacctcagcctccagagtagctgggactacaggcgcatgccaccatgcttggctaatttttaagttttttgtagaaatgagatctcactatattgcccatgcttgtctcaaagtcctgtgctcaagtgatcctgcaaaattctgggattacaggtgtataccaccatgcctagcttaatgtgtgtgtgtgtgagagagagacagagagagagagtgtgtgtgtgtgtaaataacatatattcagatctttatttttcaacgaatcttaataatttggccttttaatttgaggagttaaatcatttccacttaatgtaaatattggtatgattggattaagcctgcactttgctatttgcttttgcttgccttatctgctcttgccttttttttttccttattgtcctgccttcttttgcattaatttgtataacatcttctcttgacttttggattattaaatatacctattcattttatttctttggttttgtctaggaatatacatctttaactttccagaatgtacattaaaataatattataccactttacatttagcgtaagaaccttacaacaggaaacctccagtcccctttcctatcctttgtactatattgtcatatatttttacttctatatattatacatctgacaatataagcttacgattttgatttcaatagtcaattatctttttaaacaagaaaatttctcctataactctttttccttgtgtatatcaattttaatgctttaaattcctttgtgtacattaaaattttcatttcatatcatttttcttcttccattaactacttcctaatctttatcattttattcctgttgtttcaggtctgctgacaataattttttcctttttttttttttttttttgttccagaaaggttttttttttttttccgaagaatgtttttgcagagtatgtaatcctaaatactggtttgcagcaatttaattatgctttttgttttctttttgtgtgtttaataattattttttcatgggattagttagatctgttggccctgtaggattatagttttcatcaaatttggaaatgaaagttgtcagccattatatctttaaatatttttttgttcttcattcttattgtctctttctggaaatcattttttgtatgttgggccaattgatattttcccccatctcactgaggttcttatttttttaattatttttgtatctgtattttttatttctgatagtttctattgttaagtgtccaaagtcactgattttttaatgcagcctaacctgtttttaatccaattgagtctattttttattttaaacattgtatttttttatcttttaaatttccttttggacattgtatatcttttatttctctactatactcacattttttcatttattcttgaaaatataatgtttataaacattagcatttttaaaatggtcatctgcaaattccatcttttttattgcaggactattcctactgactgacttttctcctgtttctgagtcatattttcttgattctttacatgcctgataatttttatttggatgccagacattatatacttttcattgttgtgtattggattttattgtatttctttaaagaatgttgaactttatgctggcaaacagtttaggtagtcacgggtcacttggattcttttgaagcttgcttttgagttttgttagggaaggtgcagcagaacagtctgaaagcccttctactaagctgtgaaacttctgagaatactacctagttggttactatgtctctttactctggctgttgaaaatatggcttattccaagctttctctgggctgtaagaatttttgcagcctagggttttccaatgccattttccttcatcccatgcatgcacctatcagcattcagtcaatgactcaagagaacgcttctgcacatctctggaattacctttctatctaacttctttctttttgaacacgtattctatttgccatcataagtttcagcagcctcggcttcctcaaactccactctttgtctctcaactcagctataatgcgggctttgggtttaccctctctgtgttgcagcctagaaattgcctctgtacactgcttcatgtttttttccttctctcagaaatcacagtcctgtgcttcctataattcaatatctaaaaacaattgtttcttggtttgtatttttattttagttggttgtgtactttaacagcttaacaaagaagaataaatactgtaaaaactaagaagaggctgttcaaaagaagaatattcttcagtgcctaatgcaacacaaaggtcaagtaggattagtgctgaagttgttcattaaattgaagagcaataataagggcatttttttatgttagtgggagtcgttccaattgattccactgggttgtgaaatattggaacgtgatgaccaagtgtggtcctgtttgaccctatagcagtaccctatagagatgtaaactttttttcctgctgagttagcacagatgaaataatagactctaaccaccttcacatgtatgataaaacatttgaacctggtctagaatatgctgacctagaggaaaacaagcatattgatgattcttcaaggaagttcagatgtctgacttcaattagacatgtgattagaaaaaataaaaactggacaggacattcatttttctattgtcaatagcattattaagtttaaaatgcaagagagctacatttttagaaagaaatcaaaaactcctcagaatttcaaagtgttcttatgaatatgaacaatgctataagtgtctatgactgacttttgcattttcagcttcaaatccaagcatccaccatatcacttggactcaggagtaagccctagggaaacttacaagagttccgttttatccacagaatgctatgatatagccaaactctaattaaactcttgaaattgaagttgatacctcatgttcaagatataaatcaggataaaatacattccaagtttctatgaaaacgtagttatatgtttagtactatcatttttactgatcattagataattactctgttgactaaagttgactgaattttttgattactttaaaatcaccatcaaaagtctagacttctgaatcgagaaatacttcaccattatgaagaattacaaaaaaaaacaaaactcatagagcctgtatcagacaattcttgcattgctataaagaaatacctgagactgattaatttataagaaaactggtttaatgggctcacagttctggagggtgtacaggaagcatagcggcatctgtttctggtgaaggcctcaggaagcttccagtcatgatggaaggccaagcaaggacagacttccacatggcaggatcaggagaaaagcagggatgccatgcatttaaacaaccagatcttgccggtaggaactcatggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttgtgtcatggataatttctctgtgctaaggtgtgagcatacacatcatttgggctgttactgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttggttttatacaattatttggataacttcatattttagttaaagataaagatgcctcacaggataatttaaatttattatttgattatagttttgataacatgattttctattaatacccgattatggcctattttgtttaagtgagttaatacatactcaaagcagttggcaaagaaaaactatgtaagtgaatatgtaagacctcccaattttgaaatttgattttacatctgagttttttaagttacttggcggggagggtaatgggttattttaagccttggaagctttgtccctatttataatataccaaaaatccccttttagatctttgggtttaaaaattttttaaaaaccccccctattgcagccttttttctgattagccataattagataaaaaaaaactttcctataaaaaccaaaaaaaaaggtaatcccgaaaaaccattttttttttttttttttttttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgataatcattttaataacagaatctgggaagatttttaaccaaatatttgggcatgaaagacaatagaggaggaactggtgatcttggaaatgataatctcataagcaaactactgttagcaggaacagaaacataatactcctggtaatggtggatataagaattaagctgaggagggaaagtgtgagatacacagtgagatgcagccagacttggatctaggagtttggccaggtgctatgcatatgactttaccactgggctgtagatctgagaaggataatagaacagcaccaaaaagagttaagtcacaaagtgcatacaccatatggtggcaaactcagacagagagaggtgataccctttgtaatgccaagtcatgctctgcttgggagacagaaactacactggttttttaaacagtgaaatggaattgttaactggtaaaaggtggttggttactaaaaaaggataaaagaaagctataaggtgtcccgagtacaggtacagaagagcagctactccctctaggctgagggaggaaagacagtgaaggagttaagggctaagagagggcatgctccttctccccacttgcagcaaagctgaggttcagaaatctttcaagagggcgttgctgtcataggaatgtacagcctatggatggtcaaacaaaaccaaaaacaaacacgtcggagtttgtaggcaaatgcatgtctgtagaagctgcccaccgttcttggaggataggagcacgctgggctactgagaagccgacttcaaggtcagagcgtgtgtgcagaccaaagcaagtcagaagggtgcctatggagagacaatgtgccctcccaactaaaggcacacctgggattctttctgggccactgggctcccgtgctaaataatacaaaaataatgatgaagattctttttttttttttagacagagccttgctctgtcgcctaggctggagtgcagtggcgcgatctcggctcactgcaagctgcacctcctgggttcacgccattctcctgcctcagcctcaggagtagctgggactacaggcgtccgccaccacgcccggctaattttttgtgtttttaatagagacagggtttcaccatgttagccaggacggtctcaatctcctgaccttgtgatccgccctcctcggcctcccaaagtgctgggattacaggcatgagccaccgcgcccggcctaatgaagaaccagaactcagcttggaagtgtggtgggccgccattatggacttattgggtccttccaaggcctctattgactaagcctatcattctgccaccggatacggagaaatgtctacggggtctacctactgtatcacaaagcagggtgaatttggagctcagaaacagtagatgtataattggcacagctggtccctgaaatgacttattccaagatcctaaatgacattttagaaattcacttggcatttttattaaattgcaagaagatatgagctctgtaaatcaagagcagaaacctttaaaaggataatgtaagacaaaaagacaaatggataagcagaaattaaagatgagagaaataaaattattcaaaagaagttaagattgcaatagggtaatgaaaataagcattggtggtatgtgtatacaataaaacttttcctgtaaaacaggagctgtgaaagtaggataccaatttgagaggtaaatacagcaagaaatgtaaaacaaaggaaaatgattgcagaagacattaggatattatagatttggcagagagaacagagtgatgtactttaagaattatagatgatcctgaaaaagaaaattgattaattagaacagatgtaaaaatcaaaaacaaatctgaagaagaaacagtactgaatcaaaacacaattatgttcccaaactgaaagaactatgttccagtaagttgatggaaaaaaaaaaacaaacccaagcttcagaaaattctagcaaaaatatgaattatgtaaataaagagaaaatcgtgtatacatcttgggcgaagaaaaacgttactaacagagacctcaaatcagaattgtatgcaagaataaatgccaaaaaacaatatactagatgttacttctcttcaagctctccttggattccccaagtctagtctgatgccctttgtatgttcacatagcattttggacttctcctattatataatgcttattctatcatgttatgctaacatatttacttgtctccctctactagaccgtaaggtatgtctccaaataaatgtttaaatgctacaattatgagataataaggtaaaataactttgtctaaaatttaatctttgagacaaagcagttggaaaaaacccatacccagcccctctctacctcagaaagagagaagacacattttctttctaattcacatagcattatggtttctggacgatcatatatttccataaatgcaggaagcaattttaatgtttatgttcactgatgtttcccaagtgactaaactagaatagtacaaagcctataacagatacatgattaatatgtgtttaatggaagcatagaaacattagaattaaaattttaagatatttcccataaagttgtgttaatggttgctgtttttatctcctctataggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtatgtgctgctgacatgcagctagggaaaacctccctcaattctgtttccattgctcagttttaacttcattcagtgtttgttatacctgcttcattaagctaaacaaacagatggacaaaatctcattgccagacatggagttttcattgatatgcatttgttggcataccgataaacactgcttttctagagcttattttcaacccaaacccacctttttttctagttggtggagatgatctattttcaatggtatagtgattttttaaaaaatatattagatttgcttcgataaggacaatctgggaggggtggcagggaagacagttcttttaagcatcatcagagaaaatcacagctaaataataaggcttataaaaaccatttctccaaaaattaatctgcaatcgctgtatactagaaaatatatttactgctgtggaagtttagtaaaatttcaacacatataaacgctgtcattacaaacagtgactatgtgcaaatttcagccctcattaatatggttaaatgatgtagaaaaagagccaattaaaaaggtaaaaaggatttttcccctcagatagttctgaaaaatcaattccaggataaatgcagtttaaactgtgtcagaggtatcttttcaagataaaatctgtgcaaaaagggacagaggaaacaggaagataaaatctgggtagtggttgttaaaatggccttgagaattgaggaaaatggcagtttctaccatcaagggcttcggccaataccgagtacaatgctgcattcttatatctcgcaattatgatcatatatttaatacatgttatgtgtgtatatatattacaataattatataaattgatattttaacctgctgcctatttcttacagcttacaatagcaccactgtttaagactcaatgtttttatgttgcttttgaaattttcatgagtctttcatattgctcagagcagaactgtagaaaatgtaccacttacatttaagaaacaatgtacaggccgggcgtggtggctcacgcctgtaatcccaccactttgggaggccgaggcgggcggatcacgaggtcaggagatcgagacaatcctggctaacacggtgaaaccccgtctctactaaaaatacaaaaattagctgggcgcggtggcgggcgcctgtagtcccatctactcggaaggctgaggccggagaatggtgtgaacctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgagatgtgagtctaatactcagtgttcttctgttttgttttaaattttttaaaaagagtatgctcccgttatgcattctcagggtgatttctcccctaactttgccgttataaactctgagggtctcttgtctttcctcaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgagtagggaactgctgagccatgtaatggtataatgttagttcctgctggtgtcttttagtcaggcactgaggggtagtagaaaatggcaaaacatttaagtaaccttttcctctgtgaacatttaggaacagcaaaggggtcacgtgccattagagagttggagtaaatgcctttcttatttgttcttaaaagtagttcacttattgataaggaaatagatgccaagtgaaaaagaggaaccttgtccgggaagcattatgttttgagatgggaagagtgagggcaccagagcatgaatgttgatatgagctaacacaccaatgagaaccaggacttgtcacacattcattccaaccaaccttaggcaatcatgatttttggagtgaaaacatgttcatttttcattttcctttaactctttctacatttagattcaatttgtgttagtgtgaaaggctccagtgtccacagatattgtggctttcactatgtgaattagtcaaaaagatttacgtcctgccatgcttgcccactgcgtgtgagttctgttgcttgtgagaacatcatcagaatgggtataggaactgcagatagacatgcagttcgtaacttagttttaaagaaatgtccaaagcgtaaattcagccttctgctgtattttgaccccttgcaggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaaggtaagcacaagaactttaatgtcaagtgagaacaagataaaatctttttagaatcacaccatttggagatttatccaattcctcattcttctttttattttgtcagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagaggtaaagttagtcattgtttggtgcaaagataccaatcaatggttttgcattcagttttgtcatagtgatttctcttcttgttaacagaaagaatggaaatattatggggatgatcctcgagtccatagaactgtgacccgagaagacttcttggatatactatatgatattcattacattcttatcaaagctacttatggaaatttcatgcgacaaagcaggtaaactctaatagaaaatattcaagctcttattttagagtctgtaaggaaggttattgacctacagatatcagataagaaagattggaaagtgattggttttgcagtataatgatagaagataaaccatggaggcttccctgtgacctggaagaagctactaccattcatcagaaaagaaaaatagcatgagaaacacgttaaagggaaaaaaaaatatggaattcactgcagacatagtgagtttaagatgccagtcataaattcaagagatcatatactgtagatcaggtaaaattaactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctgtgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaattgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaatataattgtaaaaagaaggaataacatattgtcaaaagtaaaaagatgattgtttaatttgaaagagtatgtttacagaacatgggaatggattagtaatgaggaaaatattgaaatataaaataaagagagaataactaatagaggaaccaggagacttccacatcatggaccctcatggtcatattctttgagtagacggttcaccttatccaatgggataaaatgagaaatcatacagatttaggtaagtttcataccatggaggcagaaagttgaactgagttcatataggagacctcaatttctctttcatgtcagtctctgttacattctatgagaatatagaatcgatatatgtttgtaaatagtcttatataataaattattagacctgcctaggaaagcaaaacagaaaaattatgaagtctctcaatggccaactaatgaatataaaaatactatttttcaaatgtttatactggaataagcacacaagacagcagaaaatcttttatttcatgcagaagatccataatgcttttctgattgatgtagagacttttagtaaaagagtaaattaaggaccaaaattcacttttatatatgtattccttgggtttccttttgatatttctcactataacaggagattatttttatatgaaataataaaaaaaatatacttaaaaaacgctgttatctatactgttaattattttagaatatcacatgtaaattaggtggcagaagccatagcagatttgcatgtcttagaaaatagcaggtaatttcgtgagtttgcaaatagattattttgcaaatggttctgtactgcagtaaaagagtttggtagtaaacagaacatcttgttagtggaactgatagaaacaatattgtcattcatctttaattatactttctttgcttctctcacaccaatttcaccttcctacactgtgacactttgtcttttttttttttcccgccctatgtctttttcttttgtcacactgttttacatacctcaccaaatgagatcttttggtttaagtgaccgtttttttgaaactttagaatacatttttcctaatctcagtaaaaactggggtcatagtctcacaatgctaagaacaaataaagctgtcatcagcatttgattttgtaaggcagtggaattgtggcaaaggtttttaaaaggtttgaatagtccccctaaagtaattaaaataaccttgtatctttatttattcaattataaatttaaatctcaaaagcagagagtttaagagtttatattctgtttgaggtatgaactttgtacattgtatcagtgctggcattatcttttttctttgcttttgtttccttttataaagtttaatttaaggaaatagcaacttttgcatttcagtagttatttaaatggaagctggagtttggccaaatccctgatgcaatcaaagccattgctctctaatcccctgaaaaaaaaaatggtgtattgcagaaatatttgttgttgctgccattcaagcttcacttgatttgtaaacacttgcgggtctgttatgtgcattcatgtgcaagagaaaggagaatgaagccagtagctcctcgggctataaaattccatggagatgccaatgcaaagttaccttcttactcccacagagagcccagagaacataagggagaagtttttcttgcagaaggggagtggtttgcttacagctcaccaccactgtgtgtacttacagggagcagagagtgaaacctgaattttaattgaatgtgtgtttcatcaagaccaatcttcagagtgcagattacaatgctagcaaagaacatgcattcataattcagtttcaataaaacctacctatgcttgttataaagtttatgactcaaactccttaaactcctggaggtaacttttatttgaagcaaaactattcattgtcacattttaaagtttatttcccaaacatgtttgtgttaccagttagtccatcataaaatagtcccagtttatggactacatttattttttaatgaaaagggtattaatatgttattttcaattatgattttcttttcaattataatgactatttcaccatcagaaaaggtgagttaagttacttgaaggaattatttaataaagttaagaaaatattattttgaaacattatcctcagaaagaaatcaatattattagattatgcgtgatcattattttctaggtggttttctaaagttcctgaaaggtcattcagagcattgggaagaagaaatttgggatagtagtaaattaaaagcaatttcaccagtgcctgtacgaaataattgaatggggaatgaccttgggttgtctgtttgcaagaatataaatgtctaattaattggccgtgtctacctgaagccactcacattttaaaaagtggggggaatatctttataataacttttcaacaggatatcagacatccaatatactaaacttcttatgatttatgtgaatattttgctaatatgtactcttaacatttgaggaagcaaaaatgcaatattaggatttggtacatgagccccagaaatttaaacagcttcaaaacaatgttaattatcttgatttaatcatcccacaacttatctatgtatcaaaatatcacattgtttaaataaatatagttgacccttgaacaacatggtggttaggagcatcaaccccacctcatgcagtcagaaatccacatataacttttgataccttcaaaacttaactactaatagcctcctgttgaacagaagccatactgataacatagtagattaacatatatttgtgtgggtattatatattgtattcttataataaagtgagctagagaaaagaaaatgttattaagaaagtaataagggctgggctcagtggctcatgcctgtaatcccagcacttcgggaggccaaagcaggcagatcacttgaggtcaacagttcaagaccagcctggccaacatgatgaaacccagtttctactaaaaatacaataattagctgggcgtggtgttgcacacctgtaatcccagctactcaggaggctgaggcaggagaatcacttgaacctggtaggcggaggttgtagtgagccaagattatgccactacactccagcctgggtgacagagtgagactctgtctcaaataaataaataaataaataaataaataaaaagaaaaaagaaaagaaaagaataggaagagcaaatatattaagtggaagtggatcattgtaaaggtcttcatcctcgttgtcttcattttgagcagactaaagaggaggaggaagaagaggagggattggtcctgctatctctgggtagcagacgtggaagaaaatccccgtacaagtgaacccatgcagttcaagcccatattgttcaagggtcaacttatgtacaattattatttgtcaattaaaaacaaaaagacaatagaacatacttgaggttgacaaaaacgtgagaaggatattgctgtaggattgattgtttactaggtgatcttaactgactgtcatagtaatctaagtacattctcgctgtttctaggatttctgaaatctcaatggaggtagctgaacaaggacgtggaacaacaatgactcctccagctgacttgattgaaaaatgtgattgtcccctgggctattctggcctgtcctgtgaggtaagctacctcctactaacctgcttaatctcaagtcacttcaggagctaaatggaaatactcccagaagtacctttactgcatacatattcttaatctattttatttaatcttccactcacagtgtgagacacagtggcaagaggataatgttattgatatttagtacaaatcatacctgaagggaaatagttgatcaaaaatttaaagatttgtgaaaatatttaacaatcaggaattaagaatgttttaataagcctatttattatagctgatctattttcttggaccacttctgaagagttagagacatttaaactgcaatgattaggagataggattatactgggttttgaaaatatttttatatagaacacgacaaaacttgtacactaaatagcaggctgttccctttaacataagcttctcagggaaacatatctttgttccaacagtgctgctatgagtcattacagttataaaactatcttttttttttacattttaaaagtaattttaaaactgcttttcaataaacttgctgagatattctcttgtctgccttcaagattgtcaaatttcttaggatctaatttctataattgtgaaatattaataggaacagtacgacttaagggaggtggaatgaatagatgagaaactggcctgggtttgaatctcgacttcaccatacagtaagcctgagaccctgcactgggtgctacacctctttaggctttagcaggtaaacaccaagtccctgagtaactaccactacactttcacctctcccgcagaccccacagtctgaagcctggcatgcatggggcctccaggactgctccagccctacagctgggattctttctcattagtcaggctggctggtgctcacagcataccagttagatattattaaatctccctcacctacagcctgagtcttatgaagactaaatgagctgttaatgttaaggattcatcacagcacctggtgtgtagatgatgtaagttttgatggttaatattattattaatgtaatcactagttatatacccatgtattgattcagttataaataattttatacatcttattttgtaaataggatttgagaagttgtattaagtatggtacatgagacagatgattccactaggtcaaaactgaagtgcaacttaaaaataatgagtatacatttcttgagagggacatggcatcatgaaaagaaaaaggaatttggtttcagtgaatcctacctagctgcactacttggacaggttacttgctctgtttttgctaaatcttgggtttttacctatacatcctaaggattgatttaaatggaaacgtatgtgtgaaaatccctttacaaactgacatgccattcagcttagttaccatcacatggattccatatagttcaaggaaaaagtttataaaataactgcaactgttttgtgacacatgcttaaaatgattttctactctttcctgtgacttctctgaagggcaatatttatttacatgtgtccattttgagctaataaataatcaagtaatccatctccttattaaattgtatttcctacatctatttatacacacactagtaaacttatactggtaagcactgcttatacagtaagcactgctctttccaatatacatatgtacacatagtgtatgggtgaaaactgagactgtgtggcacatatgaaatgagtgacctttccagtgagcattgaagattttaaaatggaggacagaaagaatgtgagatttttctagacaagagatggaatttcctttatcccaggtagcgtttggttttacttttaactgtgtgcacttgatcaatgctcttaattgctgtagaccttcgttattatatagctatccaatctataaaatgacagattgagttgaagttctaaaattctctgattctgcaatattattttgctatagaaaatattctgtaagtagtcaaggttgacctttagatatcttgaagagaaggttattacagctatatttttctgcatttatttgaaataatactgttcacttgtgaacaaaaatgttagtagaatagcaaattattttcatgcaaccaaccttccattctggatttaaaatgttaaaaacctttcttcatatgattgatagactttttgaatagtacattcaaatacatgctttcccattaatttgagtcattttccatcattatatgaaaatgtaaatgagcacaaataaaacaaatgataaatgaaaatcaagaaaaactaagaatatgtacaaattgtcatctgcattagtggcttcaccgtcccatgactttcacttaagcatctatttacagacagtaattgcagtaatatcttagtagagagattacagagataaagacctatctctcataataatgtacctgaagtgttttccacaacccatggcctctaatccattatacctcttatttataattcatcttgattcctaagtgtaattacccaggcataaaatcttatcatcaaagcaagagctaagggcagttttgaaataatacatcccattccagtaacatatgctttgggtcatgaatacacaaagcagttcctctacaatatttttacaaaatgtatagtattctagagacatctgcatctacaggctattttatttcatgtttttatccacaatatggttgcaagtaaacaaaattaagtatcagttactgctaaaatatagccagttgtaaagactcttagcctttgcttgttacctgcactgttatgacagtgcaggcctggtcattaaaaatgttagttttagaaatgcctaattattataatttactatttgcagaaggggccagattaccttcaggagtcaaacaaaggacaccatttcctcaccagatttcttggtgttggagccattgagtttgttatactttatttaacctgtctttgagtgacattaaatataggttattgcccaaactgacctaaactgagctttatgcagttgaaaggttatatgcaggtaccattcttacttatgactttctttcttaaatatggaaaatattcagccttgcgtgtgcagctctctgcagtaatacggaaatcagaaatttgtcaatgatctctaggtcatgttttgatagtttcagcttctatcctgtcttcccatattttaaaagggctttaggcttgcagttgaatggccggtgtctattggatcgccactcagaagctgtcccttgtggctattaaaactgatttttttaaatctccaaataatttatacctatcgtcaacacataaagcccaaaaggcaaaatgtgaaaatagtcttagctacttacatatgcacacatctatcctttatcacttctgttgcacaccagagacccaaagtctctgttttcatgtacagacaagtgttgaggaacatggcatgggtaagttatgttataattttgtttacaaatataacctaaaacaatcatggtatctttatttttagtttatttccagcaaacatagaaaaaactatttgagatagagaaacctattgatttatgtatgacaattattaaacatgctttatctcaagtaatcctcagatccaccctatgaaaagcagaacctaccattgattgagtgcttactatctcctgtacacttcctaatacagttacaccaacatcatcgactataatttatgatccccattttacgggtgagagaattgaggcccatgatcacacacctacacagcaattcaaacctcaatgaatctgtttccaaaacctaggtaaacttgtactcaactattatattatgcagtcatgtgctgcttaacgacagggatacgttctgagaaatgtgtcgttaggtgatctcctcattgtgcaaacatcatagagtgtacatacacaaacctaaatggtgtagcctactacacacctaggctacatgggatagcctgttgctcctaggctacagacctgcacagcatgttattggtactgaatacagtaggcaattgtaacataatggtaagtatttgcatatctaaacatatttatacatagcaaaggtacattaaaaatatagttttataatcttatgggaccactgtcgtacacatggtcctatcattgaccaaaatgtcattatgcagcagcacatgactgtacaatattcctacattccaggtgaggaaaccaaggcacacagtattcagaaccttactacatacaaagtggtgaaacaggaattaaactcgggtctgcctgattgcaaaatccatgcaaagatacaagatagagtgtttttatgagctccagcacaagcatctatttttattactaaactctgaagaaagaaaggagcgcagtgtgcagccctgagcctaggataggataggtctctacagtctgcttcattctctcctctctaccctcccacatttttgtgtaaatttaatctaattttttgatgaaacaatatattatgaaaataaattaaagatagacgagagcagaagaaaattgagccatgaataatttcaacagtggggaagagaactttggaaaagtttaaattagagtagaaatgggtaagaggagctcaggaaagtatttatttgcttttctttaattccccattgtgttccagaaaggattttagatgggactcaaaaagtaacttttttgcttccaattccaacataatcattctcacgaacttttgtctcagttcaccaagaggaaaaacattcaatattgacaaacaccctaaaaattatttaaattgaaagaatagtgcaaaataatcaaggaaaagagagaatttctgttttttttttaaaaaaaaacagcacgttttaagtttctaatctttgcgttgtcaaatactctctctctctcttttgctacctcatagaaatttaatccatcaggatacgaaataaatcaaaactaatctaaaatgttaaaactgaaagacactttagaagtcatctgagttaacctactcatttgtgggatgaggaaactgggtctcaaagtaacttgcccatatctctcagacaaaactaacataaaatcaaggcttccctattcattccttttatagtaccaaggagtggtatgcactttttatgtatttatttatttttttgagatggagtctcgctttgtcactcaggctggagtgcagtggccagatctcagcttactgcaacctccacttcccaggttcaagcgatgctcgtgcctcagcctccagagtagttgggactacagacacgcatcaccacgcctggctaatttttgtatttttagtcaagacatggtttcaccatgttggccaggctggtctggaactcctgacctcaagtaatccagccacctcagcctcccaaaatgctgggattacaggcgtgagccaccatgtctcgccttttccatgtgcccttttaaatgcacacatacacaacagagaataaggagcttgccagtgacgctgcgctctaattgtctgttagacttttctaagagttttaaaacaaactcgggcctcaactctcccccagaggaattgactccacctcctctagggctggaccggaccacagactcccactatgggcgcttgtctattgtgtcaggctgcctgtcggggaaaaccacagtaataggaaaaatgtgttgtgcgttagagtagacttcaccttagggctcgccttcacatttggacctacaacgctaaactgtacaattcctcgatgaggagtattacttcttgtgtttctttttcttctaagatttattttaaacttttgtttgagcttcaaggaaacttcctctcaatttgtgtgattttttacacaaatttttacagacagtaattacagtaataacttagtagagagattacagagataaagtcctatctctcatagtaacacacatgcatgcacctagcaagtatgtcaataacacaacaattttatatatatataattttatatacatatttatatattatatatattttatatattatatatataatttatatatataatatataatttatatattatatatatataattaatatatatattcaaggatgaaatccatgcacagaaaatccagttttattcagtggtcagcttgctaaagaattggaataacccacactatgaaccacttttaaatagatcttggtttatttcttcagttatgcttaaactaattcttcaaccatcatttccaggacttattcaataataatggcaaaaatgaaccttgctttttaaataatatgtataaactttattaaattatatgattatgtccaccataagacaaataagactcaaaatagtttgaatactattctcagttttatcagcttgctcaaagttgggacattattaaatctcattagaatttattttaggctgtgataaaagcagagagtctcttgattaagtgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgcagctatgcatgaggagaggactgagcctgaaacacaagacggttctcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaaaagaaaaaaattatatcagggaaagataaattttattggtggtctaatagtcgcaagacatgtacagcttttattattttggatttcttacttttatagtctttaaattatatcagtataaataatgcatccataacactttttatttagttttttgctgtgtttcattggacatttgctagttatccatcaagcacagtaaaagcagattttaggtgttaaagacattggaattatctttattccatatgacaatgttatttaaaaacaaacatctttttcaagaaaaatactctttggagctttttcaggctgaattgtatctacaaataaaagctttccttggttaaaatctgattacacatggatgccgcccgaacaccttggagaccaggaagaaatacacattaagtatcaaaatcggcacttgcgtttgtaagtgatgttgcccctgccgcaggtgggggaaggccagtctgtctttgcagccactgaagagctcaagcgttgctaatgcagtatttctaactttgctgtcctaattggcttccttttctttcaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccaggtagtcctctgagccttccttgaacaaggtccatgtgctcattcctctttacacatgctcagcatctgcatgcagaggccagctaaactgtaagggaatgcaactgtgtgtgtgaaataaaatatgtaagggaaaaagatattcacagattctgcattttaaaaagtaaggaaaaaataactgggagaaccactgagcatgtcaagaaatagaattttagcagcatcttagaagagcaccagaagacatacctatttaaaaattatgtgtgcctttttttctgattattttcttataaataaactttctataaaatttggaaattacagaaaagaattaagaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggatgtcccataatttacccatttcccttagaattgaggtagctcttatttttttatgtttctgctggcaccctgcactctctaccaccatctgcattagaacaatcagaacaatcatgtgttccaccctttttatcgtagtcactgtaagaaattcaggttgcccctgtcaccacttgtccctcaagctgtaatctgcccacagctcatctttgttaagcccatctcccacctctgctcaccttctgaaaccattctactgagccttgtggaactcatggtcaaaacaggcaaaataccccgcagaatcctcctcttccctcagtgttctcttcatcatgctctgactgaaacccaactctcactttgcatgctgctaccccggcagccctcttaaggagtagccatcacctttttgttttttttttcccctgagatgctgactcactctgtcgtgcaggctggagggcagtggcgatcctggctcactgcaacctccgactcccgggttcaagtgattctcatgcctcagcctcctgagtagctgggactacaggctcacgccaccacacctggatattttttttatttttagtagagacggggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggcaagcagcaggcaaaggagcaagcgcagcttcattagcatttacagctgctcctcattcctggtattactgtactgcctgagctccacctcctgtcagatcagagacagcattagattctcataggagcacaaaccctattgtgaactgcacatgtgagggatctaggttgtgcgctcctgagaatctaatgcctgatgatcaatgatctgtcactgtctcccatcaccccaagatgggactatctagttgcaggaaaacaagcttagggcttccactgattctatgttatggtgagttgtataattatttcattatatattacaatgtaataataatagatagtaataataataatagataataaagtgcacagtaaatataacatgcttgcatcatcacaaaaccatcccccaatcctagtccatggaaaaattgccttccatgaaaccagtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctggtctccatttgaagcgtttttttgttgttgtttggtttttgtttgtttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagtcttgctctgtcacccaggctggagtgcagtgacgcgatctcagctcactgcaagctccgcctctcaggttcaagccattctcctgcctcagcctcctgagtagctggaactacaggtgcccaccaccatgcccggcttctttttttgtatttttaatagagacggggtttcactgtgttagccaggatggactcgatctcctgacctcatgatccatgattcgcctccttcggcctcccaaagtgctgggactacaggcgtaagccactgcgcccggccacctgcaccttctaagctgaacgtggctgtagaaaaagacaattgtgccatctaatctcaccttaaattcatgatccctctcttcaaatggaccctttgtgctgctctgcaatcatgccacttttctctcatcctttttcttttccacattcctaggtgattatttcatacctccccctccatcctcaagcctaaacctctcctctcaccccctcccatccttaccctcagttgatggtgttgcctcttatttcattgagaatttagaagctgtcagaagagaggtaacaagctcccactactgcatgcacccacttttctgcatctgtgcccaattattatgactcttttctattactttggatgaattattcttgtttccagaaaagatcacatcttccccctatgttctcaattctacccctctcccgcttgatgacatcactctggctaatctctcctccttcttatattgtcactttttttttccatcttaaaagcaaaaacaaactctcctgactcatttcctttctaagtaaccacttcattcttctccttccatacaatggagagctgtctatcccgtctataatttctcttcatccattctcctttgaattactaaaaacaggctatcacctcctcttctatactggattcaatggctaatctacagccaccagtgttcaccttactatatctaacagccatgtttgccactgtgaatcaccccattcttcttgaaaccctttgctcaatttgctttccagcccatggcattctggagatgttcaaattccatagtggctccttctcagctttcttcattactctgaaatctacatagtggtattcctgggactcaatccttggagcaatttgtttctctaactacattcattcagatggtgatcttacccaggcatgtggctttctgtactgagatattttgatattgacatcccacagtatttactattaagtttatgatttaattttatatccactcattactatggtgtggggaggtaatttttctgcagatatgtattaccactgtaaagaaacatttactgattaatatttccttttccccttgatacattattgtatctgaacatacacaaatttatttcatccatattaagatatgtttcagtataatccattttgttttacttaccttttagctcttattacaatgttctgcttaccttcattttatgttaacatatctgtaaagcaaggtcctttatttctcttctcttctaattaactagacgctcttacatattcttccagctgacacttttatgcactattttaatctcttccacaaattttaattacaatcaaaattactggaattttgattgtaattaaattagcctatttgtaaagaattgctatatttacactagtcactcttctctcttcagatattttatgtcttacagtaaactgttttaaggttgtctatatcaagcacgcatttctcatttaaaaattctttctatgtatcttacattttcattttaatggtagtaaacattacctgttttgtttcaacatagtaaatgtactaactggtcattattggtaaaccttaactattagaataggtgtttttacatgtatttgatatccaataacttttattttagttctagaagtttatcagttgattcagttattgttatgtttaccattttttttttttttttttttttgagagggagtcttgctctgtcacccaggctagagggcagtggtgctatcatggctcactgcaacctccacctcccaggttcaagcgattttcctgcctcagcctcctgagtagctgggattacaggcacctgccaccataactggctaatttttgcattttagtagagatggggtttcaccattttagccaggctgatttcaaactcctgacctcaagtgatctgcctgcctcggcctcccaaagttcagggattacaggcatgaaccaccaaacctggcctataatactattatttgcaaatattataattgtgctttcacttgtcaaaagctatatctgttataataataatttcatgtttttaaattgtctcccaaaataataagctttctattttattactgattttaatatgattgccttaagtctttcaccattaagtatgatgctgatggttagtataagaaaaacatttcttgtcatgttacgaaaactgctttctattcctagcttcttaaagatatcctctttcaatcaggataagatatttaaattactcatatgcttaattgtggagagtggagtgggaatgtagatgcatttaagaggtgatcatatataggtttttcaccttaaacagaaccataaatgatattattgactaaataaataacttaatattagccatccatgaattccagaaataattactatcttgctttagtatgctattttttcatcaactgcttgcctgacaaattcaataggcaatttgagaggaaggggttaatctatacacattcttaagcaagaattaaatgtatatgtcttatgcaatcttcactggcatttttagcacagttatatttgctttatatgattaatttagaagcatttataaataatgcagtttaatttcaattttgttaggattaaaattaccgtctttatactgtcctcttttgaccaattgactattatgactatttttgttctctaagaattctaaaagcatgtctattttctgaggaatccctagatgaagtaaaaaataaatacttccattaaacaaacacagctggtataaaccgttatgctccaaatttttatattttctttcatggaactcacaacttttgaatttaggcaactctgttcatctttgaaatggcctcatgaggcaaataagaaatagctgttattactcccacacagtaagtgaggaaactgaagcatactgatttctcttttatgtgcaatatggctctcagtttcatatcatatccattatacagtgcaatgccctctaccttggtatagtggcaagcatgaactctgcagtcagagtgccttgattcaaatcctggcttcaccccttactggtagcgtgagcctactcaatttatttaacctgaatgaggtcttagtttcttcatttatataatgaaaacaataatagtggctactcacagagtttttgtaaggatttgatgaaatactcaataaaaggcttagaacattacttagtgcatggtacgcttcataaaagcaattatgataatgatgatcataaagatgataattaccatacacattatctaccatttatagtcgaagaaccaatcagttgataattaatcaaaaaataagtaaaaaaaattcatgtctagcgctatgctagattttcttactgtctcagtccatttcggatgttgtaacaaaatatcataaactgggtagcttataaataacagaaacttatttcccacagttctgaaggctgggaagtccaagatcaagtctccagcaaagtcagtgtctggggaaggcttctttcctggtcatagctgaccccttctttctttgtcttcacgtgttggaaggcactagatagctctctggggtctcttttgtaaaggccctaatcccactcatgaggctccagcctcatgatgtaatcacctcccaaaggccccatctcctattactatcacactgggagacaggatttcaacatacaaatttttggagaacacagttgttcaggccatagcaagccttaacccccaacatgatgatatttggagatgggcactcacttatcttgtttttctttatcttcacacctttccctgaaaatataaagtgcataggaaagaaaactgtagaaagctttatagactaaatattttaaagaaacccagatcaccttgtaactatgctcttcatcatacctaatgatacttgcaagataattgttgcttcatcctaggcattaataaatcctgtacataggcatgttattatgaatagctcagtgacattgctccttaagaaaaaaaatttttttgaagactaaaacctatgtaatactgagtccaaggggatagcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctagctcaaacaactttttaaagataaaataatttgtggaaatattattttcactctatcataattcttattttaaaaagaaaataataaaaataaatctctataactgatcattgctgttgcctgaaacatttaaccaattacctctatcttcagtaaatagacagatttgtaactagaattcactattttttgttttgtaaaccttatttaatctacctaacaaccttgccagaatagagattgttagcattatactaagttctggaaattaatgctaagaaaatgtaagcaacctataaagccttgaacaaaaagtattagaagcaggtttcaaatccaccacaaactgcgttctccagacggcaagagagtgtaaacactctctgctgattaaatgagtttgattttacaagctcaagtgaattatatcttagagtcgggacagaatctgcaaaagtgactaggggtcatgtatggaaaacacttgagaaattgtgagaacataaaatttgtcgcaggatagtaagcaataaaacatctttccaggttttataaaggaaaataaaatgtaggaaactgattgtcatctccagtgaaacttaagtattgcttacttaacaaatatctgtcaactgtggaaaaaataaacagtgctcattaggaatcagaataggttcactttgtcagaggcaatggctcatgcctgtaatcctagcacttttggaggccaagagcggaggatccaggagttcgagaccagcatggtcaacaaaggccctgtgtctacaaaaaattaaaaattaaaaaaaagaataggttcattcaaaataacacatatcaaactaagtgctaggtttactgtatatataatatctgaaaacctagttttctaaatcccagtaaaatatcaagtttatcagacaatgtgatacatcatatctcaaattcagcaaaaaataataactgctattatgtgtccaaaactgtgtatgtaccaggaccaaaacaggtcactgtacagagattttctcatttattgttacaataaacttatgagatagacaagattatttcttcttttattgttgatgaactgatgctagagaaattaaataacttgcttaagtcataaaacagcagaggccatatccatgtttcaaatgctggtttgtttaaatagatgtttgatgagctatttcatagtatccttgcgcacaagattgaaaatatgagccagatgttagccagctgataggttgatgggcatatacgttgctaaaaaaatgtgacccagagtacactctagtgatatctccaatgatgaggcataagctttgtatttgaccttgttgtgttcaaaatatctgtaaatgctttggatgatatctatcaaatattcagataatataaagctgaaagtattatctaatgtgttggatggtgggaaaatatcctgacagatgatactatgaattacagttaacaagatgagattaatagaaaagatttgaactcaggtaagctcacttgtttgttcattcctgtggcatctgttaattatgtttccaacatgcaggtctatggcctatggtagatagtaagaatatgaagactgcatgggtcttgccctctaggagcttattctctagtttaggggaaagaacagaggaaatgacacatattagcaattcatgtgaagtaagagtccttacttgattgcagattcactaggtgccaacacagggcattgctatttgtataagatccaaatcaagggaggaagtacatttaatatatttgcaagtcacagctagagacttataatctactatattttgaaagaaaccctgagtaagattgctaaatgtttagcttgaaacaaagatttaggaagtaatagtattcttagatatttgaggaccttccctaggaaaagggaattagacttaattttcatagcttcagaaggcagaacttggatcactcactgaaaattagaatgcatcaaatttttattcaccgtaaggaaaaacttcacagcttatgcaagacgaaaaaagctgtcttataagaattcatgcatttaatgatatctcaaggaaagtatagaaggcattcctgtatggcaagaaggttagattaagtaatttctcaccttaggcctgagatactataatattaatgttatagtcatttgattttgtagaaggaatatataccaacagttttccagtgtgcaaaaaaaaacttaacaaatctaatatattctgatgtattattgaagagatactagcacataccactcttgagaatataattaaacttctcattaggcatccaaaatataggaatttcccctaatggctaatttttatataagaaaaaatactatgtacactatttcaaagcagacagaaaagtcatatgaaaagggtatgtcaaaaaagtttcaaaaagaggctcctgatttatgtgttgtgtgtttgtggacctaaccaggacatttgattcaattaaccaagtttagtatgtcagcaaccctctgaaagattgagaagattgactgtccagagaatattacaatatttgctttctctgttgaagaaattatgtagacttacaggtataagagaaacaaaatcatatttttgaatctcttatttttagtaatgattattggctttaaggattttaattcagttactaatgttatatttaggttacataaaataattcattatgcaattattttactgcaaaagcaaaaggctgaaaattattgttgaagatcccatgtatttttggcacattcatctctataaaataagttcttaaaacactccccagttaacacttattcatcagcatgacaccttgctgaatgacttgaaattataattcatagataattattttatcttggagccattatctctcataatgctactgttaaatatggaatggctcttttattgcttaaaaatggtggttcctttggatggttgaataaaagaggattatggcacttaaatcaatggcaaaatatgacaaatcattttgccctgctaaccacttttctgcaatgacacttgaaatttgggctttttcatctgaaaaagcctgaccagtttcatctatacttcctggaacatgcattcattcattcagtcattcaaaatagtcatcgaatgcctcccatgtttgatgaactaaaaggagcatttaagccagttttaggtcatcggggaatgtttctcagagaaagtgacatttaaaatgagagctgaaatgaataagtgctagcctgatatacactgtagagctaaggatttgcaaatgaaaagtcccagcagtgataaagagtatccgcataatttgagaatttcagatggccccatgtggctacggcattatatgcaaagaaagcagtggctacagctacatatggaggggtaagcacagtggtggtgaaggcgggggtgggggtggcaggtaatgaagctcttccttgccatgctaatgatttgttattcatcctgactgcatttgggagctagtgtaggctttcaagcaagagaaggtcatggtttgatatgttcataggatgatcactctgattgcagtgtggagaaatcaccagataagaaaatatggagacaggatctttagctaaaaggctattctaataatccaaataaaatatgacagtggccagatgaaaatagtagcaacaagaaagtcaagaaacagagagtaatagactcatggaactgatgatctaatggatacctcggataagagaggcctctaggttgctgaccttggcaattgagtgaatgacagtgacctcagatgaaacgagaaatacaggagtattacaaggtttagcaagagatgaacttcattgttgtcatttcaaatttaagacgcttctgtgttatacaatatttattcaagaagcaattagaagcagaagtctggaacccattagagatatccaggctgaatacataaaatacagagttttgggcacaccattaactgaagtcatagtaatggatgaaatcaccaaggtaaatgtggaggagaaaaaagagatgaggaccaaagttagaattaagggcgtcaattatattgaacagaaagggaaggaagagtcgataaaggagaattcgagtagccgcagaagtaggagaaacatcaactggcttactcttaaagaagccatgggggctgggcacggcagctcccgcctgtaatcccaacactttgggaggccagggcaggcagatcacggggtcaagagatggagacgatcctggccagcatggtgaaaccccgtctttactgaaaatacaaaaattaactgggcatggttacgcatgcctgtaatctcagctactcaggaggctgaggcaggagaatcgcttgaacctgggaggcagaggttgcagtgagctgagatggtgccactgcactccagcctgactacagagcgagactgtctcaaaaaaaaaaaaaagaaagaaagaaaaagaaagaaagaaaccatgggaagagagtatccagaaatatctatcaatggctacagaaaacctacatatgaggcctgatgattgtaagttttgctttagcaacaaagatcttatgggtcatcctggtattatgtttaatggtgaaaccagaagcctgtttaaagggagaatgggagatgaagaagtagagaccaggaatgtaaacaatgtctttttaaaagcttatcgaaaataggatagaaattgtcaagcaatttgagacctcacagattttttttttaagacaggaaaggcttgaccaatttcaaatattaatgagaatgagcctgcaaaggagggaataaagatggtggagaaaatggggaggcaggaggaaaggaaaccaatttaggagtggagtagcttcagacaaaggacggaaacaaatgtcaaagggatggaaaataatgtggcaatatactgaattgtttgccaggaaaccaagggagcatccaaattagagctttcttatctcttaaagtagggtaaggtgtagaagtagaagatttgagattggctgggcacgttgggaggctgaggtgggtggatcacctgaggtcaggagttcaagaccagcctggccaacatggtgaaaccccatctctactaaaaatacaaaaaattagcctggcgtggtggtatgtgcctgtagtaccagctactcgggaaggtgaggcaggagaatccctttactcaggaggcagaggttgcagtgagccaagatggtgccactgcactccagcctgggcgacagagctctgtctcaaaaaaaaaaaaaaaaaaaaaagagaaaaagaaaagacttgtaccttgtcatattggaaaaccagattcatttcacattgttataaaatctgtaaatgtcacaatataatttcaaatataacaccaaaaatgtaaaaaataaatgatctaaaattcactgtggcaatgtcatagtttcactgcaagaaatagcataaactctcaaaaagagttaatagaagttttaaacaaacattaattccatggcaatatctgtggtggaaatgacgtcagctattgtttgttgtgaattgccacacattccctaccaacaattgtctggccattagaagacacatgaaacataaatacattcttcttgattgactaaatgaagcagagcccagtctatgggatatcatccaagttcaagctggcggcttcgtggctccagctgagattatcaggaagtcaattcactaacatgtccatctagtttgtaactgacttttttgtttctcaacttttctttcgatattgtttataagatgtaagtcactattttgaccactccaaatcctgtcttataaaatccagctaaaattcaattccaaattcccttcttcctttttctcaactctcaaatgcaaggatcgcattcccacaagataacattcaatgttgcattcttgctgccatgtttattttttgtcaggtggtttttttaaattattattttcccaaagtctaagtaaatttctagaaggtaggatgttctttcattgcctgtttcagtgcattccatgtagctcttcctaactccttattgcataattgattattgtgttaaatataattctgcttcatgaaaattttaatttgaagctatttgcacactattctgaagctattctcatttctttgtggaaaggtgttaaagggtatcaccccaatgtctcttattatgcaagcataagaaagaagatatcgatctgagattgctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaatttacatagagattgattcagggaaaagagaatagcaactcttattgtcagtgtagctacgacagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgactgtcagcaatgtgcctgccctctgatttcttccagtaacaagtaagattgagaaatataaccatatttcccaatcagaaacgccatctgtctagcacatgggctgtctatgatttggctattttttccatgtagacaaaaatctcaatttaagatagagatatttttaataatatagaaacatgacaaaagtgagtatataatgctctatggttcatttttcctttgaaactctgtcccaagtaaataatacttattaattaaaattgaagtaccaatattaatgtaagacatatttataaaacaaatgatatatatatacaaatatgcatggtttcataaatataccagtctaatgcttgcatatagctctgcccataatatcatctatgaaggattgttcgggtgcatattatataatttttgtggctgtttccatttattttatgtgtttaattcaagattgggaaataattatcaagaaaacattgaaaaattgtacaattaaagcaggtgacttattgttatgctccaaaaaaagtcatctcccggaatcacagcctcctttttcttaagatggtctgagcttggtaccatggaaacacagccctaagaagaaacaaaagctggaatatcttatttcagtgctgtctgaacattctgcactggtttatacattgatgaaaaccctaggtgttttcatttacctttttgcccacactacctgcactttctgttaagtgatttatagacttcagtaaggcagggtagttttactctaagaatttgcttttgaaaataatgtatggcagtttgttcagaattagaattctggacactttatcttgagtgttaaacagccacagagcaatttggacaatgtgatctttgcacctgtgcctactcactttcttcttaatcttcggctttgtgtgcattctgaaaacatttcctgtaaatcatctccttttcctctgaaagctcctcttttttgttggctggaatcacaagccttttacagggtgtcaaatgtcaatttttaggtaagctggatattgaagaggataatatacatggtcttattgttcatccagggaccaagtagtatgtgtatgaaaaataacattatttttgtctctctttccctaatttctccttgatgccccgatttatttaattgttttaaaaagtaagccatttggattagaaaaatttaataattaattgataattccctggtgagtacactataataaaagctacaggagatatacaagagaagcatgccattttttggaggagctcactgtaaaacctgtgtgttaaggggtatcaacttaaatgtaaagaaaattcaaaggcacaaaacaccacacttaatactggaagcttcaagaacatatgaaaagaaatagtagcatgtataatgggtcttaaacaattaatttcaggattttcactggtgggaatagtaggaaattatatgggcaaatgcttacaaaatacaaggcatgtgcaaaacctaataagtaacagaatttggaacatggcgttcagacacaatttcatgatcacagatgaaaatgaatgggagaataaagaccatattgtagaaatccttaaataccagtctaagaaatagttatttaattttctatgtaataaggaaacactacaagtttttattttgaaaaaaaggttaatatgattatggccacattttaggaaaactattatcatagaattgagtataatgaattgaaacaggcaaatgagaaaagcatagagaccaattaaaaggctagtatactagcatgggcaaaagataattagaaccagaagtaggtaatagtaataagaatggagacaaaggaatgaatgtgagaaaatggtttaatacagctttacagattcggaaactaattagatgtgaggggtgagggtccgggcagaagttgaagacaggtttttaggcaggttacccccaaaaatggtggtgctattaactgaaatggagaaaccaggagagagccgttagagaagaaagataatttatgtttcaaataggttcagattgatagaacatatctgtctgaatggaaatatgcaaatagctgcaggaaatggaaatctgaaaattgcaggagcagatgaaggaagagatatgttaataagtgaattaaagttggataagatttcccaggctaatgttatccaaggcgagtatatagaaagaatgaaagacaggactttatgttgggaaaggagaaaaagaagagccaaggcaggagcagtcagaagagagggaacccaggcggcactgccattgacaccaagggagagaagagcagtgaacagcatcagttgctgctctcacaagggagacccaatgaatatggtggcaattgactattgtaattgagcaaataaatgggcttgccgcctgaagcacatagaagccaataacgttggcactggcttcggagaaaagaaaggctttactgcaaaattgttcagcaaggagacaagagtcaggttcaaatctgtctccctaatttgggatatggggaaggttgcaagggatcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccaggttttgattttgtccctgtcttgttggttcaaggggaggaatagttggttcctggtgttgttagagttcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatttcaagaataaaatgatagaatactaccctgattggttagcaggatcaataacagggtgtgttttcatttttgtttcattgttgttttatatgatttgtataatttgagtaaatttttatgcaaaagaccctgaaagaatcaaaatatcaaattaaaatggcaagttcagtggctttcaaactttattgattgcatccactgtaagatacacttttttatatcataagccagaaacacacaaaaacttgtgtgtgtagatatctaaatatatgtattatacaccatgccatttatttaattttgttattttacatttttagaaaaaaaattttagccaaaacctactcaatggatttcatgagtcacttatatcaccatctaaagcttgggacgtattaggctaattaacaaagtgaagacctataaattgtgagaagagaagaattaaaatgtgaagcaaagaaaccagccagggcaaagaaaagaggcacttctccccaagacataaaaacagattctgaggaatagatggaggaggctgagatatctcaatttatgacttcaatctgtgcagtcagtgagaaatatggaggcatgatgagtgattactgactcatttccacggcattagttcaagtcctcattatctcttaccaaaacaaatatggtagaaatttaactcttatgacggagtggcagtgctcacacacccttagaagtttccagtgccttcccaaggaaagatcagactctttgagcattagaaaccctctgtaatctgactacctttccaggctccaagccctcaactccattctatataatgccaagtttggcatttcttgcacttatctagacatcattagcagtctgctcttgctattccctcagacaatccctgtgaaatctaatttatttttaaaggcatttttcaaaccctacctctgccacaaaacctatccatagcacagaatgtattttgtacattttatatacaacgaacacattttactatacagaattatttcaatcattctttcaggagatgaacatttactaagcatatacttcatcccaacactatgaataaaagataaaagatatgtgtcctgtcctgtatgtgtacatatctgtgtctcacacagaattgtaaattctttgaaggtaaacataatgtcttatttctttctttattcaagaaaaagttaatgagggcccaactcaatgctaggcatggctcttcgtactgggaatatataagtgaacaaaacggcctgtgtttcctagccttctggagcttgtattttttataagagagtaagataaagaaatagatatataatgtaatatcaggtaatgacaagtactaccaggagaaataaaggagactcaaggaacttagagtgatgaaggtatgattttagatgaggtggtccatgatcttcacaaacagatgagacttgtgcagaaatgtgaatggtgtgagccatgtgaatacctgcaggaagaacagtcccctcagagaaaaaagtcactgcactggccctgagacagacccatgcttggcagataacaggaggccagggtggttggaacagagtgaatgagaagagggggctaggagatgaagtcagcaaagctctaatgaatatctaactctcctgagggctaaaaatcttccagtggcaagaggtggcttggtacaggataatccagtggtgttattgatggaagcaccagcagcatttgcagataggagataagtggagtgtgagagaggagacacggttgacaccatggtttttggcagagcaaatggaaacatggagtggctgttgactgggatggggaaaattagggaaaggtctggtgtatttttggagggggagaaacttacttttagatctgcgaaggtaggcacaatatttaaatcccttaggactaagtgagatcattcagaggagagaggagaagggaacagaaatcagaaaactgaattgtgaagcacgttaagagatcaaggacatgccatagatccaacaaaggaaactgaaaaggaacaaccaatgaactgggataaaaaccagaaggaaatggtttccaggaagcccatttatctctgcagtgtccataggagatgacacagagagcaagctctgtaaattttaaaaattctgttgaggggagtttggaattagcagccatagggaaatgtaaaagatggtcaccatgagaaaagcacaaggatttctgagtagccctgcagacaaaatgataattgagagaagattagggagttgtgaacagaaagaataaactcaagcttcaagtgagatggaatccctactccctccagaagaccttttatgtgatataaggaaacagtgcaatccaccataatatcataatttgaaaaaaattgtatcaactattcaagaattactacattcctatacagtaaacactttattatttttttattgacatttcattattttactataacgaaatgtaatttaatcatactggctctttagagtttctcttgaaatgtctaaaatctgtttcttagagcccatatatgtataagagtgtgtgtgtgtgttcgcgtatgcgtgcatgtgcgtgagtgtgcatgcacagatgcagtcagtatcaggctttaaatgaatgagctaaaaatttggcagagtgtgtcagttataagtttattttttgtgaaggcaaaaataaatttgttggataatgcgtttgtgagtagtagatcaatttgttcacatattttgcaaaagttagagcttattactcattcatgtactattgatgtaacgcattagaagacagttaacattaggtcctaatggcacctgaccaaaaggagctgtgggcctggcctatacaccttattgcctgttttcagcatcaactgatttagtgaagcagcaaaaagaaaaatggtgtgtgcagcattatctttctgccacagatacatgtttttaatttccaagtttccaatgcatcattcagttttatctaacgggaatgcagctgagagaagtttgtaacaacccaaaactacatgctaatatagtttagttttcaagtcttgtggagtctttttttttttaatggaataagatcatcagaaatccaggagcaagacagactggctgtggtctaccagcattgtagtaaaaacattggggaagttttataagacctaattattagaaaataccataaaatagtcattttcatagaaaaagctttccctttcctcacactgaatcacattactttgtgttcaaggtaaaatgtagtttgaaatctggatgtaaattagaaaagacattattttattccaagtgaaacatgtattcacacttcacgtcttgaagcaccagtggccatttgggctgagttttcaagaaaaaaaaattatatagattttatgccctttttttaacctaagagatattaagtaatagctattccactatcagacaatgtgcataaattctagtcagatttttcttttgattagtgaacaataggacaattttgctggatgtttagtatattcatggctgtcacatcattattaaattccagaatattaacatgctttgtgtgatgcatttttaatccatcataaaccaaacaatatatatttgtttactgttattaatggtttttcattgtgacgtcctagccttaaataagaacttcagcaataattataaagatggcatttattactacctaaaagtatgtcccaataaccttgatcatggataggaatactattttataaaataaatggattaaactttttttgcaatccttttctttctgattcagtttcagcccctcttgtgtcgcagaaggacttgacgactaccgctgcacggcttgtccacggggatatgaaggccagtactgtgaaaggtaccaacagccatgaaacgtacagagtaatgatatgtagggactatatggtaaagggtcacaataggaaaacattcattatttgaagaacttcaatatttgcatatcctttagaagtttaaattacaatgctttcaaaaccacttgtgtatcttagaatttgtccaaagaaagttgtttatttccaccgtatgtttagactttatcaaagattccaaactatttacaattatctaacttatgctttagtatatatatatatataattttatatgtaaatataacatttcataagaataaatcaattttcaaaagcttagcagtagttactactaataagaaactggctacacttttcttattttaatgcactggaaaatattgtctggaagtaactgaattcacgtcattgttctgaacactatgactacaccagcaagtgtatacataactcaaaatataaatagtatcaagaatttttaattagtacccagacaataaagtatttgttattcagttttccttttcaataggcaaacaatattatttaaatgttttctcttaccatattgcttatgaaatctcataatgcatgtatacagctgttaaattgaattctcagtgtaatccaaatggtaaattaaggagtacagttccaaactgattgtctagaaaagttgcaattaatatcttccagatatatattttctgtaagatcagtatcctggatattcaaacttgtcaccaccacttttggtatattttagatattatctttaatataacagagagttactaatgttaactactaacattatacacacatgatagttttagcataattgatagcagtataaaagttttagaaagatccatagacttcgctcaattccaacagttcagctacattccattttcctcatctataatctcaggaatcattgataggccacctactttacactaatattgtgacaataagtgtgtaaaggacactgttggtgccctgcctaggcacctacactgaagccttctctccaacagaagaggcagaaaggcctgaatgtttacccgcccttcctgcagtggcccatgactaaccagcgtgagagtacaaaagtccagctctttggcccctaagtggaacaagttttgagatcttattttatgctccagagcactccatggaatcaggctaagactgggacatcacctgaaatcatacccttgattagagcttttcttttccatgtcctgcttcacccactcctttgctagattctcctaggaacacttaaatggtaagcttctttgtaaatataaactaatactaattatcagcatccacttaagagtcttgttttatataaccagcaacagctgtattaatcatggcaataagtaactaaataattagggttaagctttataaatcccaatgcaatttttatacatttgtaaaatatatttctaaataaatccgtatgtggtaactctaaacacagtatccaatatttgcatatatataaaacagtggattcacaatttccataccaacagaaattagcagcaattaaataactcatagcaacaccaaatctaaaaatatttccatttgttctgaagatatatacatcttttggatatagatataggtgatacaagtacatacttgttaatacccaccagtgagctttggtattcatggttagactaatatttatttcctgtacctttaaacaccagtaggatggtgactaaaagcatcgctggacaccaaaaagattatctacagtaattcatgaaaaaaaaattatgatatagctacatttatacactgtagttaccattttctacaaaagcatgtgtatagaataggctagaagggtacactaaaataacaattattgtgttaaagcagaatgattacagaaaatttatttgttaatatccagtagtatttaatcgataaaagctgtcagtttgtgtagcatagagatgagcagggccatacagtatcaaatgtgagtgacttaaagtgtttttccagtcctcaaacattgttatagctttgcattcatcatctctaacatataaatgatcaggttatatttctctgaaaaattgctttattcagctatattaaaccaaagttcttggttaaatttttattgtaaccttccaaataaatttgttccagtgctgagagcttcttaaatcatttaaatcatctttcgacctgctcagactgatcaggttaggtctaaaactgcttaaatttcttgagtatccctgtaatatagaaacctctcctcatactttattttcaatactcttgtaataaactctttgaacatttaatcaatctgaatctgcttagaatacaattattttacctataaatgttaagaagccatttaagtggacttacttaaatgctactttcagtatttgtactctttcattgaaaaaaataatcaaaaacatgaatgtataaaagcctaatgtcacaaatcgttttcttcatgttttgccttttctaaccagcacagggtgaattaactttcacagtcagccatgcagatttcacagtctcaggcagctaaagatggtctatgattatcttgccagtatttatagcttttggctccaatcccctactgtctctcaacttcctcacatacttgcctgttgaacaaaaattctaactgtttgttatatttacactgaccatatataaaacttgttgtccaatctgggacactatattaaaaacaggcagtgtttttagcaattaagccaaaacaacaggtaataggaaattgtcctgggcaaaccagaatgtatggccctgctagcattgtgtaaagttaccaaacttccagtgtcataacccggagtgaaatacacttaggtgaatggatgcatagatacgtggaagagtcaattaatggactgcatttagggttcatccagttggattctctttctacttttccaaatcagtgttatatattttgtttgcatatcattaacccacttccacagatacacatgaaaaatccatcttgaggaagatatggcaaaaagaaaagatgaataaaagtaaacagaaaatctgagtagcctattgccacttaacttgcctcttttgcctcattggtaaaattaatgggttgtattatttggttattttgagatctgaaattcatgagtatagggaagcccagaagtcaatatagaattgcactcatctctaattatacaagaggacttaacaaaaaagtttatgatctagagcagtcacagacaaactatgacccacaggccaaatttggcccatttctgattctgtatggcactcaattaagaactgttgttacaggtcagcatttacaatcaatttgatgacaggaggcactaagttataacccaaatgaaggataatttcaaacctcaggaagaatccaattcttctcattagtagcctgatattacaaagtaatttaacattattattattattattattaatgttttcaattccatcaacaacagcagaatgctttagaattttatttctttttcacggcataatcttgatttttcctatgtcctgcaaagcctactgtttactatctgaccctttacaggaaaagttaactaatgtatggactcttgctatcagttttgttgcatcaaaacaaaagaccacacacaacaatgtggagacatgacttgctattaacctcttttgctttgtcactgtttcaattcaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgtttgtacgtatactaactttgctgttagttttggaggccttgattccagttctgtctcatttccaatgagaaagagtgactctccccgcccgcctttttttttttttttgcaatagttatactcttcattctttctgacactatctatccaccttctgctgttcacctgctgattgcgtgtccatcctgctgagccaagaacagctgagaaaatcctcagtgtgctttagtcagttcattgaaagacctacaatgaagctcctggaggcattttatttgatttgtccatctcagggtttacagttttgcctcaagttggcattgcctttgtgacagattaaagatgtgagtgtattaaaaaatttagaatcctcctgaatttgtaatcgactggacagatactttaagccttgaatgacaactgatgtttcttttcccagcttttatgaaaatccatgggcatactgcttcataattttctcttgaactacaaaacccgtaagcagtaacaatgaagtcaagtatttttactcacgtacagtaagtggagagcagtttgctctcttgctgtctctcttttttcttactgattctggattcgctagtgccatattgaaagtacattgaaatcagtagctaaatataattcttggatcttgcatacattcaaatccaaaataggttatttataaatttaaggaaggagtgctcttctatagtattcttttcctcaaggaaatttattttagcaccttttatttcaacatttacctattgtaatagtatttgtgcatgtcaacatttcttgttttagcatattgtttgagtctaaatcttaatagtatcttaaatagaagaatttttgtttatgttctagttttataagagttaacctcagaagctaaagctggattaaaaaatacaccaaaaagttaagactgggtgttatttgggaaaatagattttaaaatcattttttctttgtattttaaccatctttaatgaaaatgtattacactgaaaataaatgtgaaggtaggtgagaggggagagattaaatgtactgtcaaatacatttatattgtcatatttagttgatagtatatacacactaattcttcccaagtataatgatatattttaatgataattaaagaagtagactatcaaagtattttataatattgctttcaagtcaaataaattattaacatgcacataattaactagataatatatagatattcttaatgtaaacagtccttgaattattaatcatcacttttattaactatccagaagcaaacttgaaataaaaagatcatattaatgttaagcacaaaaattaaacaatagtacattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaatgtatttacaggggttatacatggtatttagttcagttgctggactggaagtgtttatattctttttaaaagaatagcagtttttattccagaaaaaaatattaaattataggattgtttttgatatctagactcttttgctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaattctgacttattctcaattttccttttaatatatttctgtatccttaagctaaattagtgcaagagaccaaaaaatggattcacctggggtgtttgatctgcaggacctgttttagcacatgtaatcatggtggaattgcataaggcctgggggtgagagtaagggaggtagcttggctctagcaagagaatttagatgtagtaagagaaatgtctgcagtgcttgttgttagtatagtactgactacaggaaataaactttctcctattgcttagaataagtaaacactcagtttagtagcatgtattgtacaagagttaattttgcttcctttagttacttccctgggaaatataatttagactgatccacatcatggatttgtgtatttcaaaaacagaaaagaaaagaaagagagacagaaatgcatgataaatgacctaagcctgatcattgtgtgatctcaggtaatttgcatattggtgaaaggaatctatacactcactgtaaatttagtttaggctcttatttctcaaagtatataaaattctgctgaagagatcaggcaaaacaaagccaatgcaggaactgtgaaaggacttcccttggacaccttggtccctaaaagatacttatagcttccagggacagttgccagtgacccctggattttactggatccaaaatggaattttttgcagcacacaggccttttatatgtggattttcactactatcatgaagaatgtatacaaataatctgtgtccacgttaggaacctatttagacatcacagtctctcatagttagtgacctaaattcagccccaccatgcagagtcagttcctgagcataactaagcaatttattcaccttcaaattccaggcattctctaaagtcccttttaccacacagggttcatcataatagtaattttatttaaaggctcaccttgactgagaacttaccatttgccaggcactatattaagcattttacacgtggttctttcattcttgtaacattcccattccttatcatccccactgtgtgataagagaactgaatttaggtaggttaagtcattttctcagtgacttttcagtagatccgtgatttgagcatgggtcagtcttacaaatcttattttcttaacctctatgctggctactgataaacagagaaagcaaacgtggtttagccagtatattcaacattaatgaattcagccctttattcatttactgcttccatgtttagagcccattctacctcgattaaaaataaatataaaactagctaaaattacaaaatgagaaattttaagtgtatgtaatctcagtaatgacatttattttctgctaatcattgagactcctctaagatttaaaacattatggcatttatggtagattccttttcatcagagattgtcaagtagagactgtcttctatgcagaagaaaagatactagctgggtgcccagattaacttcacagcctctttttttctaaaaggaattatttgggacagctttacaatgttatgtatgttggtgagttctgaagagatattttattaatttcccaaattaagatttcttcttgataagttaatacaaatccatcctcctctttcaactgtcattcatagttcacatgtcattttataaaatgagaacaactaacctgccttcaagaaacttaaaaatgaacaaagaagccattatttgcttaacagtaaagtttagtattttgaaacacaaaacttggatttgttcatatcctattttctgtaaactcatatcattaacacagaataacccatgtgatgtttaaaatagattatgagtggcatagtaaaatgtattactctcctagagaacagaaattaaaattagtatctgttggcaagatattacttcataaaaattgcctgaaatagcattttataaatatcaaattggtgttgcctatttttaatcactgcatagtggggtttttgggatatatcagcttttattatttatagtcacaatttacttaaattctaacatatatttatttaaaataaaacatacactttgcttgccaatttgcaaaagtgatcatgaactatgttttctacttgcaacctgagataagcctagctaaatgtggtaattttccttaactctgtaaaattggcaacttccaaccacttggtgaaaccggaagtctgaagttttatcctatcttgatctacagagatataatcaacattgttgtttttaatagccagttgccaccaaagatctgatcacaataatgcagagacctttatatattatcactagaacactgttgtacatttataatcaaaaatgattaataatggcagtgattgccccctatatatgggagcagaaacaaaatagaatgtggttatcactgtaatgaaaacaggacttactattctgaaaaatgatgataaacatcagttgatctccagatgctgattactgatctaacactttgcttgttgtaccccctaaatgtcatcctctctctgctcgtactcactgctcaagtaagttcttatttgaaaggacagtaagtatgtcatagttttctatagtctaagctgtgtcatgttgttcacatccaggtgttaggcaatctataaaacatcttctgttcaccttgtttgcaccttctactcatttgttttgttagtaaaagatatttgagtttcttgttgtcaaccttagcattggtccaggctaacaatgtgtggaatggcaactatcaccgtgattctagatgattttcctagttgttagagatcagtctcagtggtttgtatattattgagggaagctgttctgctagctgattaaggagttgcacagttgaattatcgtatagagacagctgatcactgttgcctttgttttcagcaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaattggggcctcaactgccctttcctctctcacgttgcctcccttcctcaaggaggctaacctgggattgttctgaaggcagcaggggtccaagagtgtgaaagcagaaagtgcaaatttcaatatgttgctctgccacattctgttggtcagagtatgttgcaaagctaacccagattcaaggggaagggaagtagacttcacatcttaatgtgaggtgtggcaaagaagtattaacagtaaccttttttttttttttttttttgagatggagtctcactctgtttcccaggctgaagtgcagtggcatgatctaggctcactgcagcctctacctcctgggttcaagtgatactcctccctcagcctcccgagtagcgggactagaggcacatgccaccacacctggctaatttttgtatttttagtagagatggggtttcaccatgttggccaggctggtctcaaacttctcacctcaagtgatctgcccatctcaagcctcccatactgcttggattacaggcctgagccaccacacccagccagtagtaaccatttttaattgtccccagaaatgatcatcgctttgatctgtcagtcatggtgttctttcctcctaaagttttgtgctgattttcttcccgtccatctctccctttcctgagtcaaaactgaaatccttcaggcaggtatctgaatagtcattcttgttgatcggacagtctctgcctctgcaatcacaagatagttctctttctgtctctaaaccattgtttttaatgtattctcctgttcctcacacatctgtgaggttttctatcttgttctcacattcagaagttttcttccggccaaccccaacctcttccctcttcccctcttcccctctctcttctctcctaacattctacctccctgatcttctcactatttcatgtacttgggcacatgccatgctcaaacattaacccttgccattctctttgtccaaagtgttttgatacccttctctcacaaaaatattagcccacaaatatttactgaatattaactgtgtacaagaccctttcctaggcaccataaccaaggtgtttaaggtcccttctttaacgaggaagaaagaatatataaataaattaagtaataatgtagcccaaacaggcataagtgttaagaaagcaaaggaaatgcagtagtgactggcgcagggtatagggctgggggtggtggggagtttcaggtaacagtaattttagaatcatcagggacttgctctctgaaaaagtgacacttgagcacttgacctgaacacctaggaaccaggtgggagaagaccaagggagaagaattctaggtagagaagacagcaagcaaaaggacctcttccaaatccttgctcccttgaagattgagcatccctataatttatcacctggtccagtggttttatcctttggctacatggtttttcaattactggaatatttttaaaatacagtggttcacgcctatgatcccagcacttggggaagctgaggtgggaggatcacttgaggccaggagtctgacatcagccagggcaacacagcaagaccccatctctatgttaaaaaactagctggatgtggtggcatgtgcctgtagtctcaaccactcgggaggctgaggcaggaggatcactttagcccaggagtttgaggccgcagtgagtcatgatcacaccactgtactccagcatgggtggcagagcaagaccctgtctcagaaaaaaataaaaatagaaatactgatggttagaccttaccacagacccatcaaaaatcatattctgtggtggtgaggagggaaagagcccaggcatctgtattttataaatgttcatgtgattccaatgggcagccaaaggtgagaaccactgatccacaccaatgttgtcgcattctaatgtgcagagataatgtgggacgcagattctgatttcctagatctggggtagagcccgattatacatttctaataagcttccaggtggtgccaaaactgttggtctgattgctactcaaagtgtggtgcacagaccaacagtagcaatatcacctgggagcttgttagaaaagcacattctcagtcagagactaagagaaaccaggtgatcaaatcacctcctgattcagaaatactagggggtgtggaccagccctctaggatttccgaaagtcctactggtggttctgaggcccactaaagcttgagaaccagactgtggatcttggtgtttagacacagtcaatttggcacttaactgagttctatgttgtgttttctctaattgtttaatgtggacaagtctgttgaagtttgcattgaacggggctatgaagccaaaataatcttttacttggtttccatgcagtgcaaatttggtttcattctggctaggagaagagtaagagatatagccctagttccagacttctgctctggcctccaaagcctctttgttcattcagcttgtgaagcatcaggagcttgcaaagcccctgcaggtgacgctctacagttgtcacctgcaagaagctgcaggtgtcacctgcaagaagctgatttattaaaagccctgccagggcagtttaatccctgtgaagtgatattgtaactcacctctagctgctgtcctatcaaaaaatcactctccgtcctccttctctttgtttacaagcaccagttaatggttttctctccattaagcagctcaggggactgctgtttagagacctaattgaattcttgccaagtttgggcatgatccagagctgctccaattctcggtattttccatgctatgtattttcccctattctaacatgtatatagcattgatacctctatctgcagaatgtaagaaattgtaactgtatacatgagagtatattataaatgcagtagttcctgctccttggcgtgcagatacacctcattactctgcaatgcaaaactaaaaatatacatgttttttaaatctgctaaaagattcaatatatgttaattttggaaattatacgactatttatgagatctattccataatgaagagtcaacaatccatttgtctctctaccaattctaccacctatcctggcccctaccaccaaatttgaatagcacctctttgatggccaaaaatattatggtgagtgtattagtccattttcgtattgctataaagaaatgcctgaagctcggcaatttgtaaagaaaagaggtataattggctcatggttccatcaggctgtacaggaagcatggctggggtggcctcagggaactttcactcatggcagaaggcaaagctggagcaggcatcttcacacaggcagagcaggaggaagtgggggctggaggtggcacacacttttaaataaccaggtcttatgagaactctgtcatgagaacatcactagggcagtggtgctaagccattaaaaccactccagtgattcaatacctcccacgaggccccatatccagtattggggatgacatttcaatatgagatttggatggggacacagatccaaaccatatctggtagaatattagcattcttggctacttaaagaatatagtttttctagcctttagcaattatttatctataagactgaaagaggttaatcatcaaagtagggatttgtgagactgcatctaatcatgggtggtaatagactgaagggataaagaggaacagttggcaaataaataagtcaataaatattatcataagaaaacactatagaaagaaaagttatttttattttgactttttattttattttttggggggtggagtctcagtctgtcgcccaggctggagtgcagtggtgcaatcttggctcactgcaacctccgcctcccagtttcaagtgattctcctgcctcagccttctgggtagctgagactacaggggcccgccaccacgcctggctaatttttgtatttttagtagagacagggtttcaccatgttggtcaggctggtcttgaactcctgacctcaggtgatccacccacctcggcctctcaaagtgttgggattacaggcatgagccaccacacccggccttctttagacttttttttttttttaattattctactcaatagataccaagctaaaaatttatatactttttgaatgtgtaatacataaagcatgtggaggtcaaattactatgactttctccagtgcaatctaatggagcaccacacatttagactctggagcatgttttattccctgtggacaggttcctttcgattgctcatgtagggatttaggggatacttttaatgttatattctatgccttaaaggaaatcttcaatacttgtgcaatacactttttctccccaaatctatttgctcctcctctttggtccctcagtttatattatcgcctctatttcaggttctgggcgacatgcatatctgttcttttgttgttgttcttatctttcctcaaccatcatccatttgatagcattaatattctgagatgagtagtttcatcttccatggaattattcttggaccataaaatatttcatagctgaattctttgaacatctgcctgggatgtttagcagaagtaactactctttgtcacttctctttcacagtttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaaggtaggttggtgcagtcacaagcaagggccagggacaaggtgacagaagcttcacaagcggtattggctgtaattggtaaatgttcttcccacagccccaaatcaagggacacaactgttagggaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattaatccttacaaaaccaataaaattcaaattaaaaacattaatataaagtaacatgattttggctgaatggaaattgctgcttgcaacaagaataggatattgactattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtggccatattcatctctcaggtgcctagcctgggatccagaaatgcttacattaatatttaaggttatcatcaaaatgaaaacacatgattagaatcttgtactaaagagctagaactagtagacctttaaaagttcttcaacaagcaccagtttgataaacactgttctaaattgtggttaaagcttttggtagttaacgaggtaggagaaaacattaaagaaattggggttgtttcacctgatgaaaaaagatgaaaggtgtcaacttactatcagtcaattatcagatatttattaagaaattatagaatacctcagcattgcacttggttccctggggatttcatgactcttttaatatcttcactacccttaggaaatgtagattctatgtgctttaaaaataatcattaaacaataatcaagcaattagcaagaatacataatgaccatgtgttttacaaacattcaaagtacattagcgcacagagactggagaaatcagtaagattcagggtaaccagagaatgtaccattactgagagtataatttctgttggaatttgaagtgtagacacaattttagtagagaagtatttgttgctttagaggaaggcatctaagatttattcactacacattggtagatattcttttaggaaatatattctttaattctgaccataacctttaaggtaagtattattatccctattttccagaagaagaaaccaataatgatgataacaagaataactaacatttattgaaaagctaggcaattgactgaagtcttaaatggattaccatacatagcttttacagaaactccaagaaataggaaagaagttgtcatggtctgaatatttacatctccccaaatttatatgttgaaagtctgtcacagtccattggagctgctgtgacaaataccataaactgattagcttataaacaatagaaatatatctctcacagttctgaggctgggaagcccaagatcaaggtaccagcaatgttcgatgtctagtgaaggcctgttcctcacagagggtgacttcttgctatgaccccacatttaattcatttaatatctggatactgaggaaaaggatagctagctctctggggtctctttaataagggcactaatcccaatcatgaaggctacattctcatgactcaatcacttcccaaaggctccacctacctaatatcatcacattgggaactaggatgtcaacacatggatattagaaggacacaaacattctgccttctgccgtgtgaggacacagggagaaggcagctgtgcttaacagagccatgtgagcagaggcagtggtgtgaattagatctgtctggcagatattaaaagtcagacctgctagtgaaagataaggctggagacttcagtgaggcagggtgatatgatggacaaccttgaaagccaggcagaggaacctgagtttaccttgtggtcctggtattcagggaagtgaagagttttaatgaaaagaatgccgatcagttattttccttgtatatggagagaatacagaaaaataaattaaactagaaaagcaaacattttagttgaacatgaaacattttaaaactaatacttaagcaatggatgatgaagtaaagaggatcctatagaagaggctccaatttgtgaacatcttctaagccaagggattcagtgacccatccacttctggctggatattgatccagatgacctggattatccttaaattctagtctttcttgattttttattttgttcttcttccatcattcacttgacatttgtatactgaggatcaccttctggtattataaaaacttaagttatttcacctctttgctcaatttctttaactatgtcagtgctccccaagcttcagccaaagaccatcaaggacacacatgtgatggaacaaagtgggatttattaacttgttgcaacaaggggcactgaacaccatgggggaattgtgggctgtctcaataagaaggtgttaggaataacttctagtatttgaggctgtgctagataacttaaggttagcactcaactgggtgctattcagaagtgggagtaattctgtgagtattttgtgaatcctatctagagggaaggaagaacagagggaggataaagctatgattaataaggaggcagtgttcattcatattagccaggaaatgggaggttggggtagttttgtggtctacacaaaacccgctatggttttgtctgcgcttagacattacagggtagtctctttttttctgtttcattcatcactggttcagagtgaccttgtctaatttagtgtcctatgagattatttatgttccataggaaaaaaatatggccctgctgttaggccagttcctagcaacaccgaggacaggccagttagttagcgcctagccaggtctctatgttaaggcctgccgttctcttttttacctgtgatctgtgtctctgttaattggaatgggagccttaaatgggccaggcaaggagtttatcttaactctaccccttactgactgtgtgatctcgtgcacatttttaactgtcttcaagacagtttgctctttcatgaaatggaataatgcttaccccccatagagctgttgtgaaaattaaatgaaaaaacaaaacataaaaagcctggcacatagtaatttctcaataagtcactgcaatttttattatttgcctgaatatttggcatgacactcaatgtgtaagtgcccagttgaaatagtttccttatcttttctttgaaggtgagaaggctaagttccttttatatacaaaaatgtgttctgtcgaacactatcactgcaaggccatttactaaaaatgtttatgggatggaatctttttcagcacttgctgtcacctcagcgggccccagagaggcttattcagctggcagagggcaatctgaatacactcgtgaccgaaatgaacgagctgctgaccagggtaaggtggcaaaattatgaatcttctgaaagcagatagattatgtcaatgaaggaaaattacttcaaagttctgaaatgcaaatcaccttcttcctaattcccaatttggtatataaaatagatgtattctgacttgctaattctgcttcaaatcaaatcatagaaatcagtagcacgcagaaaaattggggatacctggaaattgtcaatggctaaaaagtccagaatgacagtgtattttgagaactttattcagtagcctccgtggtaaagtttgtatctgttctgatttccaaaagcactatctttgattgtgtaaagagaaagaaaaacaaatgaaaatacttgtggtctctttcatctcatcgtgggatttttgcattagtatagaaatacagtgtaaatcagtctttccacacaaaagaggaaatcttctctattgtgagactccaaagtgcttaagacactttttaaagtcagaatgtaaagtccatgttgcatttatcaggctttttaaagaattggaaattttaaattttcaaaactgcgatggtattaaaaactttttgcagttagagaatgaagaaaacaacataaagcccgccatcttgtggccagaaatatgcatgaagctagaaacggggctgcaaagtacggatttaatttgattatctaagagctttaaatgataaagagtattggagctagaaggttcctggggattatcgagtccactttgtattttaaagaagagctgcctcgggccatgacagtgaaacgaattaacaatggccatacaatttgctaaactcagggacttaagctggacccagtctcaagattcccactggcccagtactttttctacatagcctgctgtcggtttaggaaaatatccacaggaaaatcaaataggcttctgagcacataatgctaaacaacggccctgatgttacaatagcatactaaacactttttcagaatctcatagcaacaatatagaatgtacagatacaacacggagtttcttgccaaatgtatgtagacattagattaaattgagtgcatttatctcatattaatttaatatgaaataattcatatttgttataaataagaattttctaacaggtcatggtagaataaatcaatttaacaagcacacataaatgttcataacatacaaagcctaagttacgtgttggcagatgaaaaatatgaatgaggctcaatctgtcttcaaagaactttgagatgtgtgtgtgtgtgtgtgtgtgtgtgtgtgtacatcagcatttaagtgtatggaggaccatattagacaactgcatgcaggtatataataaaacatgaaataaaataaagtcggaagaaattctggagaaatatttaataatagaataatttcatctgcttaggggtaattagaaaaaatttcatgtaataaatggcatttcattcattcattcacttaactaatactttttgggagtctctcatgttctaggaattatgacactggggatagaagtgtgagcaaaactgcacagtccttgccctcattggcttagtatagtctaatgatctgacgttagagacacaagaagtatttcttttttttttttttttttgagacagagtcttgctctgtcgccgaggctggagtgcagtggtgcgatcttggctcactgcaacctccgcctcccgggttcaagtgattttcctgcctcagcctcccaagtagctgggattacaggtgtgtgccaccacacctggctaattttttttgtatttttagtagagacgggtttcaccatgttcgtcaggctggtcttgaactcctgaccttgtgattcgcctgccttggcctcccaaaatgctgggattacaggcatgagccaccgcacctggccacaagaagtatttcattaagagtgtcagatctttattatgtctcaacctatactctttaccctttccagcagattgtctcatgctatgttttttaaacagactttattttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattctatgggtttggaaaaatgcattatgacatgtgtccaccgttgttgtaaaatatagaaaagttttactgcccgaaaactcctctatgcttcacctattcatacctccctcttccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatttcattgtttagacatatcactgtttacttattcattcccctactgaaggacatcttggttgcttccaaattttggcagcatgaatcaagttgctgtaaacatctttgtgcagacttttgtgtggacttaagttttcaacctatttgggtgaatataaaggagcatgattgctggatggtatggtaagagtatatttagttttgaaagaaattaccaaaatgtattccaaatggtcttttctattttgcattcccaccggcaataaatgagagtttctgttgctccacatcctcaatagcatttggtgtttttagtgtttggattttgtcattctaataagtgtgtatggtatctcattcttgttttagtttgcaattccttaatgacatatgatgtcgagcatcttttcatacgcttatttgccatctgtatatcttctttggtaaggtgtctatttaggtctttttccattttttcattgggttgttttcttgtcgaattcagagttttttgtatattttgggtaatagtcctttatcagatatgtcttttgccattatttgcttcccctctgtggcttgtcttgttctcttgagaagtgtctttcacagagcagaagtttttaattgtaacgaagcccagcttatcaattaggtttctccttgttgagcctttggtgttgtatctaaagactcattgccatatccacggtcatctagattttctcctatgctatcttctaggagcgttacagttttgcattttacacttaggtctataatccatttttagttaattccaatactattttaaaataaactttttactttacagtagttttagatttcaaaaaacttgcaaagagagtaccaagagccttcacatactccattcccagtctccccattgttaacatcttacattagcatggtacatgtgtcatatacatgttatatacatgtgtcatatacatattagctcatatacatgagctaataatattgaaatattaccattaacccaagactgtattcatattttttcagtgtttactgaatgtttttttactgtttcaggatcccatgcaggatactacattacatttagccattgtgtcttcttagggttcctctagactgtgacgacactgtcaaaaatactgtaacagtgtttctgatgactttgagagtttggacaggttcgtgtgtttggtaagctgtccctcaattggggtttgcctcatatctttctcatgattagaatggaattatgagtttttgtgggaaaaacttcagaggtaaagtaccatgttcatcacatcaagaacccatgtgaccaatatgacttattactgtggatattgaccctgatcacctgactaacatagtgtttgccagatttttccactgtaaagttactcttttatgcccttttcatactctaatactatttttatctgcccattcttcagattcagtaacataaaaggcgcagaaataggactactgaaagcaaagatcactttgatgggttgagaagggggaggaaatgtaaatactcattaattacttttttcctaccatatttataattacaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaattaccaggagccctatctcacacccataggttgtgatgcagttggtctggggtagagtcagaccactgggatattcaagaactccccagattatactgataaagaattactgtgatcctgtagttacctaatagctaagactctcttccctctggaaaatgccttaattggtactgccaatcttttttttttttttttaaacagagtttcacccttgttgtccaggctggagtacaatggtgtgaactcagctcactgcaacctccacctcctaggttcaagcaattctcctgcttcagcctcccaagtagctgggattgcaggcacctgctaccatgcccagctaattttttttttttttttttttaagtagagacagggtttcatcatgttggccaggctggtctcgaacccctgacctcgggtgatccacccgcctcagcctcccaaagtgctgggattacaggcgtgagccaccatgcccagcactactgccaatctttgttatgctcctttttctctgcttggttggctcaccagtcacttgatacagtctttagatttaagagcacatgtcaaggttgatcctgcatgactgctgtaggagctaccctctcttctttaagggcttttatattttatactcattgtttttaaatggagaaatctaattccctaatatccctgggtaaagaagacattattccacccaagaactcatatttaaaatgtattttgatatattttaattcatgtataaatataaagtaaaaaaattacataatcatatatctctttcaatgcattttgatttgttgccattttattttactcactggaagaacccaagttcctcacatatgagaatcatgtttaacatattcaaactgccctacagtatgtgtgaaatattaagatgctttttgatgatgactctacttacctctatagctattgtccttagctcctttcttttttcagagccaaaattttttaaagacttggagacaagtctgtatttatttctcactccactgctgcctggattttcactcccagcccactactgaaactgtttttataagataaccaatgacaatctggtaactaaatccactggatacttattaattttacttgaaatctctgcagctttgatctttccttccttcttaacatactgtcctctctctgtttttctcttaattctccaacctttcattctaaggctcttcctctcatcatcccttcaaagtcggtgttccttggggactaggcctcagtccatgttttccctcactgtataacactttctttggtcttcaattgccatgtacaagctgttaattcataaatctatattttcaaggctgacttcattctcatgctttggtcctatgtgccttactatggattggacatctcaaactaaactcatcatttcctcttaaagcccattatttctcctgtgtagaacatctcagtgttttatccgccagtatatgcccagtctcccaaagagaaattagcaggttgcccttcactctactccctctttcatccttcatcaaattcagtttccttctatggtgactctttgtaagccttatccaactctaacctgttgttatttatatggcagagtgaacattctaaattgcagatcctatcatgtcattctcttccttaaattgtactatggctttccacttttttcaggatgacatacagtgctctcccaccatgatctaatctctgcttctctctcatctctccccactactcatggtctggtcatctggacccctacggattgagggtataagccagaaacctacaaattttctttggtgcctctttcttcctcatgatgctcctgcttatccaattcattaccacacactgggcttccacttgtgtgtatggcattcatctctactaccccactctcatccaatctcatattgtgtagtttgggattaccacatttgttttttagctggtctctctgcttttactcttgttctcctccaaatctgttctccgtaacgtagccagaatgaatgtttgctattccaaatgtgaatacgtcatcgcagtgcttacaaactcttcccctgacttcccttaggctcgtaggataaagaccaaaattctccccttggccacatctcccatcacttgtgcccctggccatctgcactccagccatactgtcccccagccactttgtcccaccacaaagcattgccacacatttctttattttgccttaaaggtaatctacctctccctacattttgttaatttctgttaactccaatttacctttcaaatctcagctcgtgaaagccctctgtgccatcgcaggggttccaagattcctcctgtgcttatcttataccactatttttcctctagtttgtagttataaatttatctacatgatcatttgacaaataactatatagtccaccagactatagactccaaatgggcaagaaacctttttgtttcttaccacagtatcaccaatattatacacataataggtgttaagtcaatatttgtttaattaattgtgaatgattttaaaagcatttgaacaacaagatggaaatgtagacaaacccaaaataaacatttattttgcactctttaaaatgtgttaaaatcaggcatatatttataattatattgttgaatattttgttttcattgataaacacctcttaactatttatattctgtaaggggagaatgctatgtagtagattgaactgtataaaatattaaaattttgtttcacttatattgtattttattgcctattgaatatcaaatttaatgaaaatgaaacatttccaaaaggatgaaactagtttttaaacgatttaagtgccaatattataagtttacaagattttatttatagtttttaaaagatttcaactgctaacagtgttttttatttctccttttatatttttaaaagatatatatataatataaaacaagtcatatctttttggtttggaacttttaaaattggcacgtgaaatatttaggaagaaattccacatggaactggctcattgtcattccacggggtcagctggttgctccttctttccttgtgtgttgttggtccttatggcttgcctgatgagtgcttcactaccacttagacatatggagctggtaatattggaagatgacccttgagagtatcatataaatgatttgatctgaaatctaattttagcaggaaaccatatgagtccacaaatgcaaaggtagacagtatctaagcaatgttatctattcagtagttaggtttgctccattagattctagttttaacataaagaaggcagaaaatgaaacacactggtcatatccaaccaagaaaattatgtgcagattttaagaggcacagtagaactgcttgagctaaagcaggaaagtaacagctacattgttcagaagtaaattaacgtgtgcctaatggtaatgcatgctgcctagacataaatactctaaaaaacaaaacaagaaaaaatagaaaaagaaatgggaaaaaaaaaacctagttgagtgaatgtcaacataaaagaaaaggtaatcaaaggcaagagagatacaagatactgtgtaaggcatcatttacaaaggaacactgtaaagattgcagaatagaggtaagagaatgttaaaataagaaaatccaagatagagaatgaaaggaagattgtacaacatattaggataaatgagaagttatttgtcaaatactcaaaggacaagataatagtgaataagaagaaggatgactaagagatggagatggtaatttaataaaacacagaaagagccaaactgaatcagacagatagttcctatcatgtagtatttagcattcattcataacattatcaatagcctgtcctgggtgagattgatttttgtgaattttgctttggcagtgataccactatctatcaccactacccataggtgatagtgcatttgtcataggcttctttatgaagtctctcgtgggtatttttgaccagggtgaatcttcaacttaattactgtgtaatgagacatgatttttaaaaatatatctagatgatgttctgatatgattttgaaatgtgttaattgactgaaagtcaaaacttatatacttaaagtatacattaactggagcagtgtcctccactcacctagaatactccagtttttcatgtattttactactctttctggatgttagccaaacacaaaatagtgttgggtacaaacaaaatataagtctgtgagacaaaaaaaaagtgtatttcatctccaattccctgtacatgtaagttcagataagttacttaacctcctcataccttccttttcacctgtgtaaaaagagggatgatgccttctatatatctctaaattcaggaagagtaagtgagacacacgagagtgctgtaagcctttgcaaacatgtatataaatttggcataactattcacaatagcaaagacatggaatcaacctaagtgcccatcaataatagactggctaaagaaaatgtggtacatacacaccatggaatactatgcagccataaaaaagaatgagttcatgtcctttgcagggacatggatggagctggaggacattacccttagcaaactaacacaggaacagaaaatcaaatactgtatgtcccacttataaatgggagttaaatgatgagaacacatagacatgtagaagggaacaatgttcactggggcctaccagagggcggaggatgggaaggatgagaggatggagaggattaggaagaataacttatgggcactgggcttaatacctgggtgatgaaataatctgtgcaacaaaccccattatgcatgggttttttttttttaacctgtgtaacaaatctgcacatcctgcacatgtatccctgaacttaaaagttaaaaaaatataaaaaatacaagtaattctgaggtacagatgagcctgactgtgtaactcatcctttagcatgctaacccgcattaagttgatgcttttggtgccgggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattctcatgcctggctcttctcccaagcttcaactgtagctcttgagcagcagcttcctctgagcttctaaaaaatgcccagaaaattgcccagccaaccacatttcctggcaagcatagcaccaggcatatggtcagtttgagtgctattagataggctttagaacttccaagggatcattggtttgattgtcattgtatccaccaatcacccaacatctttgacccacgacaatttgccagacactatgcttggcactctgaggaataaaaagagtaagacagatccctagccttttctaatctatctatctaatggagatatggcaaagcacctaacaaagtcactacccattagagttgtgaatagtggtaataataattatttttgaaaatctaagaaaagagagcatgtgctagaataggtaaggagggcttcactgagaagatggagttggaattgaatctcgaaagctggatttgttttggataagtagagaagagttaagaagcaaaagtatgaacaaaatctttttttgagaatgttccaaaaggaagtaggcaagaagaatggtaataaggttggcaagattggttaggaaaattgttttttagtcctgtatataacaactttagagaatatttactataagttaggcatcatactaggagctggatatatgataaacaaaacagaccaagttctcacccccttagagcttaccttacagttggagaggttgtcaataaataggtgagccaattactaagtaattctcaaatccatggtgctatgaaggaaacgtcctgctgcaggaagtgtggaaacctaggtagcaccctgggaatggccacgctaaggagaagcacttaaactgaaagctgatgggtaacaaggacccagtctttacaggtgttgaggagaagctcattctaggtaaagacaatgggatacaagaaggtgctaagaagggatgagttttgcatatttaatatactaaaactatgccagggaggttgattgcatagggtcttagtgctaattgttttaacttctttcttatcatggagtttgtaggattcttgacaatttagtattgaagtaatcatataatcaatactaagaataaaatgcatgtgaatgatgactcttacacattactacgtaaatgaaataacctgtacaacagatcataagccagaggaagttaagacaatgaatatgatcttgatcatccagaatttaaaagagacagtgtatgatatacatttactttttaaaatttagacactttgagttataaataagaattggtccacttggtgtgaaattatgatcttttggtaatacagaaaatatattgatgaagaaaaagaatatattttaagtttaaattataatgtacattttctgtaccataagagacactagtggtattgatacattaatccgtaaggtaagatattggaagatgaccaaaatatagatcaagttccttattatggtgttcagtaatatgtgaaagtaagagtggtaccataaagttcagtcaagtctagactagaaaaatatccaaagcagtttagactacgaacatcttttttttttcttttcttttctttttttttgagacagaggctcgctctgtcgccaggctggagtgcagtggcgtgatctcggctcactgccaagctgttgaccttagttagtgattcagaagtaacatttaaataattgggtatgagtatgtgtgtgtgtatgtgaatgtgtttatgtatatgtgtctgtgtgtaaaaagttatttgacccatcagacctttgagtgcaaacacgtgcaggaagccaagtttaaggaaattaatggaacataattacaacactcaccagaaaagcaaggatttgagtaacctagggattggatgcacagtttatcccaaaaaaatttttaaatccaaaagtgaaaataattccattattaatgttttagaagaataaatccagagcattataatactttggttaatactctccaaattattgtgtatatgtactgcaaattatacagaaaaaaaattttaattttccaatggattcttatcctttcatcctttcatttgtgatgttaacacttgcaggatgagaagttagatgataatagttggactttatattccttcatttgtgcaaaaccttgaaaactttcataaattaaacctcttgctgcccttggaaaatcacaaaatgcagtacaattcctctagcgtcttttaccatgttctgtgctggccagacatttagttctatttaaaatccacttacgtatattttaaatattaattctctggccatgcctagtatgcaagcactctggtacaagattctagagtgttaatatgctgccaacttggaccttattcaaaactatattgagacagtttgtgattctctaattcattatctgtagttagactatccatatctttttagtaaaagagaagaaggcttatatattagcatatgcaacacatagaaaaatgaagtataaacctttcagggtactctaaaccttgtaatttttaaagaaacaatgttatacacacaccatttttgtttgactaaatatggtatattttaaccgtgaacacgttgaatgcattccagtgtgtcaaatgatattttaaatgtaaatagaggtgaatgtgcctgagaatactctttgggaggtggggctgttttggggttctgttttactttgctgacactgctgcatgattctgtgattaacaagcatatttctggtgctatcatatggaaaagttagcatttattctcccttaacattttattggcatctttgatgtgttataaaacaggcatttactactgagtagctaagcatttctccctctttgtttctttaattaacgtattgatctaaaacaaatctataggatcaagcttattgaggcagacagcctgtttgtctctcaagagatcattgctgcactccacacactttttcagtaaataaaatatggacaaaactgcaacatgtggaggctgaagattccattaaggacttttggcatctgtaccttaaagatatttcaaaaataattgtgctttattgcttcttctctgccatagcatataacaagcgttttttaaaagaccaaatacagctctctgatttccatttaatggaagaagtaataaagtttaattgtatacgtgagcatggggcatcatttgcaatacatctgatcaataattcatcgattgccgttggctcaaagtaatatttgaaagaaaatgcagccagtgggagcttatctagctgtagcttcatcatctctattaattatgtgtttcccgaatttggatcattaggctaccaaagtgacagcagatggcgagcagaccggacaggatgctgagaggaccaacacaagagcaaagtccctgggagaattcattaaggagcttgcccgggatgcagaaggtattagaaagaatcacattttaatcatcatttctcccaacagaaaaacacagaaagggatgacacaggactggaatttctcttgttataagtgacatctgtaaaatcaaaggtagagtttcaaaaagtagtgtggttaagatattcaagggtattatctgctgagaacctgtgacctgcagtgttaaattagcgacaatagtgaattagtgacaatgagggcagaatagcagtaaattcttgtaacatggctattataattacataagaataggcaacttttgttttgttattgtttttatttgaaagtatttaaagtatttttcattttcaagcaagctaatgtcatcattccacttgatacattaaagcagcactttagtttctccaaatggcttttcaaatactggggactggtttttaatgaacatctgttgcttgggatttggatgtgctactttatgagaagctctggtgcatttagctcacaattctctaggagttagttcttgccatctactaacatgaatgagaaagtggaagccattttttggcaaaagcccaaattaagaaacttaaagaatacagataatgccccatccgcactcgccccccaaaaaaacctagtccttaaatatctgttaaaatataataaacgtgcatgcatgtttagaaattgggaaaaatgctttttgttgttttttgcttgaagcagtaaaacatttttcttgctctgcaatattatgcattttagatactttgcttcataatgtagccaaataaataaggatgtgagatcaacttcaaggcagattctgactgataattcttaggcatcactggccaagaagagacaaactcccaaatgttcaccactgcaagaagcaacagggttttaatttgagagctaatttgaggcaaaggtgtgaggttctgaaacagaaattatttctgccagaaaaatctcagttaattcattgtggtttatcctctgctagatgaagctgttgtactttccctagtattattttccattaatgctacttgaagtgtccccctccaacccaaaacaacaacaacaacaaatcccactgcaggtagagcaccttcactctgagcggatccccaaaggccctagtcaatgctccaggaactttccttttctttccattgacatttcaaacacccaacacctagcagcccatcctggggactcattttcaatttgtttcaatcaaacactggtatgagaataaatgctagcatatgttttagtagatcctattatcaacactgcttactttgttctctgcaatgaaccttccatctcccaccaaagagagatgcatattcatggttacctctttggtcaatatgaatatttgcttcttctgggtgcctagggcctctaggtactatttgtacaatttgtggaccaacaggggtagactggagatggagatttatcccaggcttgctcaccaccccaaatcccacgtctatacaccagagaaaggattacccatcaccaaaggtgtctctcattccctaaattatgcatagatcaagtggtctgattgtgtctgtccagatagggcacccttttctaatttatgtgaagtgccatgtgggatagctatactttagggaaataagaacaccactcacttttgcctgcaggcactatttggtagaattaatccaactgttaaaattgaatgaaaggtcaaatttaaattgtaccagagcaacactaaatgttcattgagatgtaatacaaagcttggcagtttaatggagaaaaaaagagaaagtgggggaaggaagggaggggagggaaggaagagaggggagggaggaaaaaggaaggaagggagggagggaggagagggaaggaagcaaagatggaggtaaaatagctgccacgaaccctgatagtttcaggccttgactgcatgtccttaggatctcacgcttctctgtttttcctttgggttccatgaaaaaccccgatattttggtaataaacacccttgggttgctttgcctggcttgaagattttgcttacaaactaaagaactgtggacaagatacacttcttgtctcaagagggcctgtatattttaggatttaactgcgtgtacatggaaagaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggttttctgtctactaattctttccctaatttatacaacttttttttttacctgtagtgctatttccttttattttaattttatctgatattaggatttttaaaaaattacctaaatcctcctttgaattaagttggaaataaataagtaaattccaaagatacatcttttacaatcattttcaatactgtgggaaagaaaatatattgaagtgatagtgcatacttttgaataagagatgaaaaacacattcatctttaagaatgctcagagaagttccagatcctatttatacataggatctggaactatatatatgtatataaacataaaactgtatgtttatatatgtctataaagagtgaaacagacttctattaaaatgatgcttcctttccttttttggtgggggagatttctaagaaaatcatattgcctagcaagtgatagatgcctatgagagaaatggaaaatgacagcattttaaaatttaactttcagtagaaaaataatggaaataaaaattaaactagacagttcaccatacaaaaataatgttaaatgagggtaagtaaagcgcagtgaaataatctggaaaataactataaaactttaaaacactaataataaataaatgttatccaaattaaactggcaagttttaatgggccatgtgtaatttatctgtgtcccgatgaggccatatttttctccaaaacccatatctaaaatttgtttttcataatgaagataaagtagcacacataccaaaaacccatttgaaagatgctctcatttaatccaaaaagatactgaaggcccatgtccattttggggagcttgtattttttttacataacatgggttgcaacaaaaagctggccatggaatagcagtttattccataagcagccaatatatttgctaaaatgtttgttcttttggtcctaaccacattgaaatcttctgggactatttcaataacagtaattgcaacaattgataatatccaactggaaaaaaaaaaacaacctcatgactgagctgcacagtgatgtcctatagaaactttatggggtatgtgttatatgttttgatgtttttcttttttttattctcatgtttttattttcctttttactttaagttctgggatgcatgcacagaatgttcaggtttgttgcataggtatacctgtgccatggtggtttgctgcacctatcaacccatcaaaagaagacatttatgcagccaacaaacatatgaaaaaagctcatcaccactgatcattagagaaatgcaagtcaaaaccacaatgagataacatatgacaccagtcagattggtaattattaaaaagtcaggaaacaatagatgctggcaaggctgtggagaagtagaaacacttttacactgttggtgggaatgtaaattagtttaaccattgtggaagacagtgtggcgattcctcaaggatccagaaccagaaataccatttgacccagcaaccccataactgggtatatacccaaaggaatataaatcattctactctaaagacacatatacagtatgtttattgcaacactatttatgcaaagagatggaaccaacccaaatgcccatcaatgatagattaggtaaagaaaatgtggtacatatacaccatggaatactatgcagccataaaaaagaatgatatcatgtcctttgcagggatatggatgaagctgaaagcttcagcatcctcagcaaactaatccaggaatggaaaaccaaacaccacatgttctcgctcataagtgggagttgaacagtgagaacacatggacaaggaggggaacaacacacactggagtctattgggggttgtggggagaggaaaaggaaagcattaggacaaatagttaatgcatgaggggctttaaaacctagatgatgggctgggcgtggtggctcactcctgtaatcccagtactttgagaggccaaggcaggcagatcacctgaggtcaggcgttcaagaccagcctggccaacatggcaaaaccccatctctactaaaaatacaaaaatcagctgggcacggtggcatgcgctataattccagctactcgggaggctgagacagtagaatcgcttgaacccaggaggtgcggtcgcagtgagcagaaattgtgccactgcactccagcctgggcaacagagcaagactccatctcaaaaaaaaaaaaaacaaaaacaaacaaacaaaaaactggttgacgggttgataggtgcagcaaaccaccatggcatatgtattcctatgtaacaaagcttgctttcttaatacatgatcattttgctaaagtcatttttgtgcaccttaatgattgcttcttgtttacaaatggttttaatttaaagaaattatgtatgccatccaaaagatacagccatatttgccttttccctttctctatctgttgtcattctttttccaccagattcttctctgcagaagtttagctttgagaccagagcacaagagaaatagtgagactctgtctctcatttttcccttcctctatactgcctaggcccagaatctaaattagatcaaatttcaaaagatatttcttatgaaagctgatttatacacgcacacacacacacgcgcgcacacacacatattcatttaacaaagaaaaaacatacagctttagcaggttgggaagtggcatttattaatatcatcttcattttaaaaagtgagtacaaattatatcagtagttacttacatgctacaattggttaaagtcagctatacagatagcatgcactcagactaaaggatgagatagtaccataggtagagccaaatctgctactgctttcttgaaatctaagaagcagaaagcttcttacatttaatcattggtactctggaaggcttcccacctagtttgctggaccagggagctttcaaactaatcagcctatggttactgtgattctgtaacaaaattgagacacagcctaggtgatgtatcttactgacaatagtggtgaaatattgggaggattctttggcatatgtcaaggtataactgttaggcagtgggtcaagaaagagccaccctcactaacttctaggaatacagcacctgacaataacttctaccacagggctaggaatggccatatttgttctttaagacatgtgattcaaatatttctgctaattaaaccatggctgtcttagcccatttgggctgctataatgaaaatatcatagattttgtgccttataactgaaatgcatttctcatttgtgaaggctgagaggtccaagatcaaggtgctggctggtttggtgcctggtaaggagctgcttcctggttcagagatggctgtctccttgttatagtttcatgtggtagaaagggcaagggggttatctggcatcccttttataagagcactaatttcattcttgcccttatgacctaatcgcctctcaaaggctctgtattaatctcttctcacgctgctataaagaactacctgagactgggtaacttatgaagaaaagacgtataaattgaccacagttctgcaggcttaacaagaagcatgactaggaggcctcaggaaatttacgatcatggcagaaggcaaagggaaagcaaggaccttcttcacatagtggcaggaaagagagagaatgaaaggggaagtgccacataccttcgaacaacctgatcttgtgagaatttattcactatcacaagaacagcaaggggggaggtttgctcccatgattcagtcaccacccaccaggcccctccctcaacatgtgggtattacaacttgagatgagatttgaggtggtcggtggggggacacagagaaaaaccatatcaggctctgcctccaaataccatcacattgggaattaggtttcaacatatgaatttgaggagaacataaacattcaatctacagcattggctatcagggttaaagtactgactacaggaacttttaaaccaaagacatatataacgaaaaaagaattataaagatgcattgtggaaagggtatattagacattgaaactcaattctttctactatcccagtgtttctcaagctctagggtacatcagaagctctgagaaggcttgttaaagcccagattgctggtcctcacccccagaatttctgagtctgtaggtttgtggcagggcctgagaatctgcatttctaatgggctccaaggtggtgatgctgctgctgcttataggggaccacattttagaaccactgtactgacccaccttctcacatacccctctgcctgctctgcttgtcctgactatgtacacctgtttcaggagctctgcccagtgcaaaactctctccaagaatagaaattaattttcaggaatctctatgtcataaggagatcttcggatacacccttgaatggtagaaaatgcctcttggccaaccgagacccctcattctaggagttttcaaaggtaatattatagaaataagtattcagctgacaaaagagtttgagaaaacatctctcttaaattcaccaaaaaaatgtcctatagaacacactccaggaaactttagtctaaaactaataatataactgtgtaaatgtttcaattcaccattttaaacttttatttgacgtagaattcttttctcaaatgaaatcctgcccagaacatcagcctataaagcagactcttggcagaatagacatcatttgtagaaaacctgaagcacctggagaatcctacgattccaaggagtacagtttgaaaccccatttaatgcataataaacacagacccttgtgaaggatgctattgctggaaagtgtccttgaagcctaatttataacccttctcctagaagggttataagtctagaccagtgcttctttcttcactcctttaaaaaatgaacacaggagaactatgtggaaatacaagggcaggttcattttcagagatctcatcactgagtgtatttccacactcagtatttttaaactgactgatagccactgctatgactatcttatcagcaatgcagagcttgcgtttccagcctccaagtgttatgctacaggtcactgttttttttaaactcttacctgagtatgcttcgacctacttctttattttaattctttctttcttttgaggttagaaacaccatgctttaattgctgtaacccccaaaagaaatataatattgagaaacatattacatttccctgtttgttactgattgttgtcttaactgcctctgtggttcccagcaggaacactcacggcaaaatactcttcatttggagatggtggtgcccagcagatgctgaataccatgttttcatgtggcatgtttgtttactaatttacaaaatttgttttaccccctgcagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtgtgagtagatgagttattattttttcttttgacaaactgagatttccagataatttacagttttctaaatttttatcacacgtataagtaaaagatgctttgtttttccaacctggagatatttgctatgttatctatcatctatctatctatctatctatctatttatctatctaccatctattatttattcatttacttatttaattgtactttaccattgttccaaaatgaatcaaaagcatgttcttgcctacatataatcaagtaaatgatcttttctggtgctgctccttctgtaattaggctaatgagtttgttttgttaatcatctgcattagggacttttggactatcagttgatttttgttttaataaaaatacctttggataaacaaagttatgactttaccattcatatattggccaacctatacattttatcatcttaagaaatgctgaaaagaaaagtcatcaaataataaacacctaatactttcaaataagagttgcgaatatgagggttgggaaaagtgatagtgattttacccatgctaaagaacttttatgataacgcactcaataaaatagatacatctctacattcatagtcagctaacttcaaagtggtagtattactaatacttaaataatttatactaaaccagcaatatcagcacaccagagaacttgttaaaaatacagattgtcagaccccctcccagacctcctgaatcagaaactttggggatgggacccagcaaaccatgtattaacaagcccttcaggggattatgaggcatgttagtttgagaattactgtctttcaagtatttagagtttcttaatgactcgaaaattatcactttagaaaaactaggtaagttaaatccaaaaacttccagatcaatcagttggaagaaaaagaaacatagattaaaattatgctagtctactagcatgacaatgacctagaattctgttcacagtttctgagcaaacataacaatattcatcattacattcaaagtaatagagaaaaggtctcagtacaatgaaacaagtggattgtttgattttggtatgtgaagtgaatcttaaaactcatttcatcaatcagattcctagaatgacatgattcaaaatgttattttacttacaaatttaaaaggtttcttaaaaatctgtttcgcttttattttaattaattataaatggtctcaggtaccagttttcaacttgatttagcacacagtgaatctattttacatgttttcttattttctcattcttttcatgttagcatctctttgtaacatggtttaataccaataaaccctaaggcagtgacatgagctcattgtctattattgggctgggggtggttacagagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggaggtgagtcttaggggcacttttatcttaatctcagaaggttggggactgcgggggcagtgttgaacatggctggactattcaagttgatgcacatttacaaaagtcaagagtgacaactctgaaagggggcttctaagaaacagaacaagaaatgacttttttttgtttttgttttgtttttaatgaccagttaccatcgcccaaagaatcaaataaaattttgataaattaaactgttgaagatatttaagaacactgtgatacagtggaagaagttctttacagggagtcaggcgaccttggtctcaatgacaactgtgccactatctagacatacaaattgggcaagtcaattaatctgtaagcatcagttcttcaaatctacaataagtgcattatactatagcatacatatagggtatcttcaaatattcatatcatattattttgcagctttcccaaactaattcacaaatcttgttcagagatcttgctgccaaaaatcatagaagttccctacactttcaaattcaatctgagcacatgacaaatagctcaatgaattgagaccagagcttggaaaaattttggttcctctttttctatgcgctgtgttctatgcaaatgatcttttagaaggaactaacatgaatagatcaggtctgcgttattttctcctccttttccacacagataacagttacttctcaactcaagaaattatgggcagcctctatctttttaagagttctgatggaactagaactaaaacagattcctccattattttttcttcttttttttccaatttctttcttaatcttaacatagtaaataatcacttttcctaagagtaaactcagcacatataacagcagcaccctgtatttgatattaatatttaaacaacaacaactttctccccagagacaaatttacctttgctgttttcaaagtatctgactccaacaggtcagaaaacagcagcagacctatacgtcttctaacacataatttcaccgtcaacagtaactcagcaccctctggcatatagtatgtatgtagaaatgtttgttgaatgacagtaacaattgaatacaatcaaccaggattttttaaatctattcatttctattttcctttagattaagtagtaagaggaagaattacatttttttaatatattttatttccgtgtccctcttctgggacttagccttgtcattctggtagaatattgaagaggcttactttttttcttcactgatgcacctaaccaatttggagtctactgacatgctagcagtattccagaaatactgctgtgaggcaggatgctgggccactgtcctgtcacaggctccagcatgattcgccctgctcggtgacacaccagccgtgtgacttacccgaaggtgcacctgtctattttatggcaaccgtttgataaatgaaaattacctgtgtggaaagcatagtaagtatttgagaaatatttcaagaagagttatatggcacagtcaatagtacctttagctattcgtttcttttagtgatgtttaaaaccagaagtcatcattcttgggcacccctacaaatacctggagcttatgtatagtcggtattgaaattctgagtggtcctgtttggattttccttgtatgtgccacgtttaactaaagacttgtttaaaagttactggataaaatagataaactaactgaatcaatatgaataaggcatagattatttatggttgcttaaaccaaataaataatttggttgctgccaaaatggctgaaaatcacgtggggtgtttgttaagccaacaggtttcatgggctcccacctagagagtctgtgtaggctgctctggggtttggccccatgtgtacattctaacactctccctgggctaatctgatgcctatacaggttcgaggaaaactgacacattgcatctatttgattgaataataagctgcattttaaataaataactcccttataactgtgtccacaatgaaggtaacacaattaatacccaactcaaaaactttttatttattttaaggtggtatgtaattttctttttaaaaattttatcaagcctctaattcattcaggaaacgtgctagacaccaaaattgattgtgtcagtgatgagcccccttagagcagcagcctcagcgtaacctagcaacttgtcaaaaagacaaattcttggaccccatccctaaatgaccaactcagaaactctgagaatggggcccagaaatccgtgttttaaaaattcctccagtgattaagatgcagcttcaaggttgagaaccacgggtataaacactaaaacaccatctctgattacttcaagtaacttgtatttagtgggaggtacacataagcaaaccactccatacgctaccataattatcacaggcgtaagcaaaggagggagtctaagtcacccctgagtttaggaagagctttgtagaggccctgacacttgtgctagatcctaaaggataagcactgggtcacagaagaataaagagaagaacatttcagaaactgggaaaaacatatacaaaggcatggaggaaagaaaatgacattttgggggaaagttcagtggtttgataggcttggaaagaagactgcatgtgaacgactgaagggatagaaagaaagagaagataggcagagtgcagaccttcagttataagagaatcgcattgtgagactaagctaaggaattggtttttatcctgagagccataggaagcaattgaaatattgcagtcatgggttaaaataaaatgttgcagaatttgagtggctcactgaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtcaacctttcactctacataatactatgataatattgactgggagattcagcaaaagtttcacaaaaataacagcatcatagcagaagtggagaggaattggaagaaagacagagcaacaggaaccccagccagagctttggaagtgtaaggtgatcttaggaagtgtccagtacagcagaaaaactttcaaaagctacgtaaaaatctgtagcagagaaggctctggaatttggagccagatcatagaaggctttggatgcagccaactagatggtgatggagttggaaaggcatttccagcagtggagagagggctaagggaactggggacgtcatgggaagaaaagagaagacaaatatttcagtgaagcaaaataatatgtattgagcagtctatccccaaatctaccattatatccttgccaaagaaggcagtgcggatcaagtaaagagtaagttgctacataaagaatacacaggccagcctgagcaacatggtgacaccctatctctatagaaaaatacaaaaattagtcgggcatggtggtgcatgcctgtggtcccagctacttggaggctgaggtgggaggattgcttgagcccagaagtttgagcctgcagtgagctgtgatcatgccacagcactccagcctggatgacagtgagaccctgtctcaaaaaaaaaaaaaagaaaaagaaaataaaagaaaacaagaatagacaggaagatagcttttgcaggttcctgaagaatctaccacaccaacacaccaaaaaaaaagaaagaaagaaaaagaaagtgtccaatttgcaaagctctggaataaataaagatctaattaattacaagttaaaagtagaaatataatcaaccttcatatccaaacaataattgagcaattatacttatgccatactttttgtagaataattctccctatacataggccttctttctgtttcttaaatactctaagtttcctatcttaggtattttatatgctacatcattttctatctgtgcctctctttgtttttattgtactcatctaatctttctttaagaatatattatacattaatttactcattcattttatctctcctccacacaagccatgaggaacatgtgttcttcctcacatcccccaatcctagaacagtatctagcaaaggcaaaacagattgttttccgtgaataaataaagtgccatagaacaaacccagatactctatacttttgtcaatatttgtgagctccaaatttccatcttttctcggttcaaagctagaacccatcagtatctaatctgaaaacaagacacctctaaaatttatttaacctcatcccagcactctgggaggctgaggcaggaggatcatgaggtcaggagatcgagaccatcctggctaacatggtgaaaccccatctctactgaaaatgaaaattaaaaaaaaatacaaaaataaaaaaaattagccaggcgtggtggcaggcacctgcagtccctactcgggaggctgaggcaggagaatggtgtgaacctgggaggcagagcttgcagtgagccaagattgctccactgcactccagcctgggcgacagagtgagactccgtctcagaaaaaaaaaaaaaaaaaaattatttaacctcttgatcatcatttctgattgagtatgctaagaagcacattttgatctttgcttttacaaaagattctaactcactactttattgaaatcaaaatatatatagctcttcaattaacacacgtgtggaaatatcttccctgtttccagtggcacagcattttaaattaccttgatccattaattcaaacaagccatgttgtaaaagattcttgtgtttctgtacatgctatactttaagtcagctcatacaaaagctaagggctaaaattggcagttgtgtaaaagaatgttagacccttggaagataagatatgacttgtaatcagggagattgtaatcagggacattgggactcttcccacatttgttgtctgtgaagagtgaatgacatatcaaaacttcccctgaattagtgatgggagtagctgaatgagccaagtgtcagcagcacaagtcccaggaatggacttcattttcttttttctttcttttcttttcttttttttttttttttttttgagacaaagtttcgctcttgtcacccaggctggattgcaatggtgcaatcttggctcactttaacctccacctctcaggtcaagtgattctcctgcctcagcctcccaagtagctgagattacaggcatgcaccaccacacccagctaattttgtatttttagtagagacgaggtttcaccatgttggccaggctggtctcggactcctgacctcaggtgatccacctgccttggcctcccaaagtgctgggataacaggcatgagccaccgtgcctgacccatttttatttatttattaaaaaatatttattgaggaaactcatctacatactagagatagtgatatataaaactgtctttatggaatttgtgttacagtgcaggagacagtcactaagtcaataaataagcataagctacgaccataaagtctggatgcacgggctgataaacataagttgtttactgatatgtaataaatggtatgttgcatgatattgcataatagattcaatgtgttgtccttcattaacaatgtgtagttcaacaggctgtgcctttctgctagtccctgtacatgtatctgtgatgcattggtatttctgatttttattacctaatctttgtttttagcaactcccggcaaaagtaatcaagacgaatcaatctatataaaaaagaaaataatattgtctatgtttctaccactctgtagaatataattcagataaatgggttctaagaagaacaaaataaggtaattataatagttaaaattacagtgttactgggtgccaggcagtgttctaagctaattcttctccaattttacaatgtctatcaatcatgtggggttcttgttaaagtgcagattctgagtcagtagttcccaggaatggattgagattatgcatttctaatgagcttccaggtgacgctgatgctgctggtgaatgggctgcacattgagtagggagggactaaacattttgtatgaaggtaaattacttccttaaggtttcatagcttgggagtgagcagagctgtgatcccaaaccagaagggctgtcacttggatgtagcttttaatcactgtgccctagtacatagagaatgattgagacaaggataggtgctattttagataggtaatcagaggagtggctattaccagaatggagggaggacacaagccaaagagtaggaagagcacatagtgggaatatctgcaagtgcaaaggcttagaggcaggaactagttgtatgtacctggcaacatactgaattggtcggtgaagggaaggaaagaagggtatgaaattagcactagctcagtgcaaattttaaaactgtgatttctataatagaagagatagtattttcgtagtcaaggacccaggatctatcattaagtagacaggggtttaaatcttaatcacactgtactatgtgaccttaaaggaatcatttaatatcttagttcatctgagctgctatagcaagagaccaaaaactgagtggcttatatgcaatcaaaacttatttcttatggttctggaggctgggaaatccatgatcaaagtattggcagatttggtgtctgatgagggaccactttctggttcatagacaccgttttcactgtgtcctcacatggtaaaaggatgaacaagctccttcaggtcttttttataagggcagtaatcccgtttatgaagtctctgcttcatgacctggtcacctccaaaggccccacttcctaatcctatcaccttgaggattaggatttcaacatatgaattttcaggggacacagacattcaggccactgccctttacttattcaatttcccacttatgtaaaaagtgatcaacatgggatccaaagattggaataacaaaatgcttacaaactgtctggcacatattgagatctaaatgaattagcattattgtctatagaaaaaaactataagtggtcaaagcttaaaattataattgatgcagttaaatctgtaggtagaatggtgatttcaggaataggaatgaatcagaagtataaagaataaaataagtaaaaaatagaccccaaatggagaaatagcaatatttgtctctcactgattttactcttctaggccaggattgagtttcatgtacttttgagacaagctatatgttccaaagaaaaattataatctattctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatagattctagaattcaatatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaatacaaggggtaggattttatgaaaatgcaattttgatgtcttgttcataatggtctacagaaaaagaaggaggctgttgaaagcggcaaacgacaaattgagaacactttaaaagagggcaatgacatactcgatgaagccaaccgtcttgcagatgaaatcaactccatcatagacgtgagtattgggtaaaactcaaaagagagatgataatgaataaatgggagccgatgagaaagctcagtaatagaagcaaatactagtacttgttttcttgtggagataaaattatttttgcattattctactgtgaccatgcctatctattggtgacaactggaatatcactttgttctcccaatggacatgagtgtttgtgtaagtgtactcacacattcacacatatctgtttttgtccacagcgatgaaggacatttcttgttcctagagcagcacttacaatctgcttcaatatttatataacattagttaaaagacaaatgtaaatttacaaacaggcttttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctattccattaaataatgactttaattctctattctttttgctatgttagtaagtttgaagtttcattttaaaactaaacatgtgggccaggcacggtggctcatgcctgtaatcccagcactttgggaggccgaggtgggcagattgcctgagctcgggagttcaaaaccagcctgggcaacatggtgaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagttatgtctcatagagaaattagtaaaagagaggaggcttgaattcacttgcttaaaatgccctcttctctacatatcagtatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatgggtatgtcatttgtttttggaaatgtttgtgtattttgatgcttgtccaaaggttttgactagcataaatagtagagaatcattttcaaatcctgatttctgttaattatgaacacactagctatatggcctttctgtggataggcttaattaggagggtctgggcaaagctttgctacagcagcatcaaaagtctgatttacaagtagactcaaatatggcttagtaggaagtgaacatagccctaggctacacttagaaaaaattattttctgttctttattaaaaagcacagtggttgccttattagcattttaaataacatatatgaaaacacattctgtttcaaatttcagtttcatgtttctaatggaatcaaaacaatttattgttaaaaggatggcttttgaaaatttggtcccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaatagcggtgctattagccccaagaataatttgcccagataaatctacatcacatgcaaagctttgttctcatacttaatacttactgttataaagaaaaaatgctaatgtttgaagaccttggacaatatatgaactatcattttattttatgtcaaacttttgccactttataatgaagggtgggtggcagatgaaacacaaagctaggtatcatcagatccaggctctaagtccttacttggggacatattggtcatttggcctgaaacaggccatttaaccttctgaaattcacttggtctcttctgggaagtgcacctaccccagaaagattttgtgaaattaattccagtaatgtagtacaagtgctctgaatctcacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattccttttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtgtgatagtaagttggtagtactatttcaggttaaaaaaatctcataggaatcatcctgaataaaatgttcagaaccatcatttatttattttgtttcacatagaacctaccaaacacatgagaattttttgggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggtttctcttgagtgagccctactaatgccatatgttctgttgacttcttattcaaaatagtggcatgatcattgcagaagcatttctatgttcagttatcctttcagaatgaatctacttttcaaatctaaactaaattttaatccatcttctgttagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatcttttataccaataaaaatttgctgtagtaattgcttcatccttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaaatgtctgaaaaattacaaaataagtgctatagagaatcagtgatttattaaatgactattggataagaaaaagaagacaatctgtcccagaaattttgttggaatgtttttcatgaacagaatgaataaaattttagtttaatagatcagtataatatagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaatttatacatttgcaggagaaaaggaaaaggtcaagtagtagagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaatacgatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaattttttctcatcttagttgctttgatcctataagagactctaaaataacagagaattagatgtttttaaaacatttccaggtcatagtaaactcaaagcctacattatctatcagatcagatttttaaaattgatgaatgtattaatgttctctagaaggacagaactaataggatagatgtatacaagaaggggggtttactaaggaatattgacccacgccatcacaagatgaagtcccacaataggccatctgcaagctgaggagcagggaagccagcccgagtcccaaaacctcaaaagtagggaagctgacagtgcagccttcagtctgtggttaaaggcctgacagcccctggcaaacccctggtgtaagtccaggaatccaaaagctgaagaacttggagtgtgatggtcaagggcaggaagtatccagcatgggtgaaagatgaaggctggaagagtcagaagatctgctctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcgttcaatccaatcaagctgatactcaatattagtcatcacaagtccaccccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaataaattttatgtcacatgataaaggaaaaagaaagcaaatgaagatattttcctagtacaagtgtatacatgcacaaacatattcttaacagaataaggaggaaatatatgacaattacagtcttcatttctgcaactggccacgtggttgtagctggtattgatgactaccttcttctactaaccattatgtattccctttgccttctgcaagcacctcagcgggtcatggctttttacctggtggggtgacccaaacctttattctggaaggacctgtgccatttgtagtcctgtctggattgggttggattgggttgttgtagtttcccattgaccttaaacacagaggatggtaatattaagagatgccctatgggatctcctgtattccatgcatgctcttccttgccttcattgtggaatagtagactgatttcaccttgatattctgggtcaattacccagccaacactgaaacccccttcttagcctgttgacttggaggtaggagggccccaattggccaggtggtaatcttaacttccagtttaatggaatcattgttgtatcccttggtgacagcattcttccctctgggaactaagatgtctaggccagcagaacataatgttgtgggaacaggaagcaaaattttgctagtgggtcactagtggtgatggtgagtggtgccacttccgcttccaccccttgattctgggacccgtgaacactggctatgggagaaacagtaccatattttggacactgattcaaggcatacacagccttctggagaactttgccccagtccggcaaagtattgtcacctagttggcattgtaattatgacttcaaaagggcattccacaattctatcaatccacctgcttcaggatgatgggaaacatgataagaccagtgaattccatgagcatgagcccagtgctgcacttctttagctgtaaagtgagtgccttgttcagaggcaatgctgtgtggaataccatgacagcgaataaggcattctgggagttcacggatggtactcttggcagaaacattgggcgtaggatgggcaaatccatatccagaataagtgcctattccattgaggacaaacctctgcctttgcatgatggaagaggtctgatataatcaacctgccaccaagaagctggctgatcaccctgaggaaggatgccagacggagggctcagtgttggtttctgctgctggcaaattgggcactcagcggtggctatagtcaggtcagtccatgttgctgagcctatgcataacctccattcctgccaccatggccactttgttcatgagcccattgagcgatgacagggtggctggggaaagaggctgagtggtgtacacagaatgagtcatcctatccacttgattattaaaatcctcctcagctgaggtcacccgttggtgagcactcacataggatacaaatatcttcacagtttttgaccactcagagaggtccatccacatacctcttccccagattactttgccaccaattttttaatcatgcttcttccaagtccctgaccatccagccaaaccattggctacagcacattaattagtatataattacacatctggccatttcttcttccaagcaagtgcacaaccaggtgccctgctcaaaattctgccccctgggaagacttccctttgctactgtccttcagggatgtcctagaaaggggctgtagtgctgcagctgtccacttttgggtgctacctgcatatcttgcagaatcatctgtgaaccaggccctagtcttctctgcctctgtcaactgatcatggggaactccctgtgaggccatcagtgcaggcttggggagagaaggcagggtggcaggagtggaggccatgggcgtttgagccacttcctcatgcaactgacttgtgcctttaggactggctcgagcctgatcatgtatataccacttacagttgatgatggaaggctgctgtgtatgcccaactttatggctagatgggtcagaaagcatccagttcatgaaaggcagtttaggttgcatggtgacttgatgacctacagtcaaacattcagtttctaccaaagcccagtaacaggccaagagttgtctctcaaatggagagtagtgatctgcagaagatggcagggccttgctccaaaatcctagaggcttccacctctaggagtcacctatgggagcctgccaaaggcttcaaacaggatccctgtctgccattgacacctcaaggactattggatctgctaggtcatacggcccaatcggcagagcagtttgcacagcagtctggacttgttgcagagcccacttaaaattggcagcctttcaggtcactcaataaatgggcccattttaacacacccaggaacaatgctttgcatccttcaatacaatcaagttggcactcagtattaaccatcacagtgaatgaatagattttctatgacgttgactccttggaatgaccaccagaggcaataagcacactctcagtgacacgaggatatgaggccctcctctgcccatttacactggaaatgtcttagatgtcttagtgcttttcaatcaggtatatccaaacaacaaacaaacaaataaaataagactaatgcagaatgaattccatagttcagattcttcaagataatggaaaattatcacataatctccacctgttttgaaacattatcttctttccttcctttcctccctttctccctttctctaagtcagtggaatagtctagtttaactttgatgtagaaaatttaggcagtcctcaacctctctaggtatgctgaattaaaaaaaaaaaagaatgacatttttaattcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagataatagattagatgatagacagaaagaataagagatttattatgaagaattggcttacgtgattatggagcctgcaaagtcccagtatctgtgagctgcagatccatgatatagttcactttgagtccaaaggccagagaatcacgggagctgatggtacaaaccacagttcaagaactagagagaaaatgagatgagatgtcccagctcaatctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgttagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcaaatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagaaaatgtgtacaaatctaagtaagcattatggaaagcataatgataataattattaaatatgtggaattaaaaacaaagtggaactaaaacacaagagactaataaaatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattcgagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtaccatagcctagccaagtggatataaattaacgatcacaaacagctaaacattccaaacaagcagacagagagagaaaaaaataaagaaatgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatacagtgtagcctccaaggcagggaagagaaaaaatgaagagacatgtaggcccctaccatactggctcatgaagcctggaccacgtctggtctgagtcattgaccagaagtagccgtgtgccccaagctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctatgtatgacttacacaaatactgcaaatcttaggggaacagaaagactgaaaatgagagataagatacactatgcaaactctaaccagaagaaagctggtatgctaccattaatagcaatcaaaaagactttaatttttttaaaagaattattaaggacaaagaaagtgatcatgatagaataaaaggaacaaggaaaactaaaaaattatgagcctgcaaggtcataataacaaagcctatggataaataaagataaatatatcagaatgagaacattttcatatatataatagggaatgattttaccatatctctcttaaaaagtgatagatcaagcaaagagacacagattttaaaagtaccttacacaagataacttaatggccttatagaactctatgtcaactagataattaattctacatgccccattcgatgaagtaactcatgaaacaaacaaaggaccacaacctagatcataaagcaagtatcagcaaatcctaatgatccaatagcatctagactacatcctcttatcataatgcaatacaattagaaattggtacaaaacaattgacaaaaagttttaaaataaaaaacatacttcaaagtaatccatggcttgagaaaaaaacacagtttaaatttacgaagtatttaataacagaatggaaataaaatttcacctcaaaatttgtgtgtgcaaataaagtggtaccaacaggaaaatgtacagtttggaatgcagatattaggcaagggtaagaactgatactaattatctaaggtttctgctcaagatgtttaaaaaagtacacagaaagaaataaaaataaaagcagaaattaatgacctaaggaaaggcattagacagggttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgcgcaattttattcaaacacatttgaatacttaggtgaagtaaacagtaagtttagagcaaaatttactcaaaaagaaatagtacacctgagaactataaccgttaaataaattgcatcagtagttaatacaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatacagatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatgggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacctaacttttctctcaactaagctcacagctccaggatcaacaattccaaatctttcaaatattcttcttttactacatctcttagtaatattattgtgccatcacgtatttcattaagtggggcattatctatttaattactgctatgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcccggccgaaattatacactttctttgatcaacttctttttactccgtcatagttttattccccaccaatctcccccggacagtcactccattttacttagtctcttggtactattctcagaattcaaattttaaattaattaatctgtatttctgaagagctgtttgttttcttactgtatattttgctttctccatgggaaagatatgcttgggagcctcatgcagtcttggtgggagttatgtaaccactgggccagatatgtcagggcacacagcatggtgagccattccctggccagttccatcgcccagagccagaccctttgggccctacacagactgcacagccccagcatgtgggggcttgtataagggaagttctgatgtcacaggatccttggggtgtttcttcaccagctggaaacctctgtggccagtggcacctttgcctgagttttgctgaggtccactgggcacattccgcccactcagcctggcaggctacacttggctcacactaccactactgggctggatcccacacctgccaagggtgattcagggcagagtggcgaggggtgtgtgagtgagcgtgggctccagccactgtgcacagctaagcgtgccagctgcagtgggctgggcagctccaggtcctggctctatgtgaggctgtggctgaaccagacatactacaattggcttccaccactggtaccagggaatgcggtggcacccaggagcttggagatgccaggaaccacagagtctgaaagagggtctcacagccctggctcagggagtccataggtctcagctccccaaaaggccacagcccttctctcctgctcattgctgtcaacatggtgagctggggaagggggtgtgtttcaaccctgtttgtgttgtagctctctcatttccaccatttgcgggggggtcccaagttcttgtcccacatcctggaagaatgaggtttgcagacaactggagggttagcaaggtgaagaggtgctttattgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccggggttttttatgggcctcagaggggaggaagtgtatgctgattggtccatgggtggccatgagctggcccaaaaaaagcaccataagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatatgcacacctggctgggttgcaacagcctcagctttgctctgaaatcagcctgggtgccgggaacagtgagagaccaggaagaaggagcgggcacttctgagcctgtaggggaagagaggtggctgagggcacagggatgcctgggtccacagctggctgggtggctgcagctgcacccagtagggcagggttcccccaccttcaactcggaaggggacatggctcccacttgttcctggctcccaccagctctgtggagcacaaagccagacaggctgacactgccattactgagaccctcttgctctcagaagagttttcatcgcctgctccctctgttttcactgcttggtgactgtggtgttttgttttgttcctatttccttttctcagaaaagaaagtctttagaattaaaatttaagctgacaatagatcccctctccccagggagcagaaatatggatatccctaaaggtcttgagtgtttcggtctttcactattttatactcaatattccatgatttttatctagatatgcctggtggacaacaggtgatcgccaaatataggttgtccctcccatctccaaattctgatgctagaaatcaggaatggctatgatagtccagattttcagaattgataagatatttatattaccctaagagatacggaagttgaacagaataaaaaaattcaaaataaaagtaaataaaattactttctttccctgtttagtttgagatcatgtgtaaatatcagtgaacgtgatgtcatataggatttttttttattgatcagaattaggttcaagttgtgttctggaaacttctaattaaattgagggaagatgctagcaggccagaatttgggaattagatgatctggctccaaattcaatacatattgtctatgtaattagctgtgtcacctaatgtaccaataatgccttttcaagaaacactgtgcagtctgttctgattcctccattggcttaattcctataataaatatagtttccaaagtttataacttaattttcagaatttatttattttaattgacagataaaagtggtatatatttatcatgtacaacatgatgctttgaaataagtatacattgtggaatggctaaatcgaggtatttaaaaatatgcactacctcacatactggtcatttttctgtgttgagaacacttaaaatctactctcttagcaaagccatgctggctttagtgatttttttttttgtacatgatactctcatttgggtcaataatttttttaaaagtctattggaagcagagaaataaattttttgacccagccttagatgtatttaaaagttcagggcataaaatgatagatgtctcagggtttgtgtcatcagtcggaaacacagaactcttttgaacaatgccacaatgcaatctaagtttgatctaattttcttcaagacaataatgctcttggtgccatcctacctgctctttatgatttctacccgtaggtagaataatcaagaggtgagattgatgttgtttttgattctggacattaactagagggaaaattcgaagccctctaagaatggtatctaacttaatagacacctctccattacctttactcaaaactaagactctttgtggtatgggcccaccccacctctagtagccagctgctagtccagtgtctgtctcactgaagcagtctagtggtacacataggtactgagcaattatgtctgtcatgctgtaattgaggaaaaccatccttacttcattttatatttttgaatgctcccttgattgtccttcttggtgttcccataaagctaaaaattcacactcacgaattttaaattatcatgagcaatttgggggatttcctattttatcactgagtctcctttgagtgctcagctgctttcaatcttgacagatactcatctgacccatctaccacccttagggtatgctatgcgatgccagggacctacagccttttaagagatttttgaccaaagccgtctctttggggtgtttcttgactcattttttactcattatttaattttaataacctatagtacttaaaaatgtacagtactatataaagcaccttaaaaattgatgcatggtgattttcttattttaaaattgtgtatgattttttaaattattataaaagcagcttatgtctattatagaaaataggaaatacagaaaagcaagaagaagaaaatataaaatgtgcatacgagtaattacttttgtaatatcattgtatatctactcatatcttttcctatgcaaatagtttttctacaaatgggtgatatttatataactgtttcataacttactatgggaatgaacatcacatacgtattttaaaaaatattctcaaaaatatatttttaaaatgtatattgaactagattctgagaatttacatcattattatagtaagaacattatccttgattttgattcatagtctaacataccaaactctaaatttcttctgttactcactttacataaacacattgcagccagtcaccaacccttacatatatccctgcacagtttgagcagttttctttattgaaaatatttttaatttaaaatcatttaagttttatattatcttggcacattaacccctgtggaaatgtgtaagacttctcttctaaaataaattatttcataaagagagagagtaatagaataagtcataaaccatgctgatgaatttttagttactactgtctttaaaaagtaaacaaaaaaacagaaaataaatattttacatcttttacagccaactctttcaatgagttcaaaaatttcatctctaataaaaaagtaatttggggaacatttaggaaaaaagcaaaatatataaagcaatgtaaacaataacttttaaacttgcttgtttagaaaatcactggggtacaggttagtcagcctgataaactctaacttgccttcacacctccctcctccagcagagcctcctctgacagccaaacatctaggcatttctgtgttccattatggtaatgattgtctttttttataagtgactatatttgtttgtctttcctcttccctccactccagttccattagggaaggcatagtctttccattttgaatatttggtgcttgagataaataaaaagttttgttgggtaaataaatcaattcacttatctattaatcaatggcagtatgctttagcaagagtaattatgaatatctaataagtagtaggaagaggaaaactaacatgtattaaaatgcaattacatgccaagtcatctgttgaatcctaacagactttataatttcattttttcctgctataatgacgttttaaattatctcacattttcttaaacaattattaactaataaaaacatacagcaacttacataaaaatagactctgttttgcatgatatagttgaaatttttatataacttgtatatccatatgtatgaatatatatatatgtacacagactcagaaagagaataccaagaatttattgtttaaaaaaaaaaacctctaaaaagcaagaaacaaaatatcttgcaactcaaagaatctcatttatatttcacatatgctgtagacacagctcaggaactcagatgtgatgcttatgaatatgtataaagtataattagcttagaaaatgctgcttcatcacctgtcctgatattgttgatgtgcttcaataacttaccaagcaatgctggaaaaggttctctccaaattccagtgagttgaaacggtgcttttcacccataacatgttagtgttttccattcccttatcatgtgaaaagcctgtcctttaaacccagattgctggcagactgcttgtaactgacagttgtatgccataagctctttactttaatattttagagagcttcttgaaacattgaggcatgtcttttcctccaaatctcttgatttttaacctctcaattccacggtgcttgcatgaggtgactattctcttttctctggcctatactattacaataaccaattgatggctccttttttcccacacagctgcccaattcatcttcttggactacagctctgatcacactctcctactcagaaactttcaaggcctccaaattgctcattgcccagtttccttactcgcacattcaaaccttccagaaattgactctgacctgtctaatagccttacttctccacattgcccttgacgaaccctacaaacttagggagctgaaatactcgctctcacatccacacatcaaaagtccctgcctgcctccctgcctttccttatactatttctactatatcttctacattcctgtatatactacctgtctcctttcatctgagcaaggaatggttgactaaggatccaggaagaaatcactgacttcctaaaaagcagggaaaaaaaaattgcctggaagcaaagagcaggtgatattcagaaatgcaagaagatagaaaattagcaacacggaggtctgtatcagtacatagccttcagtcagggctgtcatgtttctggatgaaggtgcaagagccagtggaaaatcaatacattgataatcatccagccagactaatcagaaaaaaatcagaaaagtcaccaactaccaatatcaggaatacaagaggtgaaatcactacaacttctgcagatagtaaaggatgttaagaggatattatgaacaattttatggcaataattcaacaatttggataaaaagggcaaattctttgaaaatcacaaactaccaaaactcacagataaataatctgaatagttctatattcattagagaatttaatttgtagttcaaaaccttcacacacacaaattcagttccagatgactttacttgtgaattccaccaaatatttaatgaagaaataataaactctttcagaaaattgaagaggagaaaatacatccaacctcattctacgaggccagtattactctgataccaatggcagacaaagatagtttttaaaaaagaaaattatattatataacaatatccctccatgaacatagatgtaaaagttcatggcaaagttataacaaatcaaatctaatgatttactcaaaggattatacatgatcactaaatgatattaatgccaggatgtaagattggtttaatatttgaaattagtcagtgtaatttaccatatagcaaactaaaaagcaaactatataatcacctcaattgatacagcaaaggcatttgacaaaatgcgtctatttttttttaaaaactgcctactaagagtaggggaacttcactacctgatcactataaaaacctattttttaaaaaaacctaacagctaaaatcatacttagcacaagactaagattaggaagaaggcaaggatatctgcttccattacttccatttaacattgtactagagagactaaccagtacaaggggcaagaaaaaggaaataaatggcatccagattgaaaaataagtacaaatgtttttattcacagatactatagaagtctaagcataaaatcctggtggttcatgcctgtaaccctagtgctttaggaggctgaggcaggtggattgcttgaggccaagagtttgagactagctgggcaacatagcaagacctcatctctacaaccaaaaaaaaagtttaaaaagcataaaataaaatgctatctattaaaaaaaagttactagaactaataagtgagcttaccaatgttataaggtacaacatctatatgtgaaaatcagtcatttcaaagactggcaaggatacgttggaagttgaaattaaaaggttacagtttacaatagcattaaaaatgtaaaagaccccctacactgaatactctggagataaataaaagaaaatctaaataaatcaagagatataccatgttcatagatcagaagattcaatattcctataatcctagtttatacatattgacctacacattcaatgcaatcccagtaaaaatcctagcaaggttttttcctaaaaatttacagatatgttttacaattcatatggaattggaaaggagaaaaatgttggaaaggttatactacctgacttcaatacttactaccaagctatggtaatcagagaatgtggtgttggtatcaatattgacaaatagattattagaatagattaaagagtccagatatagatccagacatgtatggtcaaatgatttatgacaaaaatacaaaagcaatacaaggtatatttaacaaattctactagaggaattgaatatccatgaacaacaacaaaaaaaatgaacttcagtctgtatcttgcaccatattccaaaattaactcaaaagagatgctagacctaactgtaaaacataaaaatataaaacatctaaaaatatataagaaaaatctttgtgatcttgggtaaagcaaagattcttagatacaccaccaaaagcatatcctcaaaaggaaaacaaaattaacaacttaaatttcatcaaaattgagaacttcttcccttcaaaaaaaaaaaagcacttttaagaaaatgaaaagataactacaaactagtagaatatatttccaaattacatatctgataaaggacccatatccagattattcatatgtatcattcaaaactcaaaaataagagcaaataacccaagaaaatttgaacaaaagatttaaacaggtcaccaaagaaggtggaaaataagcatgtgaaaagatgctcaatgttattagtcataaggaaaacacaaagcaaaaccaaaatgatgaccagttagaatgtctaaaattttaaaagacaggttataccaagtatcaacaaagatgtaggcacatgcagctctcatacactggtgatgggaatataaatagttcagatactttagaaaacaggttgataatttcttaaaaacgtaaacataaattaccatatgatccagccattctgcttctgtgtatttactccaagataaatgatggcatatgttcacccaaaaatttgtacacagatgtgtacatatccctatgatgaaataattaccaataaaaaggatcaaatatggatacacacacaacatagataaatgttgaaactatgttgagtgaaagaagccagacaaaaagagagtacatgcagaatgtttccatttgtataaaattctatgaaatgcaaacctacagtgatggaaagcagatcagtatttgtctggggacagagggaagagaaggaaggatagaagaaagagattcaaaagaaatgatggatatattctctaccatggttgtggtaatggtctcatgggtgtacatattcaaaacttatccaattgtaaattggtttgcatggtttatttatgccagttttaactcaataaaagtattaaacagtattagtcatctctggtcatagtccctccacaatttccacaacttagattttagcctctttcactgttgtttgggccatcttcctcttttctctcttaccaattccatttattttcttttttaaattctttttacttttttttaatttttgaaacttgtattttaggttcaaaggtacatgtgcaggttttttatataggtaaactcttgtcatggaggtttgttgtatagatttcatcacgcaggaactaagtctactacccaatagttatttttctctgtttctctccctcctcccactagctaccctcaagtaggcctcggtgtatgttgttctcccctttgtgtccatatgttctcatcatttagctcccacttataaatgagaacatgctgtatttgattttctgttcctgcattagtttgctaagaataatggcctccaactccatccatgttcctgcaaaggacatgattgcattcgttttatgactgcatagtattccatggtgtatatgtaccacattttatttatccagtctgccgctgatgctattccttattttcttatgctcagcaaatcaaccttttctctccactttaatcctgtgcctcactttgcacacctgaagttagctttaaaattatgacttttaaatgcttgtcagattacattcttacaaaaaggtattcacactccaaggcactggggaaagctgttttctttttttgtctagtttcatctagtactataaatggcctatattatcttgacaattcaggattgtattatcatccttggttattttaccacaataaggttggcatctactgagacctactttacctctatacattttatccctttccaaattgactcagactcctgagcttcaaaaattcctctctccactttttagagttttctcttctctttgctcattgtcggacagattgtcagctgtcacttctgctgttttcatgtgtttgtttagagaatcttcacacattctttcattgtaatttcctgtctctaaattgttttgattcagaaaacctataaccaagggagtaaaaatgacgtgtaaatttggaacaaatatagaatctgagtgggtaacctgaggcttacttcgtgagttaaagtacattgcatctgtgtcattaattttgacactcttttttttttttccaagatgaatgacacttatgtgatgttactgtatctaattcccaagagaactgtagcaatgagaattcctgtttttcccagcagaaaacatcatcagttttctggagaataatttgccaaggttgtcttttgcaagaactatgttcagtgttcttttttatttatgtagatgtttccaatatatctttttgtagatatgatagcattgtacaatcaatctgttctatgagcaatcaattatttacctgaaagctgttagaataatacattaaaataaatttgaccacagccataccaagttctgtaatcttttctagtttaatgttcaaataatgtgactgataaaaataatgtaactaaggcagtccagatgcctttaacgagtgttatgtctgtgataatctgagttcagatttatatcttcaacagtaagtatttagcactctccaacccttcttgcacttgcaatacttttccaatttaaaatttacacataagatcctgtttgatttatctcttggtatatatgaattatgtaatgattgctgaggagcaaacactattaaaatgggtaactagacattcaagttaaacattccttttcccatatcattctattaactttgtgtcaccttttttaatctgagtctaaacaaatatatctttgcttggagataattgtggctcagagattgtcatttagaagattgtgttttgccataccgctttaagatgcattttttaaaagaagcagtgttctttctcatttcagcacttgggagatacaggaaatgctcccctctcagtccacaactagagtgaaatttgcttaaggataaagtcaggggatgtgtttagttcttaatttgcttgacttctgtagcacgtcataatgctgctcagttatgtccttacaacaccgccagttatcatgcatcgagtcacttctgcatctcttaatttccatagtgttatgctctcctaatttctccttttcctctgtggaatgccagtcaccttgccagctccactttctctgcctactccctaaacattgaagttcctaagaactctgttctagatcttcttctcataccgtaataaacagtctcctaactttaactaccgaatatgtgctaataatttacaattctatatctgcagcccagagctctttcctaaaggcaaactctgtgtaccaactgccttctggatccctccactccattattctatggttttagatgtatgacatttgtttttctgtccacaggcaacaggtcctcggggtttattaaaggaagatgccaaaggctgtcttcagaaaagcttcaggattcttaacgaagccaagaagttagcaaatgatgtaaaaggtcagtgtggccatagtttttattatattccagttaatcgggttgttactgataagatattctatcacactattggagaatgtaatttctttagcatgatttttgtgatgattctataatctatttaatgcaagtaaactttctcactagttttacaaaatgttgtctacctatctcacttcaagtagggtaatatctcataatttgtaagtcttatttctatagcatcacttcacctatatctaatgtatagtaacttttagtgtaataagtttttaagagtatcaaacccaggccagccatagtggctcacacctgtgattctagtgcttagggaggccgaggcaggaggatcccttggtgccaagaatttgagaccagccggggaaacatagcaagatcctgtctctacaaaacattttttaaaaatttagtcaggtgtagcagcgtgagcacataggcatagctacttggaaggctgagccaggaggatcgctttagcccaggggcgtgaagttaccgtgagttgtgatcacactactgtacaccagcctgggtaacagagtaagatcctgtctctaaaaagaaaaacaaaattaaatacatttttctttttctgagatgaagtctcgctctgtcaaccaggctggagtgcagtggtgcgatcttggctcactgcagcctctgtctcccaggttcaagtgattgtcctgcctcatatctgggattacaggtgcatgccaccacacctggctaatctttgcattttgagtagagacagggtttcaccatgttgaccaggctggtcttgaactcctgacctcaagtgatcctcccgcctcggcctcccaaagtgctgagattacagatgtgagccaccgtgcccggccctaaatacatttttcttgtattttatttctgattcaggaatcaaaatgcacaaaatatctactgccatattatgggttttatgttaagaatatatcattaaacatggctgctctctatatgagccattacaattattattttatgcacttatctcttgtctcccatttgaattgccacctgtttctctcttcagtttcattccctaccattttctgtctcatatctgtctccctacccttacctaagtattcataattcctcccaaacatgctactattccaagccttcatgttttcagtattatttcttccccttggaatgccccatccttcacctctcttctttgcctaactgctttcttccagaccttcaggatttagttcaaatgccatcatttccaggaaacctaacacctcatctgatttacatgccccctctctggtatagttttctcataggcttgtcaaaccaccacaatcatggactaattaatattccatcttcttttacaatttttaaaacttttttattgatgcataacagatgtataaatttttggcattccatcttcttgaggaaagacatggggttttgctaactgtgtatttctagtatgcataatagtgactagctcaaatgaggaaatacttattttttacaataaatggtgttggcttatcttacttatcttagaaagagaagaggttttaaaatcatttatatttggcatgttttggtctcagtagaagctgatatgaaattacaagttctatctcgattataagtaaaattttaatagtacaattcttcaggctgtgtattacaggtgaaataaaactccctacacacataattctgctcagcaggtacctcttattacaatctgaagaatgactgtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcattagtttaaatttattttttttgtagttcaggtagtacattatttaaagtaatgaaaacccacaaactactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgttgcttggttcaattcagtacagttcagttagtttgtgagcttcagtcatgaatgacttagtactgctccctgccatttttatgctgtccttgccttgagggaatctgaacttgccgggagcaatttgttttgctttttaatttttgaatatacatctgttaaaagtaaatttgcccttgtgtgagtttgagatttgaagcctgtctacattgcactgatcgaatgtttgtggagataaaaagtattttgttgatggatatgaggcttggtacaaattgatgactgaaagagtgaaaagatgaattagtaccaccaggtgaatgaacactgctttgcagatagacaagaaattttttaaggccgggcgcagtggctcatgccctgtaattccagcattttgggaggccgaggcaggcagagaagtgggagaataacttgagcccaggaggcagaggttgcagtgagccaagatcgctccattgcactctagcctgggtgacagagtgagagcctgtctcaaataataattaattaattaataataaaaatttaaaataatttttttcagtaaaatgccaacttcattttctcatggaatgtgtacgaggcaaggaagaagtagaccttggtttattaaaagtttgagaatattaagattttaaaattatacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcatggtggtgggtgcctgtaatcccagctactcaggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaatgcaggggttggagagcatggacccctgcacagttgaaaatccatgtataacattagactcttcataaacttcataactaaacttcataacataaactttataaactaaaaaaagaatctattcccaagcccaaataatgaatcagtgcattgcttgacatatggtgctgtcccacacagagaacagtatgaaacattattccaatcattaagttttatcaaaccagttgaagccttccttctatacagtggtcctccaaacactcagtcattccgttcagacaagtgggtcttgaagattctgagatcatggatgtaatacacttgcaaacgctaacctgttgagattctgtgttattattttatattttaaaaataagagaataaactggaatactgcagtgctgctaaaccaaagtatgatataggagtgcaattgtgactaagggatccttttattattaaagatatactccttttgaatttgcatattaccctttgcctgaatcagcctttccatagcaggcatgcaaaagacaagcaaaatctgctctattgaccacaattttagactaaaaggatgaaattaagcctgggtcccctggcctactgtggtctggagaacaaagcagtcttttccaggtgaaattgctgatccctcatacaaagttttgattcctcctttagagtgtgaatggtggaaataaaaaaataaaaccagggtggacttccattagagaaaaaacaataagtggcaaaatagtggcaaatatagaggggcaggttctattggaaagattatccctaagagcgagacgtagcttgtcatatccaaccccaccatgtgagtagaggacaagaaacaaacattcagaacactcctgtatatcatctcagcaagagacaaaggcctgtgcaataaaaatggggcttagagctaaaaacttatctgggctttgttgtgtgttcagaatcagagtctgagattctatggcgttttttgcaagtaagttaatttagaccagaaataaacagaaatgccttcaagagacttacagataacataaagggatggtggggcctgtgttaaaccaaagactatttgtcttatttaaaggtattcaaactcaattttcttgctgggcaaaagaaaacaagcctgcaagcccacagtcaccatgtcctagaggagccaaatgcaggtgttgatgtctggtggttttagtttttcattccactggctgcagaggggactcccttttatcccaatatcctgaatctttgcagaacctgctaccagacaagtacaccttccctcctttcctgaagctcctactatgaccccctagtgggaggaagagcatatgcaagcatggtgcttattgcgaacaagatctaatttcttactttcagatcagaagagggtttctccataacctgactccctgtgaaacagtcatctctgaggttcccatatgtggtcactctagtatgtatgtctgtctgtgcagaataagtaatcagatatacagcacatcccaaacttgtgacagctactagggaaagggaagcacaggagtaacaatcatgaaagaaggctagaaatataaaggttcaggaaatgataccgttccgaatcattgtcaccaaattcaatgattgcctgcataatgcagaaaattggagggatttttctaagaagtacaaagattgggtgtagcaaccttatcaaatcaatttgctggagacctaggagagaaatacagttgtagatttcaacttctattcttcctcactcgggtgctcttctttcctacccaggtctcaagatcctgcactgggtatttaggttgacttaggggacagggtctttagaaatctcaagaagccaaaatctgaacacagtcacttatgcttgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcatcccgatatttagttgaaaagtgaggaatatatacataggtatacatatgtttaggaaatataaaaacgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagcactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaactctgccctgcgatttttattctggatatatctatcttgtgccatttcaatgggcatgtgacaaaggaaaattacactgtcattgtgttcccagtcgacccttgctactctgctgcttccattccctcattgtgagtcctgcttttgccaaactaattctagcacatttttcttctactctatgaggaggagatgagaaagggagagccagacttaaagacgtatgtgtgtgtagcctttgagttttggtggatgtgatctttagagagaaagtagaatgactaggcttctgttattgggtttgagagctgaaggaataaggagagggaatctagaaaataaaactatggattataaattaaatcttcttcttattctccagaaatcacaagtaaaaaaattcagttggattttcttttaactatcgataattctatgtcttcacccttgttacaattcaaactgaatcacaagagttctttcttacttttagttatggatacactatgcctcctctgtcttttatttaaaatcagcccaggagtgcttatttttctaggttttcctcgctattattttgtaagttccattttgaaatctgcaattcttctctgaatagcttctactcatctaattctatcaccaaagctacaaaatgtttagatgtagttcaagaaattccagaaactactttagaaaaaagtgatcagcgtaagaaagggcaaattaataaggatcagagtcaagcagctgaaacattaaaaaaaaatcagaacagggttggaatatacacattgtaacttgctagtacaaaaaaaaaatgcagagaatcaaaattagcgctttggaacttgagaggcagcagtaaaaatattcttcaggtcagtcttctgaataattggcccagttgttcagccagcattttgctatcagaatgcagaaagtggtataaacccagggatacccttcaaattaatgatctttctcaccatacatgaatatcttgcttgccagaacatttgaatgctccattattttaaaaactaaatccaatcaagaagctaagaaatgaaatttctacagttccattttcttaagtgttgaagactttcaagctaatatcaaaagagcagccctttattctcaaagaatttgtatagatatcacagtcataatcagactggctttatttcagagagtatgcttttggtagcctatccaaagattttattttagtataaacagtaaaaataacagaagtattataagaaagatgaattgtgattgacagaggagaaaatccaattacttggaaagtatattttgtgggcttagaattgaaaataataatatattagtgactgaactagacatattgatgttttagagccgtgctttgctggaatattttatgctttgtttttcagtgatgtcaggtctttggcttggaatttaacaacagacactttaaacaatgttatgtgcttatattagtataatctgtagtataacagaagtttaaggtgtctgcctataaaaccctttatatgaagtggagtgaatcattaattaatatgtccagtactcttcttcacatccagacaccgatagttcagaatcctccatctatccacctttccctttgctattcttcacagatgcaggccaacaaagatgaggatagttctccagctgcccatggcctgcacagttcctctaatgagccacatgcacaacctctgagaggggtgtgcacacagtcaaatcaagactgctgtagctctattctttggggcgtattctctcccacctgccttctctgggtaccaggaaagtgatgaaaatcagtcttggtgttgacaaataacatgaagatagcaaataacattcttccccagttaggtggtttaagttttttaaaacattgaaaaacagaaatatatgcacacagaaagcaatttagccagcacaaccgggtataaaatgagaagttttagtacattgtccctcacggcactattaactgcctcattcattcccagtttctacccactattaattactgtaaaggtttttggcatgttcttctctacccagctcccaccagcccctaccatgccaaatgcttgtatatgtgtcagcatatatatggtgcatcttgcttattttcatggaaaggtcttaaggtttatttcacatccatatccgctcatctacttctttttatagattgcacctgtaccattgtatgaacatgctgtgtggatataaacagcactttaatcttattagggtatttttattcccccctccttttttttattacaaatgaagagctaatgagtatccccaaagataaatcttttacaggtatattgaagggtaaatttctatcagtagaattgccaaaccaaatacatgtctatttaaaattctaataaacttattaacttgctcttcaaacaatggaatcaatctgcacgtccactagcactcttgtgaacacttggcattatcatacatttaattttccccaatctcaaaaataagaaatgacatcttactgttgcttagttttacagttctttatgataatcttgagtgctttttacgaatttcataaatgattatgtatgtttattttattgtgaactacgtattcttatattttcctcattatccttaaaaatatggaacactttgcatatttgcctgccagttttgcacatagacaatgctattccactctgaataattacaacttggttatatatgttgcttaggtgaggcttctctgatttctgtaactgtgaccaatttctttaagacaacaaaggagaaaatgagaggaagacaaaggaaaggaggaggacaggaagaaaaggttgagggtgatggtgggaggagcattgctacccaaaatgctctactaatccctagttttgactatcaatccttggtagaatgcagtagttagcattgtttatggaatgggactatgtggatttgaataccaccactgccatttattaaccatgcaagcttaggaaatttactcaacttctctaagtctcaatttcctcatttgtaaattggagataatagtagtatatacatcatcatatacatcatacatcaatgttattgtaaggattaagtaaaacaacccactgaaactgaagaacactaaatgcgtgtaacatacacattcaatgcttgtcaggcattactcttactaaatacttgtccatcctatccaggagggactagaacaacttctctttcttggtcctttctcagtggtcctcctcacttggggactctgtcttgtatttacatgttgcatttctgtggagctaatttaaacaattagtacgcatgtcccaaaacaatttttatggcataagaaactattaaaaatttacctaaaaaatgagctgttgtatccagtcaagagaggtaaataatattgtgggaagtataggatttttcatattttgttttttcaatttgaattttcactaataaatgatgtaagaaaaagaagacagatgaactccatttcagtcttaagatatatttgcagtttaatgcatacctgagtaagatttctaaacttatatcaacagattggatctttattttctttccccttaatgatttcaaattttactctttatattgttgtactcgaatttaaactgcttagttactattacaatataaattaatctaaagtttagagaatattaaaaactagtggaaagcagctagaaaacttatatatgtaatattaaattatctctagcaaatggcatttttgaatattaaagataacattgctaaagtatcaagagaaaaaaactatataaaatttattggacccaatttgtaaaaatattgttttctttatgagaaaaatgactattatcagatatgtgctaaatgttgtttttccatttctttaatgtgtatttttgtccaaataaatattaacaaatattattatactgaagttggaggattctgctaaacaatcatatctgagattttgaaaatctaatccaatgattcattttggtaataaaagtttttaaataagtggaatcaatgggagtgataacaagagggcataattacaaatggaataaaagactaattctttggaggtttcttctctataggaagatatcaaattaagtcagataaagatcagataccaagaagaaaatgtcattgttcaacatgtagaagcatccaataattcaatgataataaaaacacatatttttaaaatatgattggaaatatatttatgtatagatgccaataaattaaatacattttcttgcttttaattaattttatattaaaataacctgaaattgcacatccaagtataagctcagggatgataaaacttatttaatccttttttttgttttttattcgcagaaaatgaagaccatctaaatggcttaaaaaccaggatagaaaatgctgatgctagaaatggggatctcttgagaactttgaatgacactttgggaaagttatcagctattccaaatggtaagcattcaggacactaccaactgtgtcagttgacctgaagttttgaagactgttgttaacttttaccatttttttctaagattattctggtactattatctggaaattagatactgtttttcttactcatgaattcttctttgtgagaatgagaaactaaaccatactttgcattatggtattttttatcttttattgcctttagccagtatccttaggaatgtgttacagaaaggaagatatagacatcttattattataaaactcatccttcagtattggcaggggattggttccaggacccccccccacagatatcaaaattcttgaatactcaagtcccttttataaaatggcatagtatttgcatataacctatgcatagcctcccatatactttaatccctagatcatttataatacctaatataatgtaaatgctatgtaaattcttacagtgtattgtttatgaaataatgacaagaaaaaagtttgtccatgttcagtacagacacaaccattttttcccctaaatatccaaatatccaactctccaaggttggttgaatttacagatacagagcccactgacacagagggacaactgtattgtcttctgtgtttcagcccaagaaatcgtgtattagtgaaatagaataaatcacatagacactaatctctaaaatactgatgtaccaccacaaagacacagtttattaaagtacctgcagtaataggtgatagcccactgcattctctcttgataaaattcaatttctttaactattccaactttcaaaaacattagtggtcaaaccatgtctgtaatatctttctacctattagaactgctggaaatttttgcatggtattagttcctgaaagcacacgttattttaaagatactacttttactatttttatattgttaaagcatgatataataacaacaaagattataaacacttattgagtacttaatatacttatgttaagtgtatgtaatcctcataccaattggagcaaaaacatttgcttcatttgcttgcatcaattggtcatatatatatatatatatatatatatctatctcaattggttatatagataacataagtatagataacataggtaacattcagaatagtccacttcactacttaagagctaattaggtattacggtatttccaccacaggagtgagaggttttatcacagttttnnnnnnnnnnnnnnnnnnnnnnnnnnnnnnnnnccttgttaaaagtggcacagtggaaacttaaaccccacagtttgatttcagagcctatgatcttaaccactaacctatacacactagtagtcatctataggtacaatatacaaattaggatcaggagacaaatgcacatatttatacaacacagttaatattaaaatctcggtggtttttacttttttaacgtttaaaaacctgagtaacttttcagattttcatgtccctttttcagtagtaagtatatagaaaatttccaatgctgaaaacaagtataaatgcatggcctaacatacctgaaaatgtttctctatcctaaaatgaaaatacgttagtttccctccaacccccaccccaacccctgccctgctttggaaatgcagattaaatcttaagcctcgttttcatgaagctcatgtggataaatttatctcgtgaataagttcagcagcaaatcacaatatgatcttatacaatgaacatttagaatagtcacgtcactactttaagagctaatcaggtattcatagcaaaagtccctgagaaaatttaatttacctaaaaaaatttgcttcatttgctacacctgaatgagacaaagttcagccttttccctttgtaaatgtgtccgaggtcagccagccacagcctcgctttgtcaagcatggattaagccactaactccacaccctttgttttgtttttcataccctcatctgctgacagatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacagtaagatctcctttttcattgtgatgatgtcatttatttcctctcactgtaaaagtatcccagacctgtaaatgctcgagttggaaagaccctcatggtggtgtagtctgccttccttctttcatagattggcctcagaaattgagtgtcatgcagttccaaagctggaatccaagtcttctagctctgccccggtgcttttttcctctgaaatttttccagttgagaagagattaggaattctcaaggtgtgcctaacattcagcagagagatgcaaaacactttttaatccgtgtgtgtaattaaaaacacagttgtacttgggtaattatatcctcagaactggcgaagtgtcatggaacatagaggttaaggggcacgttcatgaacagacttgttagaacaggatatgaaaatgatatcaacttgaaatgcattaaaatttgaaaatcttgatattttattatttagattccagttacatcacatttctgggaaataaaaataaagcatttatctagtttctaaagactattcacatctcttatatattatataaaattatattgacttaaggatttactgagaaaacctgagagaaaatatcataacttatattattagttaaatatagtcaaaatattaagattttaaaatgcatttttccttttccgtcaaatgatacaaggctatattgggccaggtacagtggttaacacctgtaatctttgcactttgggagcctgaggcgagaggatcacttgagcctaggaattcgagaccagcctgggcaccatagcaagaccccatctttacaaaaaatttaaaaaatagccaggcatggtagtgacattgcacctgtgttcccagccacttgggagtctgaggctggaggatcccttgaacccagaagggtgaggctgcagtgagctgtgatcacgccactgcactccagcctgggtggcagattgagatgctgtctcaaaaaaaaaaaagggggttatcttggtatccttgttacatggtttcaccaaaggagatgcttgggtaatctgtgcttttcactttcaagagactagccctctttatatgccaacatttttgggggggtatcaaaatatttggagtataaaaacaaaagcactgtaattggtattatatgccataaaattcaaatgctgtttgagtggggaatggagcctgatttcagcatcctagcctcaaatcaaatcctatggatgctatgatataatagacattattaatacgactccttcatgagcaaggaagagtacaaacacatataacataaacttcagagccagggtgaaaaaggggagataaaaacattttttaaaattttttaatgtaagcccagaaatggcttctcttgtagctcaaagtttacataataacttcttatgatttatgccaaatcacaatattcccactaaaaatgaatgaaaacaaaattttaatcaaatattactatctctgctgcttacttcataatttaagatatatttttaacttttattttaagttcaggcgtataagtgcaggtttgttacataggtaaacctgtgtcatgggggtttgttttatgaattatttatttcatcacgcatgtattaagcctagtacccattagttatttttcctgaccctctccctcctcctgctctccaccctccaaaagaattccattctattttagattgattctcaactggtagtggccttttgtcatatctctgttttaatcctatcctctattatgagaaatagttaattatctataaatattaattaaattgggtctgttttctatcttactaaaacatagaaataatttttaaaatacaaatagtggccactaaattatatattttgtgtacttttatttgataacaattgcttcagttaaaatggggtgcatttataattagtacctgttatgaaaaataccatttttagtcactactttataatatttatagaaaatacttcctcatgaatttataatttttttttgttttgcttccatgtgaaattgcctgcagaaatcagtacgtatatgtttacttatataccttttagtaacgctcatgcttcattgcctattgcaaaaagtttcagctttgcatgtactatattttggttttgctttaaacattgcgtagctattctttccactgttacagtattaatggtagatgcgtaaaaggaatcttcctttataaaaaggtcatatgtggataaaggtgatataaaatgtttttaatagtgttataaaaagtttggtcaggcgaagtggctcatactctaaccccagaaatttgggaggtcaaggtgggaggatcacttgaggccagaagtttgagatcagcctgggaaacatagcaagactctatctctacaaaaaggaaaaatgagtgaaatatctgtatgatagccacataaaagtggaaaactgaatttctctatagaattaactagattatgctgtttctgataacacaaattcaccccaacacacgaatgacttaattgcaagaggattaaaatagataaggtctacactgttgttgtttttacccactgaagctcactttttcctctccttgtaattattctcaacttctgtagaattatatttggagaaacacataataaaactaggtcttaacaaatgaacaactactgggatatcaaaatgttctctcttaaacatcccacagtttaaattgaaagtcaagaaaaactaaaaaaatagctacaaaaaataataacaagaataacaaaatttaatatatcactatttgaaaaatatgaccaagagtgtcctcagcggaaaatgagagcaactacattactaaaccatcattgaaataacaattctaaacaatcaactttgctgactttagaaaaagcagagttaacttaaagaatgaaaaagatggaaaaattaatgaatttgaagacagaaaatattagacctgataaatcaaaaaggtgactccttaggaatatagattaaaaattaagtgattgtcaagtttcatcaagaaaaataaaggacaaataggcaaagctctaaaagaggtatcactagacaagggaggaaatttaacacataagagatcacttggaaaaacttcaactgctccggagaatagaggaaaaagaggggagaagaggaacttccaagttccattttgaaacatttggcaaaaacttctgagaacttgtgaataaaagggtctgtaatttgcctaagtctaagtagtctttaactacttttgctctttctcattaatctaaatctaaatcattttgcctcagttttagaataatttgtagaatgtcagaataacaatggagaattaaaggaagggaaaaatgaacaaacggtttattaaaagcatacaaaataaagggatcactgtgtttatgctatctgtatgatgatataacaaacatttctatccagataacatgcatttcaggaagaaaatactgcactcagttcttgatatagcaaatctattagttaaatttaataatagacctatgttctttttaaatgccgctaacagcataagtcatacttatgagttcaaaatacctactttaaaacctaattttaaaaaaatgataatttacttccctttgagcacatgtgattcgttcctgagggttagttctcagtggttgtatgtcagccgcaaagcagatcattcagagtctaacacagcatgtagccttgaaccttaagcagtttaactttttcatcagagtcacagtgacagaaagttgaacaatacacacttaatcagataataaatgacatagtgtggatgagactgccagcatcccagcaatagaataagtggtttaccacgtggcataggccctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgttatggccatgctttgtcacattaataagatgaaattgtttggttaagcatactgctattctaattctgtgtgtgcacgtgtgtgcatgcatatacatgcacactaattttgttctatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctgtaagttctttttatcgtcagtatcagtaactgattgtaattgttggattattcatagagggaatgtctttccccaggattccccgttgaatgatcttgggtccttttcctttaactcgaagcgatttggggtaggaggggttggagtgggggagaggttagttttgttttgtttgtaaatttcaaaagacatttcatgagaatgataatcaccacttattgttttaaaactgggaattctggtatattctattactatttgcatagaataatacaaatagcaagaaagaaaaccttattattgtatactaaaaagccatggatgagagtaccttcctcttgctaaaaacaaaccaaaaaaaaaggccaactaatggggttatggcaggaatgaaggaacaatatacagaataagagcaaagagaaacaaacattttacatatatattcttttgtctggtataaacaacaataaaaatggctttggttatactttttacatttattttttgttttggagtagataggaaatagctgatttgtctcaaaattttgctctttacttacccaattagaagtttactaggatagaaacagagctttctagaaggtagcatgctaatgagccagggcagagttgctaagtggcaacgtgaaactttagtcaaaggaaggaagtaagggaaggggaggagaggggaggggaggggaggggaggcgaggggaggggaggggaggggaggggaggggaggggaggggtggtagaaagaaagaaggaagggcagttttcttgtttgaacaagaaaggcttgaactcaaacctttttagatacctcagttttccatgtcaaaaattctgttttttgaacaactttggaactaggatgatcagaaaagccctttcttagttcatcagtttatatttttagtagtatttaagaatacgatgctccagtaacagcatattctttttcctccttattcacatctaacacttctaaacaactccaagacagtaagttcaaggtgaacattgaaaaggaattcacgactgactgaaaaaaaacctagaaaacaacaaaaagattagtgaagatgatgttacataagatcagagtagtaaatcagtgaaaagatctgagaaaacatatattcagctagaatatgaaagccaggcagtatcgttgacatgtgatcattatgtatgtaaagcacaagattaaaagaaaccagatgttacttcaaggtttgaagttttatgtaagatttagccaacatggaaaaagcctctactatgttcagtgttactttccgtaaggtacacaaagacgaataaaggagttctttcactcacaaagtttataaaatagtagggaaaataaaatatgtacacgtaccttgtcacacaatgcagaatgttatgccacattatagaagccgtgagaagtgacataaaagttctagaaagaacaatcacctctagtagggcctgaagatttcctgaagggaaggatttgagccaggcattgaggtgggatagtgctggggagttgggggtggagtcaggtaacagggagagtattctgagaagagggaatgacttaaaccaaggcagtgggagaaggaagttttagggtccatttaggaaaaagaagtccagtttgcccagagtaattgataaaggaaacacataaccagaaagatcaacagaggccaggtctcgtcaggccttcaataatcagttaagcaatttcatttaacaacactggtacttgggataagcctcactggttaggataagctgaaagctttgagcatggaacacagtataatcagagctgtgctttttaaatataaatccagaagcagtgtatggggtagatgaaagaaagaagaatgaaggacccaactatagctgtggcaagagaaaagaagaacgtgatgtaccactcctatattttgcaatgttaacttggaagaagcaataagagtaaatattattttgtgaatctcacatttagccacattttctgacttagtcatcaagtggagaaatctagacatttttattatttcttcattgtaaagatttctgagtgcttttcccctcctcacaaaacggtgaaattcagacatgtaagcatataaaacctgtcttaaagtacaaaataaaagaaaagtataggctgggcatggtggctcaagcctgtcatcccaacactttgggaggctgaggcaggcagattgcatgaactcaggagtttgagaccagcctgggccatgtcacaaaaccacatctctacaaaaaattgaaaaattacctgggcatggtacatgcctatagtcccagctacttggggagatgaggtgggaggatcacttgctctggaggatgaggctgcagtgagccatgtttgcaccatggcactccagcctgggtggcaaatagaaaccctgtccccccccaaaaaaaaagagaagaaaaaaagaaaggtacaaaagtaacgttaagaaaaagtaatcattgtccatgcatttcaaagaaattcccaatcagttttggaaatggaattacaacacaatgccttattttttgtaagacgttagaaatatgcaagtagccaatttttttccaaatgagttttgtactaaatgaatattacattttctgatttgtaaatatggatatctggatatgaccttaacacatacttgacatgaccaaaacattaaagacatttattttaaagtagctttctctgggtttgttgattctgaaattgagtggctgatactcctttaaatgaatgacctacttactggatgaaaaatgcagtgaaaatccaatagatataataatgggatactcaataatgtttgagttcatcatgattaactggtaaataatgttgcagtattgaaatgccttaaagatacttaatgcttagtgatttttctttagatgtcttactaaggatctgcattagaaataacaataattgatagagccaaacattctaaaaggatgtttgaatttcagaaatttctttcctcttacaagagtgacatatcctaaagatttcttctagagatacagtattttgatttacctgatttcttctagagatatagtattttgatttacctgatttcttctagagatacagtattttgatttacctgttttaagttgtttaaaagaaatacctataactgaaaatcaaaacagaaagtattcaaaaggaaaagactactgattatgtactggctgtcaacagtttgggctaagtgaatgtttcagtttctgagagtatattcaaaaccagaaaacagaaagcaggtaatccaagagtattttctatatgaatgtgtgagagctgggcaatagattactgtctagtccacttcatgctgctgtgacagagtattacagactgggtaatttataaagaaaataaatttattctcacagttctggagactgggaagtccaagatcaagatgctggcaggttagggacctgtttttatgcttccaagatggcactttgaatgctcaggagaggaggaacattgtgccctcacatggcagaagagcaagagagagagagctctcacccctgtaagcctttttaatagtggcatcaattcattcatgaggacagagccctcatgaccgaaacacttcccaaaaggcccccctcccaacactgttgcactgaggattaaatttcaagcaaatgaattttgttggacacattcaagccatagcagttactctgtaggattaattgccggcatattgggtataacaacatcattttgcttcaagaatcatatttgttagatatgtattctatacaatagattggttgtaacctctagtgacattagatactcagttttaaaatggcttctctcttagacttggagttctcagagcagttagattttagtgctgctgctctgtctgctacacttttttttttttttttttttttgagatggaatctcactctgtggccaggctggagtgcagtggagcaatctcagctcactgcagcctccgcctcccaggttcaagcaattctcctgcctcagcctcctgagtagctgggactacaggcacatgtcaccacgcccagctaattgtttttgtatttttagttgatacagggcttcaccatgttggccaggattgtctcaatctcttgacctcgtgatccgcctgccttggcctcccaaagttctgggattacaggcgtgagccactgcacccggctctgtctgttacactttggcaacccccttttcaacacactaatcatggaatcccgtttttttttttttaccaggcttacctaagcaatgactgaaattcattctgtgaccaaatgatcacatattacatttatattgagtcatctcttctctaaataataactgagggatattattcaattgtgttgtttgttttgttttgttttgttttgttttgttttgacatggagtctcactttgtcacccaggctggagtacagtggcacgatctcagctcactgcaacctctgcctcttgggttcaagcaattctcctgactcagcctcctgagtagctgggactacaggcacatgccaccaccatggccggctaatttttgtatttttagtagagacagggtttcaccatgttggccaggatggtctggatctcctgacctcatgatccgcccatctcagcctcccaaagtgctgggattacagatgtgagccatcacacccagcctcaactgtgttttttaaacaaaactgatttattaggaattaaactagccataatacagccatagggccaagctataaagcatttattaaataaaaatgaagtaaactacatacagtcgctttgactactaattcagccccattcagaattggatatgattgtctgccagggataacgcactatgctattcagttctactcatgaattccagtcagatcttgatttcttgttcactttgatcctcttatgatgtcaatggtacgtatagcctgcctcagatattaaattttctcaatgccaaggtcttctctgataatgattttggttcactttcagcagcttgctaaaaaatcactatatctgacaccctttcctgaacattaaaaatatctgaagaccatatttttcccacctgccctctactgtgctgtctttctcttgcttctctctttttatctctaatcccttggatgacccttggtatagctgccattgtatcacagaacaccctttgccaagtcccattgctcatctgctttgccatattaacatccaagtaaaaattgtacatttcctacctccattgttttgcaattcattttcactcacctactctcaacactgtatgtagaagggaaattccatgatttgtgaagcaggaactaacttcccaactgaaaaccaccctatccagaagactgtctccctaggacacagaacaaacactctgaggaccatagttggccctgagtcctgcacccagcagttggcaggctggccccacctttttggggaaggcaagaataagaaagtggtttaagcagtaggcttcctggaatgtccagccccaggccaccacactcaggcctccagcagtcaccctcctctgggtggtggaggaaacagcccctgtttctctccagaacacagtgtcctcttcatggagatacaatttgattagcagatcaggtgaggcaacaacaataaacaaataaatgacttatgcggtctgtgggagacgtaacagatcttctgtatccccagaaggtctcaaatctatatgaatttacctattgcaaaaatccctctttagccttctcttttgaatccaaccaatttggcacccaacctttgcagtatacttgcatgacccttggagaagggccacagttctgcccatactcaaacacaaatgaggctcttggagacacctcctggtgtcatgatcatatggaggctgttttggtttctaggctatcttgttgggagtctgcacagccctttcatggaggtaatgatgatgctagttggttttcttccaaatgtgcaaattacatgagtagcacaaaatgctagaagaaatgaaaaaatggaaattcactgctagtgaaggccaagagggcatttgaacaaatggcaaagagagattttacatcttcccctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattaatagtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaaggtcattctcattagctccatgtaaaatcacctgcctaaaacgttcccatattgataatggagaaatgtatgacgttagaagtttgttagttgcatgcttcaaaaaatagtatgctaacaagacatggaactgtgaacagctcatagtcaaaattctagtggaaaactgctcttctgtgccctcattaatgagtataatggtgtctgcatatgggtgtttaatgatagtatttgatgatagaaaataacttcaaagaagaaacgatgatggctttgtggttgtatggaagctacttcaaactttctgagagatttactcttggttctttgtatcttgttttttttaaagatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttgtaagtctaatattcaacttttcattaggctgctgtatgtgtatagctagaggttaatctgaaaatgtatagaatccccaaatgtatatggtccccaaatggtctaacgtaggctttcagatttgaaaacctcaacgtcttaccttacaaaattctgaagagtcaaattaagttagaaggcaaatgaaaggaagaaaactacagtgtttagtcacatttactttcatttgtcagtataccatcatttctgttaaattatactttcagatccagtgatttaagaatgctaatgagaataaagctattttatttacttcttatttatttatcttatttactgttcaaactaaattacaataaactcttccgttaatgaaatgaaaatagcaaagtgtgtactattttttttaccaatggaaactcttctaacttgtgttgaatttatgacctgaactgaaataacacagattatatctacaaaagcccacccataaagttctaatttcttccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaatttgaattggtaaaattaacaaacatgcctgagcattatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgggatgttggatctggagttggacgtgtagagtacccagatttgactattgatgactcatattggtaccgtatcgtagcatcaaggtaaccaacttaataaagattaagataattaaatgatagaattttgaagtagtttcccagtttataagaaaactcctatttccatttcaataaggtaactgtgtatgcatgtaaacacatgtgtatgaattttatacatgtctgggagtgggtatgtttgtcatacttcttaggaactgacaaaccttccaggtattgaccagaggaacaactccatttctgaccccttcatcttgtgtctggtaggaatttgggggtgtcgctgtttcaggcttcctattttgcctgaagaaagtactgccacttattcttatgcaatacaagccaaagcataagagcaccattattgcttgtctttgttgtacacagctcctcctttagtctacatagccaccatagaaaaatgcagtttcaaaacactgaaattcttatgtaacataccaggtccaccctacttaaaatgggaagtaactgagaactgattcagttattctatctttggagctttaatgcaattatcaacatctagtaccatatagattacttatagaactatccctgtcttcagcacttccctcccattttctcttcttgttttcccaattctcaactccctgttaaacccaaagcagctaacagttgaaaggtatggttaagggcctagggctagacatgaagctgatcagagacagagaagacttaaagaactggttaattgttgactctgggtgatacatagagtttcatgctgtttgtagatacttaattttttccataataaaaagtttaaaagaaagagccatgtgcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaaccgggtttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaattctgttaattgaatttaaaaatgaacttctatgcaatttgtacactgaaatctgaagggtggatattgtactgtatacattagtatgctgtgccaaacaataaaagatataccattctaggaagactacttcaacaaactgggatccaagatattataaagaattttaggagaaatcatgcagcttatgatatgaaagggtggctcatttggggtccactagctgaattaaattagacaaaatgctgaataaagtaatataaacttgcataaattgtatgtgttggtaaatagtaaattattatgtaagccataggaaaaaggctttccacttaaccaatagcaattccatcagttaactgctgctgtgtcatttcatgtcaatgaacacacacagaatcaggacctggtgctcactggttctggttgaaactgatgtaagtgttgagccaagatcagactctgagtattgattcgagatctaatgaatttggaatgttagaaactaaacagccagttttctcttaaattcttaaaaacaagtctccgcattttatatcttttaaatctggaattaccagaaatgtgatgcatatttcattttctgtatgttcctccccttcacttcaacacgtacccttgaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaaggtaatgtgttcatcctcctcctgtttatttcatctttgttgacatctcctgacataattacttcaggagaaggtatgataaagctctgtaaaacttgatcacgttttacttaacttgcatttatgaaaacatgaatttactttgagtaagaattttcttctttgacgattcaacctggaaacacaatatttttaagcctatgtgtatttatttaaacagctgttgttttgtctttatctgtggcatcagttttttgtatattcttgttttagttgcctcaagagcaaagtgttttttaagtatacctcatcttctgaatcgatttatgatttatagatatgaagtgctataaagttcatactcacatctaattaaaagatttatgaatactttgggaaatatcacaggagctataagctttcaaaacatgatctggtttttaaagttctcaagttgctcttattcttataggatgatgcacttaatattcataattgcttcatgacagtccttgcgcatttcaaattgcagaatgcctgccttttaaagaagcttgtgttgattaaatggaattaggtgttgggaaaccactatgggtgagatgcaggagcacaaccaaatataatggataatcctgggcttgtcagaatcatcctgagttgagattagtcagaaaatgtgaaaagccagggtgaccccaaatttatgaggactcaaccttcatatagaatgaggttattttatttactttgagtacgagatgtgactctaaagtatgagaatttattccaaaaccacacgctgaagttatcctcgtttcttagaacttcatataaatgtatatggtacatagtaatatatagtcatattatcaactttctctccttcacagatagataaatatagggatagcacacagtagtacaaaagccatgaattttgaaatcaaatccaggttggatttcctcctcttccacttgctaaaatataaccttagacaagtcacttaaccccttgggctttggttatctcaactagaaaagaatgataaaaatatctaccttgcttgcatattgtaggatacaataatacattttttaatattcttataactcttcctatatgctaagtaatgttctcagtaatttacatgaattaacttgtttaatttttacaacaaccccaaaaagtatgtcttagtccattagggctgctataagaaaaataccatgaaactgggtagtttataaataaacaaacatttatttctcacaattcttgaagctaagaagtctgagatcaaggtactggcagatttggtgtttagtgagagccagtttttcatagaaggaggcttcttgctgttctcacatagtagaaagagtgaacaagctcctttggacctattttataagggcactaatttcattcatgaaggccctgcccctcaccatctaaaactcacctctcaaatgccctgcctgctaataccatcactttggcgggtaggattttaacataagaattttgagagggacacagacattcacactatagcaaggcagatactaatattctcattctgtagttaaggaatctgaagaagagagatgttaaatgtcttgaccatggtcacacagtaattagcagagctgggatttgaacataggttaataggcacagtggtcttcactctcaacatcttgcttcactgccacaatgaatagtgagacacacactaccatagagtgtgtgtataaaatatatggcaaatagctgagatgtggtagtcacaccttaaattgtaccttaataattattatgcaaatgtaattggcacaaaaacagtattctatcagtctcagaaaaagaaagaaaacatgaacaaatgaaatctatagcaaaccttaggaaatcattttggccaagaatttcaagactactgccacaccagaatatgaaccaaaagctgaaaacaactaaatgaacttgctcatgagaattcaaatgagcaggaaaatctctcaaatatagcttttcaggatgcaagaagaagcaaaaagcaagcagaattcacaagtaggataatcaatctctagaaaattaagaggttcagagtgatgacagagcattgcaaggacgactccaatgtgcaagtcaggggctccgatcaacaatctttctatgcggctgtgcaatacatggtcacagcagtgggaaatgtacatgttgatgggtttaacctaaaaccatagcagtaggctataccatagagcctaggtgtgtagtaggctataccatctagatttgtgcaagtactgtacagtctatgcttttaactattcagtaactgattttactatttaaaattttaactattcagtaactgttttcttatgtgtgttctaaaaaccaaatgagtcaatgcatgtttttcccagataatctgagtaaatatgggttcactttggcacagagtttttaaagttgtaggcaccagaatataatacagtcatgtgtcactcaatgacaagaatacattctgagaaagttggaattaggcaatttcctcaatgtgcaaacatcataaagtgtacagtacttgcacaaatctagatggtacagcctactacacacctaggctttatggtatagcctactgctccaaggctagagcctgtacagcatgttcctccactgaatgctgtaggcagttgtaactcaatggtaagtatttgtgtacctaaacataaacaaggtacagtaaaaatacagtattataattttatggaagcaccatcatatatgtgatctgtcatttaccaaaacatttgtaatgtgtcaatgccaaaacagttgtttcaatttacaacaaacttctctaggagggaccaggtcattctctttcttcatgattgtgtatcaagcctaagacttttcctgtgaaaatgacaccaggattgaatttgatcagattatttgtcgattctctatttgactccaggccctgtgctgtgtatacaagcaaacgacaccaatgtggtctcatttcctacaaagttgcttactttttctttattcccttgaactcgaaatcttcttggctgtgaacagaaatttaaaaatttacagcagcactaccatagagtgatttatacaagtgcttttaaaaaatctcttctatgtcatcagcgtgtcccctttcttctgatctcaggggaaaaagctttgtgtatgcatggcccaaatttgcccaaagaaaattatgtaggagcactagcatttattgaacaccttctgtatatcaggcactgagattggtgtcataaataaattatctaactttattctcacaaaaattccacattacagacaaaagaatagaattgtggagaaggtcagcagctcacctaaagttagaagctaggaagtgtttatttactgatgatgaaaactggtatagcaaaaagtaatcagcattcgtggattaaatagttgagcttttcccctgttgttgactcatcctgtagtagctctaaggatacggacagactatgatgaaaagatgaatatgtacatatgccaaaatatcagaaagaatggataatgataactttagtttctgctgataataactctcatggataaaccaagattatttgtgaaattccaaattctagcaaataacggtatttctttctgcagaaggctgatgctgtacgtgtgattacattcactggctgcatgggagaaacatactttgacaacaaacctataggtttgtggaatttccgagaaaaagaaggtgactgcaaaggatgcactgtcaggttagttgagatgagaactctcccagggtctgtcctgtgcataataaaagcttcgattttattgcataatattctattatcatgtggatgatgtggagcaggtttgaaaggattatactcagaggtggaattaccacaaaactaatgaatcttcaagtccctgcctgcatttgcacaggcatttttcaaggccctgggaggtatactagcagtacatttgcatagtcatatgtttttataaaatttgcaaaggtaagagattttggctacaatcagttaagtttccactccaatgttctttcatgtcgaggggtttttttgtgtctgtgagtacctcattgttataatttttttttcctaaagagagctttccccaaactgattaagtttcaggtcttgctgagcatgaattcactatatttatgtttataacaaaattagaaccccagcctaggttttatctcttacaggatttttttttaattgacacataggatcctacaagtgcttcaactggaaacctatgggatttaatgattctgcttcaagagagaaggagaacaaggggccgagatagtccaggaggaaagttcctaatacatgacctcaattataagatagagggtagaatgaataggaatttgaaaatatttaacatcctatcatactaagcatgtgtagagaataaacacttttatataaaaatgaatacaggatataaaatatttagctataagtagaggatttctcagcataaaaatcttagagcccacttatcacccaagcctaaagcaattttgttaaattaaaactataaaacatactttaaatacctgcaaagttaacatgtcataacagcaactcaaaaaccattaagtgctaaggagtttgtgttattttccatttaaaggatatacatacgtttctaggacccaaatcctagcaaagtacacttcacatttctttctctacatctctagagtttcatagaagaaagtagccccaaaatgttatccctctaaaagtcttaacttccaactctttgtttctttttgacatcatggacttgtcaacatgaaattgaggatagtttgaaagcgtgacccattcattgtttaaaatggttttgtcaataatcttaaacaaaatttaacatggaaggttgtctgtaaaattctttcaatacatgaaagacagtgaagcccacattaatattctgctactcacaaaccaacaccaacttttccctaagcgtttctttggtaaacttctaagtaggattttcaaaagcctattatcaacaacaaaacatctaaggcatttaaatatccattcagcagtgcatgtcatgtgaaactgtaacatcactaattatcaattctgcaaagattttgcacttcaacacataaagtattatgctaatttatgattataagagtattcctatgtatacgtagggtgttttgtaggttgcagagattcacgtttacaacttctcctgatgctagaatgaatacagcctagtcctagccatgaaaagacatcaccaggaagggaggaaaaaacaaatactaaaatagttcaaatatcaggcataataaaagtccctttaaaaaggcacatttggagtatactacaattacccacatcagattaagggcatcatgatctgcttcacagaggaggtgacatttgaaatggtcttgacctgaggtaagagtccaaaaagaggagatagcagaagaaatgtgaagaacattctaattcctgaaaccagtaagagcaaagggaggaagagtgggaagccggagtgtttttagaaaagaacaagtgtgaattcactcatacaagattggcaaatgggagaatgattcgggtaagatgcagtggccacataggttcatacacacttcttcccagcataatcatgtttttttttctaccctataacggtagctgaatccaaagtaaaccaacatagctgaagacaccaacctcaaagtactgtgccacaacacagcctgtacacagtgtgcattcacccatatgcctgccttcagcttgatttagccaagcactctatctcggaaatgttcgtggcccacgtcttttccgtcattgtgcatttttgccccatcgctaacacttggcagtgtcagccctttcttataccccttgtcatcaaactatattcacattttccttttaaggtgaagtgatatgtatactgaaataatcctatattttttaatgttttagtgtatctttttgagctgtgctaatactttgatcaggattgttattgttttgtgagttctctaattacacagttgtgtaagtttttagcaggtcagccccaaccctattttcccataagccctgttatttgtaagaataatttttatagaactcctggtgtttgtttgtttgtttgtttgtttatttgttgctttcaggaaaacacttatcacatttgaacataaagagcaatcattcctactaaagagcaggagtgatttcatggagaagatgtaaaagtgaggctaaaagaggtagactaagaaaatgtcataaagaccttagaatgtcagttttagaaatttgcatttattcaatagtcagtagaagagataaaattgttgttatgctttagaaagagtaatctgtcaaagatatttttaaaagtgtatcttatttttctcatgcttctaaaattcacattaagattaaagtaaggggaaaaatctgctgcaagtaaaatttagttagctgagcattgaaatggtgatattttaatagacttagccccaatattcacctagaacgtagctgctccaaaatagcataattaatctatactaactttaccagacatcaaggttcaaaagagaaacaaaaggcaaattaagaagcctagcatttattaattatgaaagaataggggcttttttagtaaatgcattcagaatgaataggataactctattctattctatgtcgaaatattatagagtgtacctggaaggactcatattatttctcatcccatagtcaccaattcaaagccagacttaccttgtttctcctagtgttttctaatgaattaaatgaactggggggatctacagctctgtgtttagccactcccagtccacaactctttcccgcaggtatctccacaatcgcagtaacatcagacagataggtaggtagatagacagatacataaaaatagcctcatgtttggaaaaaatattttaaatgtattcacaagacttatcttagatattcattaattatgcatccaatattgattaaacatatattctctgtgaggcaatttgctatactaaaatctttgtcatcctacaaacatcaactggattctaggatccaagtactgtattgtatgtactagatgttttgagtttgtgcctgacataggacctagcccataatctcttagatggtctcatgaaatttacattctagtgaaggagacagaagaaaccataaaaataaatacaggcctccttaatcgtctgaatctaatttgttccagaaaaatttgttggaaggcaaatattcagagtaggatcctatatataagaaatgtaataatgtattctcagcccatccagaaaccccgcccctttgcccaaataccactaagacacccttaagcatcaatataactatctactaccaagtgcttttacaaaacataaagcacttaaaaaaactaatgacttagttattgcacacctcatgaaaggtgagaggtggtttttacttattctagcacggtggcagtagagatggagataagtggaaggaatgaagatgtatttagggtatttcctgccctacaacagcctatagtctcattgctattcagtgatgcattgaataatgacagactgaatagatatgatctgattcatgtgaaatgtctctcttctcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctggtaaagatcatatgcatagcagagtttccgtgactaaaatgcgtttgcttcttttatcagttattggtaaaatcatcagttattggtaaaattatcagttattttctaaaaagcctgggatgattgtctggcagccaagaatgggtgatacagatagtgcttatatattttcaataataactttaatcacagatacaatttaattactatttattttcaatacaactccccacataatcctttaagcaatacatccggtaataatttttcccagcatggagccatacagcagcaaaatgcttccttaatcttctttcagagacctgagttgaaaaggtgattataagtattctttggcctcatttttttctggtcagtatttcttactgaattctttctgggaacataccttttggttcacttaatatgttttcaaatgaactcacattttacgactgtaataaaaggatatgtcttagaaattttgttgtgaccatgtgcatcataatatcacagccacaaaaattcagaaaatagtaacaccaattctattttcaaaatggatttctgcaacagagtgacatattcagcaatttagccacaagaccctaacataaaccacacaagaaaagtgaacactcatatacttctctgtgtatctaaccactggggtatgtttactctattaatagagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaaggtgagtttttacagtaataatgcaatataggccttaatcatgaaatccaaagtgcacatgtacctgatcaagaggaaggctccgtctataattttagctactcacgagttcagtgaaaaatttatacagtcatttttttggcttagattataggtgatttgggttagacatgactgattgaagagccaaatgcttctctatcattttcttttgaaactgagagcttaatttgaaagcataaaactgtcttacaacttgcaaaattatatcctgtaatatgtttgaaaaatgttgggtgcttttcttttctccctattttgtcaagatgtttcctttaaagtggcccacagtggaatctataggagtggtagggcatagttatcagttctttgctcatttaaattgccaaacatttgtatgcctgcaagtaaataattgatcaatagtaacatgacatgtttatgattcggggacattttaaaacactttcacaaacattgttttatctgatcacataagcaggtattttgttccagtgttagagaaagtaaaatatacactcaaacttttatgtggtcacagacatatatataaaagatctcacaaccaagacagaaatccaagtctattaattctgagtgtagtgctattgctttttaagtatataattgctctaattctgtgtagtatggcattaccaatatctgcaaatgagactttgttacttctgctaatataaatagactcaattaatgttgccaatgccagtgtgacatttcatgaaaatttacgtttaaatttaaatttgtaccgtctttcatttctgcatttaatacatatctgccaggcaccttctaagtaccatgtaagaactaaatgaagttctaagttcttgccttcaaggaacttgcatcgaactggggagatagacaagtatcaatggttagaggatagagagctaattgctgtgatagagatgtatgtagccagcgagcaatctcagaagagagacacttgagtcaaacagagaggtcagtttccactggagtgaccctgaggcacaagctggatgaggagttagctggatgaaaagcatgtatggacatttcagagtagtgaaagttgtgtgaaagcctggagtcatcagagagaataacacatccttttccagctgcatttccaacaggaaactctagagaaacctctcatatgggacaaaaactggctttgcaattctttattttggagtgctgctgcatacattgttcctgtgtaagagaggcacaatgcacatttgcatgtcagaagctctgtgtagttagttgttcagtaagaagaatgtttagctgtttaacccagcatttcccaaatttctttaatcagagaaatccttccattcctgtaatactagcattctgctgaacacactttggggaatgctttagtaactacaagtgaatccatagcctacacgaatgaatgttggcaggaaattatcagtaggggccaagagataacagaaccagtgcataaggggacatatgagctaagtgagtgagtttcagctttatcctgaaagccatagggataccgagaactctaagagttttaagaaagggtgtgatatcataagacttgtgctttagtaaagtttctttagcagcagtttggagatatgtaacaatttaggatgctacggagtctggtgagcctagtgtctccccaccaacttctcttctatagtagtagaataacagatttgaagaaagaaggagaagatggatatgcattataaaagaaaaaaagacaacctaaatgtccatcaacagatgactgagaaaagaaaatgtggtatatatacaccacagaatactatgcagccataaaaaaagaaggaaatcatgtcttttgcagcaacaggaatggacctggaggtcattatcctaagtgacataacccagaaacagaaaatccaataccatatgttctcacttacaaggcgagaagctaaacaatggatacacgaagacgtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtgaaataataaaaataaaaataaagacattcggaacactaagctgaattggctaatgctataaactctaaagatagtaatatgcttggtagatgtacggtataacaaacagggataaaatgattcaacaacttaggagaacaatttttataaatggtcatcttggaaacgctaatttccataatcagtctgctatctcaacttttattctatccattaaaacaaataaacaaaagatctgtgctctgaatcaatattagtcaaaggtcaagttacagaatcatataaatgtgaaagtagttaaaaatatgttttaggtttactgtaactacagcattccatcaattcagaaagttcttcccccaataggtctaatttttccagattttactagagctactaactgttactgttactactctgtggtccagaaatcagaaagaattttcctttatcccagcctactcagtatcttctgtgacatttctggtttctagttcaatccctttgacacagttggctgataccttctcatttataagtcttctccttggctttcaaattgactctagactcacattgctttttgcctttctgaatactcctgtcaaatgcaccaagcagtcattctcacttttattttgggtattaatgacatgaatcattctccttacttctctattgtatctctatggtatcaccgttaaaaagaaattaagccctatgaggtttagttgttcagaattttgattcttaaattagactgggaacttctaccttctgcccatggttgttacccattctctattatctctggtgtctcaccacaaatttctcaagttaaacaggtgaaattttttattataataaaactatagctgttctgtttttccacatgtcttctcatatatccaatatattttctctaatacttttaaagtattttattactatagcaggtcagttaatatgtattaatttttccttataaaaagaaaagcatcgaagctgcaatggaaaaagcaaatgttataaacaaataattcacaaaagaaaaatgcaaacttcttacataaagttgaaaaatgcaatctcaatagatgacaagcatatggtcattgacttgcagtagcaatatccaaagatcacacttaaagcagtaaaatctaaatttaaaaggaaaagaagaaaggcttggcaaaataaccttactacctgctttgataagattagctcttacaggacacatttattaaataccaactatgcatcagatgctgtgctgcatcagtgaagatgcatacggttcctacccttgagtaacttacctgctgcacaagtagcaaattactgtatctgtttaggatacagtaaacaccaagggagacatatggagggagagaaataaggcactaactgagccctaagtccttttttagttgagggggtaggaggggtggaagcagttgcaggcgatccaggccaaaaagcatcatatgaaaagataaacatgtataaaaacatgaattatttgggcagctgttgtaatcagtttgaattattggagtttaaatttcaaaagagtgatagaagataacgctgggcatgttggcaagggccagatcacaggaagctgtttaaactgtgttgaggagtttgcatttcatcttgatgaacttgattttaagtagagatgtgacagggtaatttcaatttaagtatattactcgaggtgtcagtgtggaagacatattgtcagaagaccaaactgaagacaaagcgaacaattggattcaataatagtctaggcaggaggtaaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccatttcttaaaagactaaatatacatctaccatacaaaccaatcatttcactcctaattattcacccaggacacaagaaagcatattttttatagaaagacttgtaccaaaatgctcacattacttttatctgtgttactcaaaaactgaaaacaaatcacatatccatcgacaggtaaatagatatacataaattgtggtatactcatacaatggaatactagcaataaaatactcagcaataaaaaataaagtattaatatagatacaaaatggatgaatatccaaataggcagacaaaaaaggcaaatttaggcagacacaaaaaaatacatttgtataaaattacatagaaaatgtaaactaatctatagtcacagaaagcagacggatgctacttgtgaatggtatatgtacgaaaaggcaaaaaggagggattacaaatgagcataaagaaacttctggggtgatggatgtgttcattgagtgtggtggtggttctgcaggtgtatacaattacatgttacaaacatggtttaaattatagcatgttaattattcctcagtaaaactgttttaaaaataggacagatattagaggtatttaggagaagaaattagtgaagctgttgattgattagatgtggtgaggagaaagtcaggatgactctctagtttagtagattgggtgggggggtcataagaccaacaaaaaaaagtaagttaagtaatacagatttgggagttagatgataattattttgatttggaatgtttagcttaaagtacgcaaggaaaatatagatgatggtgtctcacctgttgaatgtggacttttaggcaaaaatcaggtccaagcatacatacatttaagtcatcaatacattgtaagtagatataaacttgagtttgcccagatggctaaaacctgagatgtgggcaaaggaagggatattataaaacatcaacattttagaagtgttcaaaaatagaccccagggtaggagattgagaatgaaaggtaaaagaagccagagagcttgacattatggaagccagaagaaatttcctatagggaaggaaatgctaacagcattaaatattgcacaaacatgaattcagataaagtttaaaagaactccactgagtttgggtataggcaggtccctgaggactttagcaagaccagagatgacagagtagtgggagaggaattgaaataaggctccagcaatgtggatgattgctccttttcagtgaccagattatttgttttatatgaattattctcaactagttggcaagagcactgtctcttgaaattcaagtacagtccttcaggagtgttccccatctttcttgagtcagttacagaaccacagtccctgacagaagtgtgccctatcccctaaatgcatcaagtaggatgcaaagttgagaacactcaattagattttcagtggatcaagaaagagaacaaaagaataatagccaaagtaaaaacacttagcttataacaactcagcattgattataaaatatttcttaagtccctactctgtgtctattatttaataaaatccttatttccctacctacttataaatcacatctgaactcatcaactgtgaaattttgtgtcaatagcctacttttctattttgtaaagaaaagaaatagggtaagaaataaaagcaagcattagcatttactagcatttcctggtagaacccacttcatcgctatcactcatgaaggatagagtaaagcactccctttaagtcagtaaaaatatgccatcctgtctctctgccagttaccttttgggccagtgaatttcaattcaattgtgttgctgctctttaatcatgttttcttagaatgatttctaaaaatgcatatattcattcatggataaggaggaaaaccacctccagtcactggcttgcctgtgatagagaggcagaatctcattttcagacaccattaaaatacccaccaagtctgtagaaagagactattttcatcttccagtcaacagccccatatgaaaatacctttgccgatctagataaaaaggaatgtatatgaaaaagtcttgaaaacagttttataaatctattttcttttagcccccagtccagtcaaggagatatatgtgtatgaaactaattatgtatataaaaataataaaataggtgtgtgaaagtaattcaattttaaaatcttaacttgctagctatatttaataggacaattattcttttaggtatttttcttgtttgtttttacaaaagtctggtttgaggtgtccattggtatgtgtattttagtccttttttaataaggcaattgtgtttgattttattgaagacacatctttttgaaatgatagggctataaacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagaataaacatttagaaattcccttataacccactggttcaaatgcccattttcaaacccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggcggtagtgagagggatcaatgagataaggagttcctgtctgctttctaaacaatgcagtttgaacagagaagtgcctcatctttccttttttccatctatttctgaattcttatcttcatcacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatatttctaattaattatctgattcctaattagatatctttgttatttagcatttttaaccttgctttattttctaactacttatctagattatagaaaactacatcaaatggatctttgatgttcagttatagttatctcttttatcttcattggtttgccttcactggtgttcaagctattattttcatgctctttgggggatagtttaataatgtattttattgatgttatttctgtaattattaaattgctaaatatagtgcaagtgcttgagaaagtcaatgttaattctcgaattaaaccaaatttgtcttgaagtattaatgatgatatagatgtggttgatattgctcaaataaaatgttaaactttctttctcctttacagccaatatatcaattgtagatatagatactaatcaggaggagaatatagcaacttcgtcttctggaaacaactttggtcttgacttgaaagcagatgacaaaatatattttggtggcctgccaacgctgagaaacttgaggtaatttagtttatatgtaaagctaaggattaagttttaattaaatgaccactatgctcactagagttctgaagtttaattacaataagaatgtcatataacccttggttgcagaaaggcctaatcaaaaacatcatgttgcatgttagaacaacaccaggatttagaaaccaaaggactaatttgacatctttgttgaagagatggattggagtcgctgtttcctttatatgcacctgctgaaaagaattatgaaagtaattaaaggtagaagccagagttgaatgtggatcttgtaattgctgttctccttctacattcactggagataatggcactctgacattgcttagtgttccgaaaattagtcagtgttccaggatgctatgagtataacctattttattgctaagcattagcatcataatggcgtgttggagctttcccatatgcctaatacaagaactatattagttgttctcatgcccatgccaacatttttttttaatttcacatatgctttttagctagcagtatggggagacacatttgcttcctaatttagttagttcaaaaaataaagtaactaaaaaatgtcagaaaatactcacgtgctgtgtagttaatttactgctcattataaaacataacatagtctataaggatggtacttggtgctcaataaatgttaattacactctaattagaatgggattaattgatttggttaaaccgtaagagtttattacagactaccatgtttttaattttttgttttgtttaattagtttggtattttttaaagggtataaaagttctgtccaggtgtttctactccaaaaagacagattatgtttggaaaaatcccagaatagctgaaaagtgtgatggtcagttattttcacatttctaaacgagcagtgaaagttcagtctcattctatgacagctagtgtgcaggctgaaatttcttctccccaaatctaaactcatagatgaagcaactgtctaattatctgatgagcttcatggtgcaaataaattggctctgcattcattgtaatgtatttgtgttagaaaaataaatttaaagtgtcaagtcagaaaaacattacaaatcaaatttaaatagtaccacagttattacctagaaattcatttgccagtcattcaccaaaagtttgttgagtatctactatgtgacaggctccataccaaatactaggaatccagtggttgttcaaatctaagatttgctttacaagatcattaaccatatattattgagtgaattaaatacagccaaacctaaggttattcaaatctagcttcatttattctagtgatgattttaattatcataaaataatttttaggaattatctataaaggtgtgcctgttaaattctataaaatctgttaaaatctgaatctgttaaatgaatctttatcactaaaatgtttttactttcatgatacagcattgcataattacagtatactatttccatggtgtggcacattatttcaaaacagccattagaggtatatttgtgattgataaaggaaccaaacattcatagttacctgttattttgcctgcagacaggttctcagtatgacaaagtgcaaaagatgtggtaaacataaattatttttacatgcattgttaagctcaagctgtttgagaggcaatatttataagccattcatgaacactacagaatagtgacattgtacattttcccatttattagattgataagaacaagtactttaaattcatatttcaaagtaaaaattttccaagctgatattgtgagctacggtcatattttgattctaatttcactgccgtcaagggtataagtctatttttagttctattggggcttttgcatttctttcctttgtagatccctgtgaaatgattttttaaagatttatgattaaagtttattgttttactaaatgaaaatgtaattataagtaaattgtttttatttttgttttttttttcctctttcccgttatctagtatgaaagcaaggtaaaatttaaatttatgcatgccttcttcgagtgcatgggttgggtaaatgtggcttcttagataaagcagccgtgcagaagcagagcaacaccagtacagctttgttcatagtatgtttcacgagcaagccgtgcattctgtgagagttctcctgctgccccttgctggccgacattctgctgcttacccaccatcagttgggctgcaatttgagttgtctcaccagcagtgatgagatttgctctgctcacttgttcaaccatctgcacacagtgcccctggtgaccagcagcacacactcaaaaggcagctggtcaatttctggtacacagtctagttctgggaaacacggtaaagtggtctcttgagttgaaccccgggccctggcctccctagtgccatgctgtctgctgaagaatcaaactgtgctctcacatgcttaccactgccttcttgctttttgcaggcctgcagatatgcaaacatttacacagcctttgcacctcttgtcaaagctgtttatctattgacatgtttatttaaaactagctatggtgccagatgaaggaatctctggaaatactatatttaaaataagtatttgcgttaatagtaaagaagtgtgagatagttctcctagcttctcaggagcattttaattcttactagcattagcataaaagctgtgagcaatgggcctccataaatggctgaacaaacctcagagatgtgcagggctggtatcctctggctagagctaaaagcctggtgttttggcatttcagagcccagctgtgccagatttctggaaagaagataataaagccgaactgatccaagaaatttttaaaaccgaggctagatttttaataagagaaatagaatatacagaaatgaaagtagggaaaaataaaccatgcgttttatcatgatacagttgtaagaccactagttgtgctacatttgctgagatggctaaaaagcgaaggctggctttcatggaaatatatgttaataaaattctgggatggcactgtgtaggtttgtaattttgcctttgagtggtgaccctcaagaaacagggacccgtggttaccattgagtccagtcaccttatgtgactatttatcccctgtaattgtcctaatattgaggttgctaaatcatattttggaatggttctttgtgtttccatgaaacaataaactatataacttgtaggagtgatttactttagtaacaagacctctgaaaaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacaccgccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattaacaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaacgactgatttggacagtgcagaacagacaatatccatcatcacaggaagttctgtggaatagcactgttataattaaagaagtatcatcatcactgacattctgatagcctttgtttgttgagcacttactgtgtgcagtgctattccttaatttattaaacctttgcaatttgattatgtagatactatgattattattatcatgcccatttcacatataagaacactgagtcttggagaacttagatcacttgcaacatctggactcaagggcaaggacttcatttcctaatctgctggcacacttgccccattttatgaagtagtatgcaaaagtaaacattcaagtgtagtttgagtataaaagtcatttttcaattttattgaaaaaataaaatgtatgggtttttgcatttggttgctttattttgttattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatgtaaagcatcaataagaagtcagttaattcctgtacctcatgtttaaatgctgtgggtgagattattgttaaaggggagaaggactacaaaaagactccttctgcaggataacatgaacatccatttagaccaaccagtagataatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaatatactcagtagtcccgattatgttggtgttaccaaaggatgttccctggaggttggtctgtttttgatagttctctaaacacatttatatcagatttcacttacttagtgtggctgctcctacaaggatcagtcttttgttaatatattttacttttctactgatcctactcttaaacgataaagcaagattaaagcattctctaaattaccatgataaaaaatggtattatgaagtcctagaattgtgatccaattttccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattgaagtttacacaagtagcaagtagtaatttacaccgtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttcgtttaactattttgcactgtttcttcagttgacactgacccatatgtgagaaagaccccggccatagctctactctcttaaaatatccataagcaagagtcaatagtcaacagcaaatattagcaagaattttatagaaactcaatagtgatcagcttgtttttaaaatgaaaacgttaaatatgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccacttgaatgatgaggtttaaagactggaacagaactttcaggatcttcattgttcatagctacaggctccaatttggaattggccatagacacccactctgagaagtttgggaataagaaaagagaaaacacattaagaactaaaactgtaaggacccatactggcttcttaaaggaagttttactgagaattttaatcttcaaagcctaactctcattcacattcaaaagatatatacatgaggatggaaactgtccggaaaatgaatagcctctgcacgtggaaattatgattccctaaaggcactttgcagtaaccaggaattattttgcaactaaaatatgaggcagaaatttgatgtggataaatattgaaaagtctgcacagtagttttatctgaactatctaaaactccatgatttgaaaattggaatagaaaacagattatacattttaccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtagaaagtcctcctgccattaaaagtgactatctacatttactgagagagtgatatcttccacatatgtaagaaaaaaaagtcattaggaatgaacatgtctatcaagattcattttaaatacagggaggaggagagaggaagatggcaaggttgtgaaagagtgaatgaatgaatgaatgaatgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgttttatttatttttaaggtttggtcttatcactggggaaaaatgcagacacagataatggtcatacccatctgtaaaacataaacaattaagtgatagagtttattcaagagatattcgttacagtgttttcaaaggaaacttagggacaatctccctagacatgtacctgcttgtgtgtcagtttgacttaaatctttggtttaaacaacaacaacaaaaaaaggtacctaacagtgataatcttctatatttaaaatcaaaagctctagaataaaagtagaggctataattctgattttaacaaaaactgctcagaagatttgaagttatcatataactagaaataatatttcttcaactgctcttaaactttccatgttttcctgctttctaaacctatgatgtatttcataatcacattaattgcatcgaggagggtgagtgagatggagaacttatttaaattttcatttctaatggtttctactcttcttttcctttactcacagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggtaccctcacacctagctgataatgcattttccctaatgcttatataaagcagttaacttacttttgtatttttagtttcgtatcatttatttctgctctcatcttggctagcaaggactgaacattccatatttccatgctggcctcctatttcactcacatcatctccccaggacaattgtcttctctaggatgttcctgttgatcaattgtaggtgcaaagtcaccctcatatttgcacctatatttcctatgggtttaacatatgcatatgtaaagaggacagcttaaaatatattcacattatcttaatttctactgtctccaagtccgactccttaccaaatctgtagacagtcagcttcggtcccttaaatttaaatgtaaattcctctaagatcattttcccagttgcacaagctgaagtaatagtcttttgggcctgactcatcccatcctctctggacacaaagaagggcagaaaatggatctgggagaaagcaagtagaacacaaccaacacagacagggacaattttatcccaatagcattcaaggatgttaaagcctaaagaatgtcaaccagccgggtgtagtggcccatgtctgtaatcccagcactttggcaggtcaaagcaggaggatcgtttgagcccaggagtttgaaactaggctaggcagcatgataagaccctttctctacaaaaaatgtttaaaaattaaatgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatcccctgtccatttgattctgttaaaagcaatccctcaactgcccagatttaagcatcatacctcttattgccttggtattctttaatatcttcaatcacattttttaaaacgtaattttccatttaatctagtttttctcaatgaaagggttcataggaattattttgtctgccatgaccaaaagaacacaatgctttacaaatatatccttaagtatgcacatacccttgtaaaccagatcatgttatttgtgattacgtgttttaaaaatcaattttagtatgtaacatttagtgatcaatcatattatgtaacaaatcttatttatttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagttacttgggaggctgaggcaggagaattgcttgaacctgggaggccgaggttgcagtgagccgagattgtgccattgcactccagcctgcgcgacaatgtgagactccgactcgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatatagcacaagaacaagaataagaacaaatatataatttaagaatcattataacaaaatagacataaagcccatatggagaaaattataaaatttcattgaatgataccaaagtatttctcaatgattatagtcaataaattggtatagtcaacatgttaatgaagatattaaagactcaatattaaaaatatgtcatttctccccaaaatgatatgtagattcaattataataaaaatatcaccttatttttctgtgaatcatgacagcttattctaaaatttatatcaaagatgaaattcctagaatagaagaatagcgtagttggggctgttccaccagatatcagcacattagaaggtaaagttttgtattgtggagctatcatgttaattcatgtataactgtgcaaataggaaagaattgagaaccctgaaaatacacaagcatagatggaaacagcatttgacaataagtggcattgcatttcatttaaaaaagacaacagtgaactgttcagtgaatgatttcagggcaattggttattcatatggaaaagatgaaactaaatttctttttcatatcaaaccaaaaaataaattcacaataaattaaagtcttaaatatggaaggacaaaaatctttaaaattcttagaagaaaatataccaggattaaattttgaccttcgggaaaagaacacttgattgaacaaaacaagattataagtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgttatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagtgttcatcagctggagaacagagaggcaaactgtggcacttttgcataatgggatatcaaggaataagaaaaaggaataaattataactaaatataacaacataataaatagaaaataaataaaaatgaaaaatgtgctatatggtaccatttttgtagatttctcatacaagtagcactaaacaacatattgtttacagacacatgtgaatttcaaaaatattttttaaaagtaaggtaatgataaacataaaatccacatttgtggttacctctgagatggagaagcaaggagatggtattagaaagaaactcataagagatgcaatggtattgtttctgaaatttggtggtagatttacaggtattcatgttattatacagtgttaacgcagcttcatcgtttacatgtatatcactcatattgtgaagaatatatcaaatagtcgtaataaaaatatttttgaagagtagagggagaaaagtgttattttatttcatttcttactacacataataagcactaaataaatataaaatacaaatgccctcgtcaatttttttgtttatcttgaaaaataaacttttttctcatattgcaaatgataagctagttataataagaataccagatcaaatattctgaaatagatttccactaaaggatacttgattccttcatcattgccagatatttaaacactacctactggctccaaatttctcctcttcaagataaaagaaatgaatgtgaatcaccagctttcaggatagtgcttaaaataaaacagattcctattaaaacaattacaataagaaaacactatgtagtatagtataaagtaagttaaaatgacattttaatgttttaacattttaataactcatatctactttataaaatatcatagtatatgctatctgaaggaggaaccaatgttaaatagtataagtctgttagacataattagatttagattcagtgctggttaaattgacaagttttatatttcaaagctaacggttttgatacccatagagttatttgtgattcctttctgctaaatgggtttgatatggcaaaccatccatgagctaaggaatttttaattgagtagtttgtgttttccctttgacagatggtgagcacttatccagatcctcaaaatgttctgtggtggacacgtaactacatacatgatttagtaaattattggaacatgatgatgtttgatggaatctgtctctaccaccatagatgactcatggagaactgagccatcactgtgtggcaggtgcccccatactccacaagaaagggagagcacgtggcatcagctctagggacaaggactgcattcaggctccctggggttcatgatgggatatcaaaaccacactggttgctatagtaacagtagcaagaagaaagcaggcatgcttgtggatgaaaaattatcttccttctttctaaatgtgggaggcaggttacatgtttgtgatagcgatctattctaccagctcagagaacaaattgaagtctaaatactcagaatgccacaaggttgggagtcaggcctgattctcagaagctagctgtccacttgtgaatataagggagagggattttgttgacaccctttgtctcctgatgggttttataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaaccgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgcaatactcctcaacaggggccgtctggaagtgcatctctccacaggggcacgaacaatgaggaaaattgtgatcagaccagagccaaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagcaaaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctgggccagggaattggctttactcatgcacaaactgatgactttctttagaatgctgcaatactttatacttactttattaggaaagtcatctgtatttttcatcaaaatattgtatgacaactcagagagataattagtttagaaggacaattagagaaaaaagaaacagaagcccagagacttcaggggttcagacctccaagccagcaatccatttatcagactgaagacatagaaaagaactggaaatccaatttgatgaggcctcaaaacacagaggatacttttaaatgcaacgagtatgaatatgtagcagtagttcagccaagccaatactatcctgcagtgaaagacctacatttactaattatcctcttggggaaaacatttagataagcaataaagatttcttaccttctaagtaaacaacaaagctttcctcagtttttattattattattattaggtagaggattaggctgtaggatgaattgatacaaagcgttcatgcagaatggctactgagacgtttagaaaccatgatcgagacaaatgagggatcatttatttggacaaactgagaacttttactaatctaacagccagatattgtagtcatggtctctgaggagaaatgcaaactgaatgctctcatttgaatcttagaatgctttagaatcctggtttcacatgtcttctagattagatgttaggccctttgacaaactttaatccttttcattgcggaaaggactttttaaaagatttaaactttagccgggcgtggtggctcacacctgtaatcccagcactttgggaggccaaggcaggtggatcatgaggtcaggagttcgagaccagcctggccaatatggtgaaaccccgtctctactaaaaatgcaaaaacattagccagacatggtggtaggcgcctgtaatcacagctactctggaggctgaggcaggagaaatgcttaaaccagggggacagaggtttcagtgagccgagatcgcaccactgcactccagcctgggcaacagagcaagactccaactcggaaaaaacaaaacaaaacaaaaacatttaaactttaaggaatttcaataagtaactgcagatttgagaaattagtttaccgaaatcactcaaaatgtgttattttgttgagaaagaattctggaattcccaaatgcattacactgttgtaccactatgtccttttaacaggtgcttcttcaagaagggcattttattatgccaacttcacagctgttgaccatcaatccaacctttatttgattaagctcagtatatagtacatcactggaaaccagtcatttagttaattggccatataaacaaacagttttgccattcattgttaattacaggataatatatgacatattagtgtgtagtcactgaactctgtgccaaaacagtaatacatttgctaccataatggctcattcggcactctaaggttaaaatgcaatctactctataagcaagtgccacattaaactgattgaccagagatcgcaagtgaccatgagaacttcacccagaaaaaatttttaatgctttatatgcctattctatggcatgatttgtgtcacatactagacaaagatgatttgttttcattgttctgaatgtatgtgagatctgtaataacatcctttatcacagatgagaaaatattaactaacctgcccaaaatcatgtactacaaataacaggaccaggtattaaatgagatgatatatttgacttaaatacctccatctatgcacagccaatagattattcttacatttttgtgtgaccataaaggtttatattactaaatgttgattatgatgtatgattattaatttggagatatttgcattatcccaacacttttcagattttcagactatgcatgtcagtcatcatttcttttcctaaaatcctggacaaaatgatagctttaataccgcctcacaaaataattggattttcaccaaactgggggccaagcttctcaagaagctccttctcccttgtcctctgcctctctttactcctcctccctcattctctctcccttccaccccttcatctggaaaaatctccctttagtcactttggtatctaatttcttggcactccagtgacctctgcctcctatatctgctttgtcctctgatccttctcctggcatccgccttggtggccagcagttcttactggacaaaaacatcaaaccctaagagcctgaagtagttacttaagcaaataggacaagcaactgaactgattttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggtttaaaaaaaaatcttaaacccacattccaaacaaataagaaatagggtataagtaatcaggtaattatgaaactctaagaatcagccattgaaactgtaaaaaaaaaaataaagctgacctattacaatactaaagtaatacaaagtttaatgtacctttttgcacatagcaggcctcagtaaaaagctgttaaataaatactttttaaaaatggaaaacacaccagaatcataatggacatattggcaatgtccttctcaataaaaactaaagaaatgatctagatttgatgttcctaaaaggtaaaataggagcaggatttagctgtagttttctagcaatgccctttttaagtaatacagcctcagggcaatcccttaattaatattttccgctgtttgaagtaggtatttttatctccatcttataaatgaatgaaatggacctgagcatgattaaataacttgcccaaggtcacacagctagtaagcttccacactagtacttaattccagtatgttcctcctgaaagcccacactcattctccatcaccaccctgtgaattggtttaaaaaaaataagggtcactatgatggtccttgtggcagaaccacactacagagagaggctacaccagaaagaggaaggcctctagctttttaaaattctaatcaagaacagagatttactctccttggacaatctttaacagaggcttatatccttcattaaaaccttagaagccctgtgatatcatgttgctaagaagaggctgctttcagctaaaggggaaaaagagtgtaggggaggggcttctcagtgagtcacacatacccggaagtgagtggttttctgaaattctcgtctcaggaaaccaccgacactcttagcaaggaagctgaacctcctgggttttgccaacacatttttccatagtttggtaaagaaagaaacctcaaaagtatgtcatttccccctattttctctttgaaactaaattttaccggtcccttcttcacccccttaacagtgacgtttttgagccacagcgaaatccattttttgtccctttctcttacttttgaattatcttacttgtaaagtgccaattcagagcatctttaccctggcttattgttttttccagttctacatgtggttttacttctttataaagtcaagtaagagggtactttaggactgaggtttccatccaagtactccggttttctctccagatatgaagtaagttttcagtaatccattcatgatccccaggctagtgactaatgcttatgactaatagcaccatgatgactgttaagaccgaaactcaaaacttgcttccggaacaaaagagaaaatgcctttggtcattttcatcagaactctttgtctccttctgattcttggcccagggatccaaggattgttgtaaataagtagcatgaggttctcaattagcagtgtgtgagttctctctcataagcaaattaggaaaattaatgaaacagccactaaggaaaatcattgcaaggaacaattagcagggtgtccttgcctgcctcttctattcaaaagccatcagctacattctttataaaaggtgctttaagtgtttgctgttgattcctgcaatctaagctctcaggagcatggtttgttccctagcaagaagataatagccagcacaacccaaggaagaccccatgctttgctaaacctgccaacccttatacggttagacattactgcacactgcagaagcctcagttctcacaggctcatgtgttgggctgcacagcgctgttgtcagctctacaagaggctaatgttgcagtgcgccatgacctggtttcagtaaactttcaggaagagtgaacgagggagtcatggaacgagatcctgagaacagcgtttgcttagtgtagaattcctaagcatccaattttggctcccttaaaagctatggttgagaggggtgaagggtggcaggaaagaatttgatttccaactgtattgaatcagatgtgacttatacttgtttatttttaatattttatcagcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtgtaagtggatctcctcattactactactaattttttatttttatttcttgctattaggggtcccaatgcatctacattgtctacagctatgcaggggaggagggaaacaatgaggatcttcaacttagactgagaaaagcacactaatggacttaaaaaggcatgcggggattgggcttaattgtaaggaagcaaaaaaacgaaaataaaaaaatcttatttattacattctattagccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatgtaagtgtttatattatccccattgctttctaatttttacccagtattctgagtcatttcagaaggaagattattcaggatatctagtacactctgatattagaattgaaagaaatataacctatctaaacctattcttacatcttcattgaatgacttacctatatttccatcttcaattttgtttacaaaacagtacattttcagttgaaatgttggaaaacacagaaatatccagaatcatgaataaaagacacttataataccatgacagaggcaaccatgttggtttccaggcccttttatctgcatagtagatgtcctaccttgtatacaatttggtgtcctgtttttagaaactagtaatacaccactaaaactgtttctaggccaggcgcggtggctcacgcctgtaatcctagcactttgggaggccaaggcaggcagattgcctgagctcaggagttcgagaccagcctgggcaaccacggtgaaaccccgtctcttctaaaatacaaaaaaatagcctggcatggcggtgtgcacctgtagtcccagctactcagtaggctgaggcaggagaatcgcttgaacccaggaggcggaggttgcagtgagccgagatcacgccactgtactccagcctgggcaacagagcgagactccatctccaaaaaataaaaataaataaataaataaaaactgtatctaaacatcatataaatgtgtatgtctaatatgattttatgttaagtatatatacacacagagacacacaactattttatagtattggaggtcatatagccttgattagagcatgggctcaagtcagactgctggtattcaaatcccagcactgtaaccgaccatctgtgtgaatttgggaaagctacctgtccaatctatttctcagtttcccatccaagtactaaccgggcccaaccctgcttagcttttgagatcagaaaagatcggatgctttcagggtgatttggccatagactatttctgtttcctcatctgtcaaatgaggatattaacagcacagacatcaaagactttgtatcagagttttaaaagataatgtttgttcaatgactcacatatactgaacgtttaataaatggcataagtactatgtagtaatgataataatgagtactttcaccagcccagggctaaacaattttcattcaatattatatgtaattctcataacggctctgtaaaatatagtctttctacttttagtcgagttaataagaattagctatcttaagcaaccaacccactcacaccactagtaaaaggcagagtaagaattttattctagcgagtcagactccaaagtctgactccttatctctggaacactctgcctttccaatttattctacttttaatagaccatggtaggctattgagagtgtttccagtttttcactattagaaactatactctgatgagctcctctatgcatcaagctttttcattatttccagttattcttaaaatagataagtagttaggaaattataaggccaaaagatgaatatgtctaaggttttcaatacacatacctgaattgtttcttccacaggctatgccaatttacattcttatcaccaatacaacaaagatggtcacagtcactacactctttacagctcatgtgttgtggttatattccataccagtaatgggtgggcaatgttgtcttgagtgcagatcttgaaaactcttgaatatctcattctcttccttagtgtccacgatggaattggttgagcaatgtgctccttgcactagaaatagttattcaatgagaggccagataaccatcattcaagaaaactggttatttactccaagcatcctttcatcctttgtaaaatagagatatttcatctatcttgcctacaacatagagttatgaaaaatcaaatgggataatgtatgcggaagttatctgaaaactggaaaaagcatacccacatagacactctgaggaatccctgcatttagtgaataactactatgtgtccagtactctgccaggcatttcatatctgttatttcattttattcccaccctattgttttatttacatttatttatattgccagaagtattatatttcacaaaggaaaatacctaagatcacacagctagcaagtggaaagctgtcagtcatggggggttagttccaggagttgatttcatcctaaagcattcctgagatctgccacatggatttcagaatgtttcctcagctctttcataattcagccacaggttagatctttgcttagcaaaggtaaggttaatgatcctcctcttcaccctcatatacctgaaaatcatgtgtttctcagactcataaacatgttttcagttgaagaattagaaaacatcatgagttgaataaacttttttgaccttggatcctaatgtccacttataaaaatgtttctaggagaaaacagcctaatttctaaatgactaacttaaaattataaactaaaattggcaagagccctaaagatcatctggtccaatcaccatcttaatgcatgggttccttttacatgatacttacagcctttgcttgaacatttcattgacaagattttccagtgttatgacaaggcaggctcgagttgttagaaagccatcggttacattaagttaaaactgagtccctaaaacttctatgtaatgattgtatttctataggcaaacacattacatttatgtgtcctctgtctaacatcccttcaataatttgaaaatagctaagtcttctccttccctaggctaaccatttccctagcttaggtattctttgtattatctcatttctaattactatcccctccatgatcagtattcttaaatttgaaatattcccttcataatatggcacctactgctcaaaaggaagtcaccagctcaggggacagtgtgacccctccctcccttaattgttaccatatttctattaatgcacctaagaatgttttaatgtttttaatagatatatcatgctactaattccaaatcgggtaccatattcaatcaagcagaacctcatggaccttcttctctaccactagaacatcctccaggcaggtctctcagcctgtgctggtttggatttttagggataaccctgccagcctccatggatcaccttacttttctaagtacttacacaaactgcattttatagggcctctcaagcacatttttctgtggtatttagagatcacactttttccttttttctcaaaataaagatacttgcccatctgggaatggagatttttactcatttaaggttcttttttttttttataaccttctgttctaatttcgatttccatttcctctcagcagtgtatgttttaacttttccgaaaacagagcattccacttagtagatgagacagaagcaaaaagttgagtagcatgccaaattggttggtttagaaagaatcacagaacattagagctagaagacaccctaaagattccaactcttaacttgcacatgaggaaagaaagccctcaaacttacagcatggcccagggggttacacacatgagcgatagttggcactaaaacccagatatctaaattccaactgctatttcaccttctttttgtttgtttgtttgtttgtctgttttttgagatggagtttcactcttgctacccaggctggagtgtaatgtcacaatctcgtctcactgcaacctccacctcctgggttcaagcaattctcctgcttcagcctcccgagtagctgggattacgggcatgcaccaccactcttggctaattttgtatttttagtagagacgggatttctccatgttggtcaggctggtctcgaactgccaacttcaggtggtctgcccacctcagcctcccaaagtgctgggattacaggcatgagacactgcgcccggcctatttccccttcttttgcacattataattagttatgactgtgtggtcagaattagattttttagaactttccatctctattaattgtattatattttagaaatcagatcatgaagccacacatatcttctgttttaatttgtttcctttcttatgttctttttgtgtgtgtagggggaaaagggtgtcttctttttaaaggttactaaaagttaaaagttttacagtttattttgtaacaaatatttattaagcacctactaagtgcaaagatgaatacgatattatcattgctagtcagagaaaaagagggagagttgctttttctgccatagccctcccacttttattccatgaattctggcaggttacttgtcccttctaaatgtaaaataattaatggacaaataaggataataatatcttccttctaggattactattatgagggaataagttatacattttatgcaaagcacctagcaccatgcttggctcaaagtaacattccatctctctatttattcttttgttagtttaactttaacttctgtgtttctttaacttaattattctagttagtttaacttttcacatttttagggtgggtggcaggtgctggaaaaaaagggatgtggtgagtattcaatttttaagcaattccaaacccttttattggtttgatatgtaatgatgatatatacattgtaatgatgtggttattaaataagtcctctataattttcacttctcaccattttccatttttgtatcagaatttagattctttattttttttttcttgctctgtcacccaggctggtgtgcagtggcgcaatcatggcttactgcagccttaacctcccaggctcaggcgatcctcatgcctcagcctcctgagtagctgggactgcaggtgcattccaccatgcccggctaatttttgtatttttaatagagatgggatttcaccatgttggccaggctggtctcgaactcttgggaagtgatccacctgcctcagcctgccaaagtgttgagattacaggcataagccaccacgcctggcccagaatttagctttttaagagttgttatttaagaactaagacttaaaagttaactcctgaagtgagaactgcctatttatgagctccatatttgtgctagcacagttgacagaaaagatctattctcagtgcccttctttttcttctttacacccatcacacccaatcctgccagcaacttacagcatgaggacaacattcactatactacagggcaatgtaagggtgtcttgagaaagccctgccttgtgaaatggattatgtcaatcttatgattaattcatgttgaacacgctagattaaagagcatttcatgcatattatctcatttgatattatggtagcttgtcttctctttatacttctctcttattctttagcccatcgagagctagagaaaacatttctacatgttctatttgtggatatttttcatggaggatggcaggaggtagaggtagataagaggctgaacttcaagtattacagaaatttgttgacatgtggaaacgtgacaagttctctgcaagtatgtgcactgtttagaccaagtctttttaacaaggatagcctgtgtggatttgtagataatgagctggctgcattcttttacttgaattttattgaagagttcagccgtaaacctcacagtttaaaatgtgaaaactaagaaaaacaatacaagtagccatggagaattcctgtactgatgagctctctttgggatttggggaaaagaagtgagcacagaaggaaagaatagaggaaaggaaagcgatttccctagcagctttagtgctacacctttaagacctaagtacagtcaaggccaaaggataaactgattggatactgatatgtatttaaagagaaaacatacattttccacttatcaaggaatccttgtttagacattaatgtataaatattactgtaaatgcccaagacccaccaaaagagcttaagtgcagtgttaacaataattcagtttctcaataaacatcttgagtagggcttttatattttagaagaagattaaagtcagtgctataaaaagtatcttccacttattcatccataaagaaaatcatgacaaataagcaccagatgtgattttagcccacatttattagagaaattaattattgactcatgaaagaagaaaattatgcaatttctatgatgattcattgtttggtgctttcaagaacaaagatgccagttttgataaatgtaatataaatctctgctcaggacccaggaaattcaagagatgcttatcaacgaatcatacgcactcctgaatctaagaactcatttccaaatgtcagccaccaatctgcagttagttagaaaagaccattgctttattctgacctgaagttaaatgagtgacagtgtgggggtgaaaacgttttggccccgttaccaatttggtgcactatctacttccctaaacaaggctttgggagcatggcttcctccataattattcccaaccacatcactgctctaatcaacaggtgcaccaccacgcgagactccccacccaagtcctgtctgcctacaacttgtaacctgccaagcaaaggcaaatgaaaaacaagcgtatctgtcctcctttcatatcccattttccccattatctatttctagtactttaaaaagtccccacaaggtggcagaattgtaacacgttgagattgatgagcctctactgagactgtgaatttttttttttattattattgttgttttaacacatttgagagattagtgcgtccaaaacaacacaggtaaagcatcacatccatagagatgaggacgccttcaagtatacactagcttagaaaaggatgattcatcttgcaatgaccattctttaaaagttccttaaaattacctcattagatcttttctcttacccttttttcttagcttagatttcagtggcaagcagagttgaaaacatcatccttagtgacaagatcattttatttctgagcaaagcacagggcagtttctattccatctcacttgttccccctttaaaatgctagaaggaaaaaagaagcttgagcagctggatgagcagctccacccactgtgggacatgaggcagaaggaagagaagaggaagcaacaccgggcaaagcaataaactggtgctgccctgaacacatcatgttttttttctttttgagacaggttcttgctctactgtccaggttggagtgcagtgatgcaatcatagctcactctaaccttgaactcctaggctcaagtgattctcctgccttggcctcccgagtagctggggctttcagcatgcaacaacatgcccagctaattttttatttttttaatttttttgttgttgttgttcttttggagagacagaggggggcaggggtcctcactttgttgcccaggctggtctcaaactactagcctcaagcgatcttcctgcctcggctttccaaatgctgggattaaaaacatgagccaccacgcccatcccttacacccatcagacttggtttcagtttacccaaggaaaagtgatgcaaggaagacaccctttaaccaagcaagggggaggtcgagatttgtacaaaacactaccaaattagagggtggggaatttttgtcccatttaaatcctaaggtacatatttttaaaaaccctcttacaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaactcttttccataacattggctcatctgagaataccgttttattaagcactgcttctgcctgcttcttgagggctgcccgttgcagaaacggaggatctaatccaggaggtgttcttcttcctaaatttcaagtggatgtaacctgtaatgattcttaaaagaactttgacaaagtccctgtccttttctggtcaaaggtttttttctaaaatggcttgaccagtgccttgtccatctagaaaatctcatagtatacaacgaaacaacaacaaaataaaaacaaaccaaaaaactgctgcttagctcaggaccagttttggatacacctgtccagtctaccagcaatccaaaagttccccataacatacagctgctaccgggagtgtacaactgccaccttgaaaattttttaaattttaatagagaagttatattgacatttacatatagtaattagacgagtgactgtaaccgcaataatatggacataacccactggtggttctcttttaagctacatgtaattgtttcctaattcctcagcatccatccacctttcttaatccctcaattttcagagctgagggtgtaaagatgtttcagtgaaattctgcccccagtggactcacagcagataggattatcttagtgatttctgaggaagactgcaagctgcgtgtgtttatcgagacggtcctctgtccgggaaatatcgtgagaggctgataaaagatcccaattctattaatagaagtattcatgactgagatcttaagctacagaggcctttccattcgggctctttttgcaggcagcgtaataagaaaggtgccacatgctgcctctaaaagaggccattcagctgtgcgaatgaatagcattttcctgtcctacccacggggttttgcatagctgtgtgaatttcggccacagtctgctctttataactgaccatctcctgggaagcaagaagggaaatacttccatgaagaccaattttacggcatttcaaaacactttaagccttttacctgctgtggcagagtgcttcgtttgactaagatcaagagaaaagagaacaaggcttttcctcatcaagtaaaaatttcctgtgtgctgatgagtcatctctgaggtacactctttgggaagaacactgtgcatcaaaagcctgccttgggctgcttgagaacctctgctgagtcagcactcactggggcagcggcccagccagagctattaagtgcagatcttaaaaacagatatgttggtgagagtgtgcaggttattttctcatgtactgcatgttctaagagatgtcataagcagcctgtatatcgacctatcttgtgaaaatagagaacagggaaaggaattgtggctttggtaatttaaggagccttgattatttatggagctgtgtgttatggtagccaaatgtgatctactcagccaggactgctgtatgctttgcaaggcccagtgcaaaatggaaaatgcagggcccctcactgaaaaattattaagaatttcaagatggtgacagcagagcattaaaccatgtgactgcacagccccgcacctagctctccccctcagcaccctaggaagctgatctttgaacagtggcagttgaaatggtgtatggtgggttacatttttaaaatgtgctgggttgcctagcaactggcaagggcctgaatgggctgacgtgcaggtttagatacaccatcttgaaagtctacattcatggaaaccttctagtggactgataattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgatatgagaaaactgattcacacgcactgagcactcaataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaaaaccggtatgtatcatcctgagacactgggaaagaaccgataaatgaagaactgagtatttgtgtttaatcaagttgaatctactacacttattaattaatgaagttagcttttcttttattcactgagtacaatagagaatagaattttatttgtctgagcctgaggagcccaatttaggaaatcagtagcctgataaagtcctcatctctgagaaggttttactctcctttatgaaaatgcagccacgatctgataccgctctattttagcatgagaatgctgttatttttctgtttgactttgcatgcttttgtttcacagtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaaggtaatagtcccctggatattggcagtaccctaagggaattactgagtggcagccatcagcattctcctggtgccagtatattttgccagggcagacactgactctggcagaagctaaaaataaaataagtgccatatacaactaccacaatcttggaaaatgtgctcagacctgtgtaggtttgcatttgaccactggcatgcctcatcatggttccatcactgctatatggctgtggttttcaaacatctacccataaactgaggccaggtggctgaagacatttccactgctctaagtgagaaacgtagaacagagtgtgttcaccatcaagctcgatgtattcaattttaaggaataatatttattctgagattatattatagcatttttatggtggctaaaaggcctttctattatgaaatagtatttgccaaaagcaaaagttggcaacactaaaatgggtcccaagactccccacctaaccacacagtggtctgtgaaaaccaggaatccaggaatctctggttgatcgtgtttaaagggctctaaggtatcatttctactgacagttatttggaacaactttaaaaacgttggccttacacccagaaactggtactattatgggcacagaaggctcatttgccagcttactgtcctctttggcatgactgcaaatagataatatactgcctgattaaaacaaaatctcaacatttgtctctgcacctgcgatagcctattaaagcaaagcttccctaggtagaccaataaaatttttaattttcagagtacgatattattagatgttagatttggttaatgttaacatactttgacttgtcatattctagaaagccaaagaaccttaaaaaacgcgaagccaaccaatttgttatcatggaaataagaaaaggaatcttcatttttgctgggagcttatgactagcaaatacagatccaaatgaaggagctctcattaagagttcttccatctctagctaatagaataataaatatgacatttgagaaaaagacatattgttgaaccacaatgaggctgggattaagaaagggaacttaaatactataattagtcaaattaataacggattttatttttgatggtttttaaaaattacttcccaaaccagaatagatatgtgtaaaatgaagtgtgaaattactctaatcctgacccagactcatttttaaaccatcatggtactttagcatttcacaggctttcatgctcctttacctaaattcagactcaaggtttttatactccagccagtctttacaccccttatttcattctgtctcagaagataattcactccaccgccctaaatttcagcctcagtcacttctctatcttactcccccactttgtactcatcaggttctgcagaaagtagtgcagcttatttgtgccactctttctttaattctgcacaagaagggcctgttaggcaaagggatgtagcgtatctgaaattgtgttgggagcccaggctctttgctcaatcaaactaatgcacttttaaaactgtgcatgaattttgctacccacttaatttatgaaagtgctattagtctgcagggttccttacaacattcctccctctccacacatatccacatttggcaatctaccgaggagacttcgacctaaaactgacccaggaaaatttggtattcttttggtgatagtagtcatggaaaagacagaatttgagatattctgtaaaatgggtttaactttcccatatataatgggcttagcgcatactaagcactgtgtacattgtttcaatttttcttggtaacatcgttagagtccttatgtcttatactctgcatatgtgaaatttgttcaggattggcattaatgactcctttcttttttgtagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtaaatatctgatttcttctttattacttaaatatatggctgattcatttattgatatattttgacttattaggtcacatgggcccatgaaaactgataggtgaataggaagtcatcttttctgataagggacagaagggtttgttgtttatttgtttgtttgtttgttttgagacagagtctcgctctgtcgcccaggctggagtgcagtggtgcgatcttggctcactgcaagctctccctcccgggttcacgccattctcctgcctcagcctccctagtagctgggactacaggtgcctaccaccacgcctggctaattttttgtacttttaatagagacggggtgtacttttaatagagacggggggtttcactgtgttagccaggatggtctcaatctcctgacctcatgatccgcctgcctcggcctcccaaagtgctgggattacaggcctgagccacctcgcccagctgacagaaggttttttagatagattagattatgagagacaatgccatggaacactgagtggggaacctggagccaaactgtcttggtttgaatacctatttaactattgactagctgtgtgttttggagcaagttaatctcttttaacaaagatttctcttttgcaaaacagggtaatgataatactaaacaaaaaggattgcataaagattaaatgaggtaatttatttaaagtgattgggttgggcgtggtggctcacacctgtaatcccagcactttgggaggccaaggcaggcagatcacttgagaccaggagttcaagatgagcctggccatcatagcaaaaccctgtctctacaaaaatacaaaaagttagccaggtgtggtggtgtgtgtctgtagtcccagctactttggaggctgaggcaagagaatcacttgaacccgagggtcagaggttgcagtgagctgtaatagcaccactgcattccagcctgggcaacagagcgagaccctgtctcaaaaaaataaataaataaataaataaaaataaaaataaagtgattggaagagtagcaggcatataaaaagcactgaaagatgaaaatgatggtatgtattcatggtgtttcaggcatagagatttagcaaatattgagaggtgcagtagttacagtacagttatccaattttggattcagaatttaaagccctcacagttttgtaaatcaatattcacaaaataattttttattagaccgtgtatcctagtttgctttggaaagtgttactctgagagaagcacgggggattgattggtgcttttagagaacacactagatacaaatgtgatacatttctatactcaaattagaacacatgataatgtagatttgttcattcatcaaagacaatcacccattatagttgtaattctcagtatttggcttctcttgtggatgatcagtattacttttctttcataggtattggatatgctttttaggtctatcaaaaactaaagtctctgaagtgacactggtacaagcaattcacttgaatttctaaaaacagataaaatataatggaccagagtgtgattgagttacttctaaattccttgaacccccaatgtttcatgcaaactttcaagttttatgcatatttgcattttcttaggggagggtctgctgctttcattagatattcaaaaggaagaagcactgaaccaaacctaattaccttttcaaatagaaattgaacataggctatgacaaaatgggtatatagtaaggttaataaactattaatagaaacataaaatcaggaacgtaagagaccaattaaaacttatgataccaacatggggcccatagctctgtcaaaccaatggagacatagtgtgcagtatttagactatgagaacagtcatattccaggatagacacatccaagttgagaagcacaacacaggattttctgcatccatgccaggaggcctggtggtaacagagaacccaggcagctttgggggatatcccatcctaagacaactggataactacacacatagagcaccctgcaaatgactgtattctacataaaggcaaagttctgctaaaacctgacatttgtttcttctgatctgaatgtttaggtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcaggtaaggctctttcatttccttcctgttgattattaactagatacaaatactaacttcttgctagtaccaaataataaaagttcctagagtcctaaactagtatcctttatttaagccaaaaagaaacttatggaagtaatttcaaaaatgcctcttaaaaattcatgtatctgatcctgataagaattaatagaagaaataaagtaaaaggtctatttagagaatttattccatctccttcactggaggttaagaacagcaaaataaataattttgcaagaacactcatatgtttatactatgttgtttttctaccttccagtttctggagatgagatatgatttttttctcttttcaattccctgcaaggctgtatttcataatctcctccccatcaacacacacccatacacacaatgcacacccatgtctgtttcttgttgatagtgacaatgactggcatctttcctggctttctccactccgtttctaatgaacatttccagtatggttttatatcactggtcatgaaggtacagttaggaaaaagaaataggaaataacctctacataataattttttaatcctttaatttttaatttttgtgggtacacagtgggtgtatatatttatgggtgacctgagatattttgatgtaggcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttctttatccgttcatctgctgatggacacttaggtggcttccaaatctattgtaactagtgctgcaataaatgtgggagtgcagatatctcttcaatattcttttgggtatatatctaagagtggaattgatggatcatatggtagctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttgatatacctgtttttcatctgaatatcttcttttgagaaatgtctatccaaatcttgtacccatttttaaatagtattattagatttttttcctatagaattgtttgaattccttttatattctggttattaatcccttctcagatgggtagtttgcaaatattttatcccattctgtgggttgtcacttcactttgttgattgtttactttgctgtgcagaagctttttaacttgatgtgatcccatttgtctatttttactttggttgcctgtgcttgtgggtattactcaggaagtctttgcccatttcaatgtcctggagaatttccccaatgttttattgtaatagtttcatagttggatctcttagattcaagtctctaatccactttgatttgatttttgtatatggcgagagatagggatctagtttcattcttccgcatatgaatatccagttttccctgcaccatttattgaagagactgtcctttccctaatgtatgttcttagaacctttatggaaaatgagttcactgtagatgtatggatttatttctggcttctctatcctgttccactggtctatgtgcctatttttatgccagtactatgccgtttggcttactatagttctgtggtataatttgaagtccggtaatgtaattcttccaattttgttccttttgcataggatagctgtggctattctgggtttcatatgaattttaggaattttttctatttctgtgaagaatctcattggtattttaatagggattatattaaatctgcagattgctctgggtagtatggacattttaacaatattgattcttccaatccattaacatggaatatcttatttttgtgccctcttgaatttcttgcatcattgttttatagtttttattgtactttcctctaagatctggaacacgacaaggatgcccactctcaccactgttattcaacatagtattggaagtcctagctagagcagtcagacaagagaaaaaagtaaacggcatccaaggaagaagtcaaattatccttgtttgcaaatgatatgattttgtatttggaaaagcctaaagaccccaccaaaaaaccattagaactgataaattcagtaaagctgcaggatacaaagtcaacatacaaaaatcagtaacatttctatatgccaacagcaaacaatcagaaaaagaaatcaagaaagtaattccatttacagtagctacaaataaaataaaatactaaggaattaaccaaataagtgaaaggtctctacaatgaaaactgcataataatttttaaaatctgcaattaatgtactttaagatagaatattcagtcccgtggtatcatagaaatacgtgtatgttcattagaaataaactaataagcacataatatgtggagattatgatgggaaacagaaataagtaacatagttctttctatcaagaatatattatcaactggtaagaaattgaaagaaggcaagtaaaaatgattaaagacaaaaaaagcacagttctgtagatacttagaaaaaaagattaattttgtttgggggatatcaggaaacgtttcatggaggaatcagcatttgagcaaggcttcaggtgattttaacactcccatacaaagtagtgggtgatagaagagtaggaccctccaccaaaatataggtaggaaaccccacctacagggaagcagaaaacagaaaaacacaggatatgttaaatattgaaacgttacaggttatgctgaaccccgaattccatgtgctatgaaagtctaaaagcttcccccaagatttctgcaaattcacagatggctggcattctcttagtcaaattttatgacaagtttcagcttcagcttttgcacttaatggattgacttgccatcctgcctgggctcttataattctggatcaaacaaaaccagaaaattactcacttcctctgtttctaatgtcccttgccatcccctgaacacacagtgtaatacaatttacataagacttgggtggtcagaagagatcacttcactggaaaacatacaattcatcttaacctttgacatctttgttcttaaaagttttccagcgacccaatcactggggcttttttttggcctcttcattccttctgtcctcagccgaacttcctcatgtcattcctctcttctccttacttctccctttctgttttattttgcagagcaattcagcttcttctaccctttactttattttttcgtttatttccagaaggggtgtcactatgttgcccaggcgcaactggctagcttttattcataaaatctgctataaacccacctttgccaatccaaacccatcaaggttctcagtagaacaaaagtctttcatgtaacagctaccatccttcattgcagacagccgtggctacacatagcatttatttcttgcctaataaatagaagacttggagaaaattcccctgagtatttctctgatactcagttcagttggtgtggtctagacagatcttaacatatcactttgttcctaagtgatgtatctatcttaaatacttgctcaaagattaaaaaaaaaaatcaaagagtcaaatatggaaaatcatagaggaaagaattaattaactggatgaacaagataagtctatttatgtcccagaagcttcccatcaacattgtacttacagtttctctctttattaataaaatgtgtggcaacttttgaaccctttcagatgattgtggcaccatttagtgtgccccactaaaactttactgaaaaataactgaaatgtttttctttacccaacagagagacttctaagataataatacctgacagtgagattctttaagtcaatctcagtgtgtatccatttattcaaataatacatagtaaaccctcatgttgtgccagatactttggtaagcacagggataaaatggtgaaaaatatagacaatgcccctgatctcatagcacatacattctaaaagggaaggtagcccagaaaataagcaataactaactatggagtgtgttacatgatgcagtggtggaagataggccaggcaggatctgaaacttatagccctcattagaattagctagcatttgaattgaaatataataaaaagtcatgcattgtacacgtttgaattaacaatccccatcctctaatccaaaatattttaaaatcttcattttacagttggtggattcaaagtgggattggaccttcttgtagaatttgaattccgcacaactacaacgactggagttcttctggggatcagtagtcaaaaaatggatggaatgggtattgaaatgattgatgaaaaggtgagtgtcagcaatgcaaacatttctgatttcttcatgatattgttgatgtgtagatatcatccatgtgtgggaaactcgaatattttgaagcccggctgtattctttgttgggagaaagctaaattgtatgttttcatccttctggattacttcaatttgtgtatgttttcagcatgttgtaggccagtataaattttaaatgcattaattgtacagcaagccaatcgtgttgactaataatgaaccaaatagtttgagatctcgagttcttactgtgttgctataaacacactcttattctcctcttaaggaacacacagtctatgagactatggactccagtgggagaaaaggcagagaggtggatcatctaaaattagtctgcctcttttaacaggctaggcatctcttagaagccaaggtagccaactgacgcatcagtttctcaatttgtttaaaaaagcatccagctaccatttcaaaaaacagcaaatttataaaagtagtgtgtcagtttgataataattgataatcaaattctaaacacctctttcagccctgcagtaagacaactttgcactacaggcagcaggtaaacagagaagggaaaacaagaaatttcacaagttttctatttggttattaaataggaatcgtacttcaactcagttcacgtttccacccttagtgttgcctcccaagaagaaaaatcacacagtgacctaaaatagttttttcttgctttcttcctctttctgctcaattttcaaactgtcctccaacaaaggtaatataggaaaaaagatccaccagcttagaggtaaaaaggagtgaacaaataagtaacactcaatagttttaccaaattttcaaacatacttttactacatctttttcaagtaacatgctcttaagggcagttaccatcgatatgtcactatcatgtgcgtttctcaccaagctccttttacatgcaaaagcctgttatgcaaactccacccaatatagtaaacatttcattaataattacatcaatagagtttacaaacttttcacctatttacttgcatttttaatctttcttcttaagacttcatttcttttcttttaccttgtcgaatgtcttgccaaactgactaatgtttttagtgtttcaatatgtttcgtttcttcaccagcttcaaaagaattctgtcatctcaaatttcaggggcttttccacattactaaaaacagatttttctcatttagaccagaacttctagtctaagttcttcattgttaggaatttaactggccttctggctcaggtctttggcacctgtgacatgaaacgggctccaaaatgtaatttatgtaactctcaatcttgtatataaaatgaaatccatgaaggaaaaaaatataattaaaacatcaaaagtttaaaatttaaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagtttaaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccaggtgagtgttggctaccccagcaacaatttctttgctctcttatgttactggttttgaaaacatttatatttacatgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatcataaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgcctcttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataaattccaagatattatgaaggaggtaatgtacttctccattcagtctatgataatgggatcctaattaacacctagtaggcctactgaaacaagcacctctataataagaggaagattctacatgaatatccaacctacttaacctttagggatttatttttacaatgtaagaaagtgataaagtcaccttcaaaaagttctaagtcagtacttaaaagtatttgatcaattgctttgtttcatgaagtaacattttacaattttaagtcacaactataaatttgttcatcccaaaccaagttatttcatgtcttaagatgtataattctagatgttttcatatgttataactattaaaaagttgaggctggacatggtggctcatgcctgtaatcccaacactttggaattacactttgggcatagatggggagatctcttgagcccaggagttggagagcagcctgggcaacacggcgaagggaggatcgcttgagcccaggaggttgaggctgcagtaagccttgattgcgccattgcactccagcctgggcaacagagcaagaacctgtctcaaaaaattttaagttgatctttctttctttctctacaattctattagtaaggctaaaaacaaaaccactaactttgcataaaacagcattccaatttaatctcaagctaacagttgactttgaaacatgctcttaatatttggtgcaggacatttcaaagctgagccctcttgcattgcctttttcagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaaaatattaaactgattatttcattctaaataattgcctgttttgtgtgattttaaggataaaaggtaactggccataaattgttgagtttgcaacatgccctccagtcatctcaaggaaagagttcagatgtaatttatggaggcaattttttttaacttattcctatcaatacttcttctttcttttatcatcctttaccatgtatgacagctttggccttctgtccaagccactgacagcaagtgaatttggcatgtgtgattgggaggaaatcagttcccttactctatttatgaaagaattattagcaaatcattgtcctgacccaagttcattattagagagtttaactagccgtatgagtgaatagctttttatgctgaaggtagagggtatagaccagattcaggccagaaagcttaattacttgattttcttatttgataatgatttatgggctttggggagatgccaaaaccaagcttatgaatgacaaccaagcacacatttgatactacagtactaagaaagatttggggctctctaagcctacagtgaatatcacaatttacacctaggtggagaggaataatgctgaaatgcatttgtacttatcaggaaacaataaaccagaaacttaaaaggcatacttcattgagtcttttggagctgtaatttgacctaacaaattcattttctataaacgttctgtgttttgttctcctttaacccatgatttcagtcatcttcaaagagctctgtgagaagactggccttgattttattcaccagcttaaaaaggaaacgtttcatttgccatctttagtagacaatggttgcagtctaataattcagaacatgtaaaagaacaggaaactcctttctcctatggaaattttagcaacaaagaataatcctctctgacaatgttgttatccactaggggaaggaaggtgctgtttccaattgaggtgatggctgacatactcactatttcaccaccgtcctgttgcttaatacaatttgtacacacaactttattctacagaagcaattctcaagcttagctcagtgtttttaaaaaactgcctatgctttagaaaagtgcctagggagtttttaaaaatctagtacctggtccagtgattctgattttgtctaggacatagccagagcataatgattttttttttttttgagacagggtctcatgttgtcacccaggcaggagtgcaatggcaccatcttggctcactgcagcctcaacctccccagttcaagtgatcctcctgcctcactccccaagtagctgggactacaggtgggcaccaccacacccagctaatttttatatttttagtagagatgggtttcaccatgttgcccaggctggtctcgaactcctgagctcaagaaatctgcctgcctcagcctcccaaagtgctaggattactggcatgaaccactgtgcccagtcaagcatgaggattcttaaaaacattcccaggcaattctaatgtgttgtcaaggatgaacctaagaaaaataagcaatagggaaaggattccctatttaataaatggtgctgggaaaactggcaagccataagtagaaagctgaaactggatcccttccttacaccttatacaaaaattaattcaagatggattaaagacttaaacgttagacctaaaaccatacaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccagcagagcgaacaggcaacctacagaatggggagaaaattttcgcaacctactcatctgacaaagggcta

SEQ ID NO: 11809 - DNA, 116425 bp, Human
atgggatgtgatattgattaacttggatgagattttgatctggacaggagcagactttttgtgtctgaaaatgggtcttaattatattaatagaatagttctcgtgtctggtagggatgacctctcaagccaaggactctgcctgagatgtcattaagggtgggaaagggaaatttaccataatatggttgaaggtagtagtggagcagtttctggatagtccctctttaggttcagcccattaaaaaattcagttacacgagcaaacaaatcaataacaagatgatgtcaactgttttatgaagatgaaacagggtggtgtgttagagtcatgactggggtgagggagggctgctctagattggaggtcagggatggctactccaggagctgatatttaatctgagaggagcagtgatgaggaactaccctctaacatcctggagaggaaccttccagtagagggaagggggcattcacttggcttgttcaaggagcagagagagggccaaggcagcacagtgtggtgggtaagggagagcaagaggccagatgaaatcagagcgggggcagccagctagggtttgtaggccaaggccaggggtcgaggctttatttcaacagtagatattacctgggcttgtcttttgtgtggtgtgggaggttgtgaactggtgcccacatgccagctccttcactctgcctctctgggaaataggctgtacaaatgtgccaggggcagccctgttgatccaagcctttaggctgtagggagggagcatgggtgagaatggtgtgctgattactggggacacgcagacagcggcagtcagcattcccacacccctgcccgcctccctgctaacacaagatgtgaatgcacacactgggtcaatcggggtcaccgaatccccctctgggaaattcccgagagagtgaagggctgggtgggatcccgggaatggattcagccagaggcgggaggcctagattccactcccctctttcacatgcgctatctccttgagtgacttactcaagaggctccgtgtctttgcctcggtgaaaaagaggaccccttggccgggcgtggtggctcacgcctttaatcccagcactttgggaggccgaggcgggcggatcacctgaggttgggagttcgagaccagcctgaccaacatggagaaaccccgtctgtactaaaaaataaaataatatacaaaattagtcagacttggtggcgcatgcctgtaatcccagctactagggaggctgaggcaggggaatcgcttgaacccgggaggcggaggttgcggggagctgagatcgcaccattgcactccagcctgggcaacaagagcgaaactccgtctcaaaaaaaagaaagaaagaaagaaagaaaagaaaaagaaaaagaaaaagaggacccctcttctaccggcagccatcaccgcgccaggctcaggcgtgaccctcacgccagtggaaggggattgagatccagagcgaaggcggcggcgccagggcattgcagccacggagcgccagggccgccagctccgccagggggcgcgcccgggacctccctgcgctccgcgcgccgcgccccgccccgcgccacccccgctccggccggccctgcggagggcgcccccagcggccagggcgcaagcggagggggcggcggccctgttcccctacgcgggcctcggcgcccctcccggcttccttcagacctgcaaggctgcagcctgggtcccccgatccaaagacggtccctgaggcgaggggcgggagaacgattcggggcaggtctgcagttcgaacttgcccagagcaggagaaaggcggcccagtgtcccggtcgtggcaggcgccatctgcccgaccagcgcctgggtcagccccgcgccgccccctgctccgcacgggttaatccccctcgccgcccgctcgccgcccgctggcttcccggtgccaaagtgggtgttgctggaattcctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggtgagcatgggagagggaagtttggagggtacagaggggagccagggctcatttgtggaggggcgtgcaggcgagaggagagggcgccgctctcataccctcgtccctctgtctttagtacttcgggaaacagccccgaggttccaaaatcgggattggaagatttgatccgctttcgaagagttgaaggcagatagatcatcatcctcatcctttcttaccaactctcccggagccccgacgttaaatcctttcgcaaggcgcctctccactcgcccgcgttcctcctgcctgcaactaacgagctcttgtagactcttgcagcgctgccgggatctgagaggcagcggggagagggcaggagggtgggcgctccaggctcttgacgcccaggggaggttgagctggctcagagcgcgggttggcggaggtgtcgggggccccatggagagaaggtagatgcgtctccaggaggggagccggcagcgaagctggtgcgtcgggacaagtgtcgtggggcgtgggtcggcctgcgcacgctgagggctggatgcgggcgtgggcgtgagctctgggtactttgggcgggaagcgtgtcctgatgaggctgcgacacagtgggcgcgtggagaattggatcagtgtgctcttgtgcatctaggtgtaagcgtgacttgggcgcgttgcagggctaagccaccgcacaaccctgcaatttacttttttgctccccctgggcaccaccccctgcccaccgcgggcgccgtcgcagagtgagaagatgccccagtaatccccatccccaatcggatcatcatggctgcgggcacgctccgccttgcctgggtatggcaggtgcctctggaatggagggcactgagccctgggcagtgaggggctgggtgggggcaccatcgggaagtctgggaagggctttggcagcctctctttgcctgggcccgatttgccagttgggtttagtcctggggaacagcatgaaagacacttgtaccccgagtcctactccaaggaccttgcacttcgcagccttggcgctctgttttccttggcgctctgttttccttggctggagcgctcttctcatatttcagcaggattgagctctgtctctttcagatttctgctcagagtgacttttggccacccgtgccccatcctctttctcctttcaccctgctttatgtttcttcatagtacttattctatctgatatgttctattcctatttatgtgtttatggcctggcctcccagcccacactaatgcaagctctatgcaaacagggacttcgttgtgtccatttctgtgtctcttgtgcctagaatagtgcctgcactggttggtattctctaggtatctgttgaatgagtggatgaactccctgctgcccatggaaggcccagcttcaagcaggcagagagtagacccatgcactgccaagtcgcttacacataggatcattcaacaagtcttagtggaaagcacctgctgtgtttcagcgttttcctttcctgatctgtgcaagtgaatgcatgcttccaaggatcctgcgtgcagagcatgggaaaggggatggaggcccagagtccaaggcattgttcctgctgggagagcaacccaattacttaatatcacgttgaagaaatgaacagatgctttctagtactggaaggttcctgttaagtgcaaaggagtggggcaactgtagctgaagagctgagtagaggggacctgtgacctggggcccctggggctctgtgggcagcatgtggggaagcagaggggaggtggcaggaggggggcctggaggtgagggtggtgtgcagatgtagcactgcccaaggacaagggctttttactgttggcactggcccaggggtagcactgcagctttggtgtaggggaacctagagacatagcttgggctggagcagggaggagcttgtactgcaggcatttaggtgcaggtgaggtgcgggggaaggtggggaagtggagcgtgggggctggagggtgcactattagaagtcatgaaataaagcgaattgtcactacaacaaagctggtggatgtgaacaggcatgtgaagacatgggctgggtgccacctgctgtacacaggtgcacacatcacatgacacactggtcaggctcctcccccacattgtcttctgcagctttgataaagagtgggttccctgacactccagtcagccactccatgtcagctggggaggacctgaggggtcatcttgtttattctcttcctccaccctggtccattctggctaatggcttctagtcaggctgatcaggttggccattcattgccttgtgagctgcagacagccagggaccaagtgccacctcctggtgaatcttggaactgcaccactgctactggagcttcttcattcattcgacaaatattttggaagaacttctatacccaggccctatactggatcttgaggatatagcagtgaccaagacaggcatactctgtcctcatggaactttcaatgtagaaaagatttattgcacataataaagacttattaagtttgtgccaggcttgatgctaggtatttgggatacagcagtgaccagagtggacaccgtccctacgctaatgaaatttacagtctacagggtttctttttcatttcttttcttttctttattctttctttctttttttctttttttttttttcttttttttgagatagagtctcttgccctgtcactcaggctggagtgacattatttcggttcactacaacctccacccccgaggctcaagcaattctcgtgcctcagcctccctagtaactgggattatgggcgcacgtcaccacacccggctaattttttgtatttttagtagagatggggtttcgccatgttggccaggctggtctcaaactcctgagcttaagcactacacccaccttggcctcccaaagtgctgggattacaggtgtgagccaccacgcctggcctctatagggttttttgaaccagcctcacagcagaccacctgtataatatttttctctacctttccctcttgttctgttattatttttctttaactttatattctgttaaaataacaggattttgtgttttatctgttttaaagtatattatgaagttttataaatgcactaaaaggtattgaaaataatataacatagtctagttttggccgggcgcggtggctcatgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaacatagtctagttttatcaaaccttaatattttgacatattttgattccagttttttagttgaaatttcctctataaatttgcctccttccctccccagagttaaccactaccctgaatttaattaattccaatagatgtttttacaatattactatagatacatgtatccacaaaatatacaatgttgttttgcatattttaaacttagataagtgagaccctatttcattattcttctgcaatttgtttttcccctcctcattagatttttgagatttaaccatgttaatataattagcctaagtttattcattttaactgttgtatattattcctttgtctgaatattaccacagtttatccatcctcctgtttttggacatttagatgaattactttttctaaaagtaattttctaaaaattctactgaatttttttgctattacagacagtgcttgactcatttttctccataaataaattcataactgaaaggaaactttgtatcattatcataagttgaaagcagtaccacttgttataaagagaagataactgtaggaaaattgaaatgaaaacaaaatgttcttaagttctagtcagacttcattcattgtcttaggaagctcaactctgtggcaagttccctctattggaagggggactagcgtgtgttgaggggaggacgtggcctttttcactgacatcattaggttagaaggatcaccaaaaagagaatcactttctcaccatgtaactcagattgttgaatgttgtgatctgtaaacttaaaatgcctttcctaccctcagtggctcatcccactttttgtgaaactccagattaaatgaaacaagtatcaattgtataccacatgttgggcactgtgttagactgtagaggcacaaggagaaataagaaagaaacctctagatacccaagactgagatacaaccaatgacctgagacaggcagtactaagtgatcacagcagatgcagatggagaatgagggaaggctgggtagatgtcagaggaggtgggttttttttttttgtttgttttgttttttgagatggagtcttgctctgtcgccaaactgtagtgcagtggcacaatctctgctcactgcagcctccgcctcctgggttcaagcaattcttctgcctcaacctcccgagtgagtagctgggactacaggtgcttaccaccatgcccagctaatttttagtagagacggggtttcactgtgttggccaggatggtctcaatttcctgaccttgtgatctgcccacctcagactcctaaagtgctgggattacaggtgtgagccaccttgcctggcccaggggaggttttatacaaagaaggtaatatctgatctggaagtcttggagtatgcaaaggattttaatcagtagaccagagaggaaaggcattctaggcagagagagcagcccaggcaaaggcatcgaagtgaaatccatagggtaactggggagcaacaaaccttgtatccttggaggagcaaagccttggctgtggatggttgtggagacaaggtgggggtgatggggacaattagactgcacaggaaagtaggcacatgggtgccagggggccttgtagaggccagtggagagctgtgggaggtttttaacaaagggctagtgtgatcagatttggcccaggtggaatagcagctctcccagactgctagccagatgtgttccctacagtgatgctggatactgggctaatgtgtgctgagtggtgtcaactggaagactggactcagatgatctctgagaggtaccttctagggagtcagagtgattgaattatatatcccagctgttcaggctcatttgctctctctgctagccagagcccactgaactgacaattcccagaattcccagctggttacctccctgggcctgcacccaaaactttaatattggcctgtagggatccttagagactctccttggggacctgaatctctcttgagtgccctaccagccccagcctggcctctctgcctggcagcctttgattctggccaatcctcacgtggccttacatcccttagggcctactctgtgcaggcaaagcaaggttggcccctgccctcccacagtcagctgcaaagccatcctgagggcagctggggtgacggctggctcagggggcctccttgggctgggctccatgccatgacctcccagccaggcaggctcctgcgtccgtgctgtctgggttcccacaggccctaattcttagaaaattcccagggcacagaatctgtttcctctcagagccctcctagccccacgagaggtcttgtcaccaccacaaggggtggtgacataaaagtgggtacgtagtttccccttccactggggcgcacccccagaaactctgggtctgacaagcagccctttccctgacccccgtgacatgggccctgatgcagccaggaagctgctaacggtggtcgcccagagaggctttgaggtggcccaagtggcacaactcttggctggtgggacattctgggagctccctgggagggaggcagtgcccacaactttgggccaaagggccaggaatgggcctccgctttttcaagctgcaggaatttattttgaattcttcgtaagactccaaaaaccacataagctttggggtccactcaaatgtcaaacaaactcctaagtgggaccagatgtcgccatgctggccacagagatcacaggagtggccgccctgctctgtcctttgcctgtccagcctctgcacttctccctcccctcttaccctctagttccagtgcccggtgatgatttccaatgataaggatggaagccagagcccggcccagcctgccaaggagtcagtccctagagatctccaggagaagcccttctagggagacgccctggtctaggcatgtgggtctttagctgcagagtcagggccgggtggaaactgctggtgctgctggagtgcgccagacacccggaagcaaagtttggggagctgagtgaatgccccagcactgtaggtcagcgtctcatgggggtgccctcagagccaacatcaaggagtagctgaagggctgggcgcagtggctcacacctataatcccagcactttgggaggccgaggtgggtggatcacctaagctcaggagtttgagaccaccctggccaacatggtgaaaccccatctctattaagaatatttttaaaattagccaggcatggtggcaggactgaggttgccatgagccgagatcacgacattgcactccagcctgggcgatatagtgagactcaaaaaaaaaaaaaaaggagtagttgatggaagaactctatttcgctatagagtaagtcctgtttgcctctcaaataaaaattgtgcctccacataaaaattgtgcagaggcagcttaacccacatccccagccccatcctcctaccagcttgccaccttgtaagcacctcttaaccagggattctagagccctgttccttcagtgcccactcagggctcagccttcccacgcaccagactgccgggggctgagactcctcagtgtgcattcgttggcaggtaacacctcgtatgaccttgagactgttttatgtgtgtcttccagcctcccttggatcgtcagcattggtagggcaacgaccatggtgtttttttgtgtgtgtggttttttttttttttttttttggtgagaggcaatgtagagttggagcatggcttagagttgggccaacccaggtttgaatcaggctctggcacttacctgctgtgtggaattggcaagtcactgaacctctctgaagtggcttattagctttaggatcactgtcattgttgccccagtggactgccttctttatgtcagatgttaaacattctcacctcatttaaccatcataacaactcaattaagcagctattgttatctccattgtacagatggagagagtgaggtttcccagggatgtgcagagaatggcagagtcaggattcaatcttagatttgcaagtagaatagggacagccttcccagcctctccatgttcctccaggccctgcctgtagaaggtgggactgtcggaggggctgtgaatagtccccagctctgagcatccttgtgttgactctgttttggtgaccccacaggaggaacgtctgcgggggacagtgctgcccaggatggacaacagcaaacagcaccaaccactgtatcaaacgtgagtgcctccaccagtagcagacactccgctctatcaaacgtgaagtgccattccccaccctactcccagggcaggtcaagcttaggtactccagaacctggagcagaagcgtctttcctagtctgcgtcctgaagatgcagcccctatttaaagtggaggcaacatccaatggaagggaagaggtttaaaaatgcctctagctggggccgggagcggtggctcatgcctgtaatcccagcactttgggaggccaaggtgggtggatcacttgaggtcgagagttggagaccagcctggtcaagatggtgaaaccctgtctcttctaaaaacacaaaattagccaggcgtgctgatgggtgcctgtaatcccagctactcgggaggctgaggtaggagaatcacttgaacctgggaggcagagtttgcagtgagccaagatcacaccactgcactccagactgggcgacagagcgagactccttctcaaaaagaaaaaaaaatgcctccagctggacacagcttctcaaatcaaatcactgcttgtgttttcaaagcttcctgcactccctcctgctgtcctactgtgttggccccactcacactgccggcagggtctcaggagactgcatgcacctatgttctgcagaacatgcctggcccagagcctccgcatcccacatttccaagggcaccattcatgtagcatgtgatgagaatccacctctgccctggcccctggcccaatggccctggcctctgttagccactctaccaggatggtcagatgacactgtgacccatgcctggagccgtctccccttggactgctctgatgcctggcaggctggctcgaaggagagaaaagccatcttattttgtggaaaccaaggagtgagttaggaagagctagagccttcacacctgagcctcttccactgatggtatcaggagcattaacaacaacaagagccagtaccttcatagcactcactttgtgcagggtgcactttaaacatcctctgtggcgggtggatgaggaacgtgaagcacaatcaggtaacttgtccaaggtcatgtagtcaggaagtgcagagctaggatttgaatccagacaacctgacaccagggtccctcttcttaatacctgtaccctgctgccaggtatcttaccttcatttctgggcctcactttctgcatctgtgaactggaggtgatggtactattgctgtcactgctactgctactgctactattagctaacaactgagtatgtactagtgccccacactgcgctaagctcttcacatgcattatcttagttcgacctgtcaatcatcttatgaagtaggtgtatgcttatcatcgtggcttacagataaggaagctgaagctcgggttgcttgggaaacacggccaagctctgctgctgcaagtgctgagctcgggctggacccaggcagactgactccagaactccaggctccgatctcctgggcttcgttcactcccgacaccagcgaggcctggatattccagagtgtggaatccccacagaccatagcagatatgggagtctgagggagcccgttggatctttctccttcctcccacaggcccctcttgggtccacatcagctccccaggaactccacctgactatccttcaggtgactgcccctgcctctgccagtcccaagcctggctgcaaagcctcagtctcaacagctcccttccttcaaggaccagccccaggcccttctcggtaggagggcttcacagctaatagtccaggtgtgtgaaaaaacgtatgatgttcccagcatgatggatgccttcatctgggaacatcatacgttattctatgataacgtatgataacgtggttgtcctaacaccccacttgatgggatgcgatgcgattgctcccattcccgcgagtctggagatatgggttcaccaagctcttggcttctgcctcaggcctcgtggccctgaccctctgcctgtttgaagatgcagctcaggcagaattttgggtccctcctaggacctccaaataacagaaccagagccaaaaactcaaaaacaaacaacgaagcagatctgcttaaacaccctttccttttcagggaacgtggatgcctgggggcggctcagaggtcaggccctcagtggtcaggggcaccggtggggagaaacacttgtccctcattatttatttttatttaattaattaattaattttttgtagagacaaggttttatcatgttggctaggctggtctcgaactcctggcctcaagtgatcctcccacctcaccctgccaaagtgctgggcttacaggtgtgagccaccacgcccagcccctcataattttaaagaagaaagtgagcctcagagaggcggtgacttgctcaaggccacacaccttattggaaaagaacctgagactcaaaatcagctctgagcaactcctctgggtagagaagccagggatgtgggcggccaggtggctttatgctaagcagaggctctggggctggggcctggcactgtaatttttttaacagcatcccaggtgattctaggtgtggtcaaaaatcactgagcagagttgggggtcagtcataggaagatctgccttgggggccctcctcaaacttgaatgttcccccaaccctctaggaatcacatcaaagagaagattctgattcagcagatctggggtggggcggatattctatgttctaaccagctcccaggaacgctgacgctgctggcccagggaccacactttgagtagcagggccttccaggactcaggaggcctgggcaggagggactgggacttggaggtgaggaagagggttggtatgtttgagagagcttagcctttgttgggaggttgggaggcagcgttggctgatggagaatgttgctgaggtttgagctgaagctgcagcgggtggcttcatagggggtgggcctttccccagctgccccaggggtctgggcataggtctcacttgggccctccagccctggaggttctcggtttcctaacttgctagtgatgttccagtgttattctctgccaaactggagtttcaaccctagaaactcaaggttgagtgagtttgcatactgttacagtaccagtgcatgtgtgtgggggcatccttgtgccccagtgggtgctgcgccaggatgctgaggtaggatgctgccataccttctcccctggtatttctctccctggccgtctcaccctgctgcccccggtcacccaccctgacccaggcatacaggccagctgctctcctgaagggagttgccagtgggcaacagcccctcccacttgaagttggctcgcccgtggcagggctgtgtgctcattaactggtccctgtgctgtttgcttgttgctatttggctgctaataagcctaatgagaacccacgcaggcgggcggtggggtgttggcactggatggcttcatccagagctccgcagaaggtggggctcttggctccacaccccgtcagctggctctcccccacccctgtggctccgcacctccctctcccctcccaacagctgccctcctggctggggcagagactgccaatgttggggaatgttcatgattctgtcctagcagtttcacacatgaagggatgccttcctgggccagtgagagatgggggctgacatcccccactgccaagagtaaagtctagtgccagaaccacagggagactcagtctctcccagatatctgtgggcccaacccactgcccatgctcagggagtgctggctcctgctcagttgccctctcttgcctctggcagaatcaatcccaggtcactgtcacacaccagtccatctcccgggcctgccctccttccgccctgttctgcaggtgcccattgctggaagcccagcccctccttccaccttggcgggggctagagctgggccgccatctcctcctccagtcttggtatctgcctttccttctgtagctttgccagctctctctcgggacttatgtgtttatgtatttgtggaggcagctgattgcggcctgccgggccctgcccagcagaggggaagaactggagggtgtggagtgacagtgtcctgtttatagttgcagcttttggaagactgtccattcttcccagactggctcccgcccaaccccaccccaactggggaaggggatttgaatactccctagacttctcattttatctcagcctggacgcacaggggctggggctgctttggggaggacagaagagaatccctgcagctgtcgaggagggggcaggcaagttactctcccactcctgcccccagcagcaaggctcgagattaagagcatgtactttggattctggcaccagatccctggagacgtgtttgagtcccagctctgtgtcctgggggaagtgactggcccttttctagccacagggcctcgtccataaaatgggcataacaatctatatagagttggttttggggatgaatgatatgaacgcgatagctcttactgtgcaccaggtaccattctaagcacttcatattgttcatttttaatcctcacaacagccctataagctagattggattttttatccccatttacaaatgaggtcggctgtctgtccgagtcatgcctctgagactcatcagagcccagacatgaatccaggtagcctggttccagagtgcgagggcttagctctgtgctttctgataaatgagtaaatgtgtgtagacagcctggcgcaggctaagtttagctggtattttaatgctagatcaggagaccatgctggactgcctgggtttaaatgtcagctctcagctccaccacgtggctgaggggctatgggcaggctgcttaaagtctttgtgtctcggttgcctcttctgtaaactgggatcaacattgggccctgtctcccagagttgtaaggaacaaacaccgtcacttaggtcagatgtttagctcaaggcctggcatgtgcgatgcactctatacatgtttggccttgattttgagggcagggactgtgtctcaccaccctcagcaggcagcacgctgggtacaaggtaaagggtccataagtgtatactgaataatacagagcctatcccggccgtgtgcctgagagagccctttctgttgcccaagttctatcagcccttccagaaactccccacggtgttcaggggatcctggggatggtgacgctggagtgggcctgagcatttctctgcgtgtatcacgtgggcaatggaatggcatttccccaagtccccatctcagtcctacgagaaccctgtctctcctgatctgagctcctccttggcttccttgagggagcctgtttgccccattcatgacaaccacatcccaaagtggaagactgtggcaaggtggctaagagccccagctttggagtcaggctccctgagttcaaacccttgctccatcacttactagcatggtgatcttgggcaagttgttgatggttctgcctcagtttccccatatgtcagatgaggatgagagtagtacccagtgtagttataagaatgagatgtttatgtgaggtaatacatgtaaagcagtgagcgcagcacctcgctgtgggaaatgcttaacaagccttaggaaaaggagtaagggcaagggtaggattttcatcttcactgactggttagcacccaccaggagccaggaaccaggagccaggaaagtctcatctccggatgaaccagccagtggggactctgaagttggcagggagtggtggagaggaaggtgggaggtggcgaagggtaataattatatgacctcagtggaacccagctgatatgtagggtgcactctcatcaagagaccctgtccatttcttacccctgcatgggggtacccttcctggggagatcttcctggggagcaggttaccctgaggctctttgtccaacgaggtgattaggagatgtccttgactgggagcttcctgaagccaggtgctgtgtcctgctgacaccagtggagtgcctggccctctctccacacctgtgtcctttgtacatgcttgggacctgtttatcaaagagctgagtggggaaatgatggcatgggtggctggcagtttcctccctccatccccagctgcctcttctcagtctccttcactggcttctccctctctacctgacgtcttaatgttgggcttccccaggactttccccagaccttccaaatccctcaccccaaagagggaggccataggagccaagcggagcatgaactgcccctgggtattgagtgccagcaggcactgtgcccgacaattgacatgcaatactaacagtaatgcccggggctcactctgcctggatgtgccaaatgctgccatcttccttcaaaccctcatggtgttctctgtcctggtcccctcctgtgtccctggctgctgcttctcctctgctcactactaaactgtgggtttcccaggacttagtctggggtcttctattttgtttttgcattgctcccggaacaatctgctgccttctcatggatgtaaacatcatctccgggccaatgacgcccaaattcacatgaatcctctgccaggcctcttgtctgaccttcagtctttcacatctgctgcctgctcaacatctgcgcttgatgtctcccagacatcctcatcccaacttgtctaaaatgaactcgtgacttcccttcctctgagctaactcccccgtgcaggtcttactcactctgttaactggcacccccatcgacttgactgctcgagccagccacccaggggctacagggacaccttcctctcactcaggctttgacatcaacccattaccaagccctgtttgttttacttcctcagtccctcgtggacctgcctgcttccctgctgcctctctgggccagggccctgtcacagctctcctgggtgataccacagcctgctgcccgctctccctgccgccctcaacacatcccacctgaaacttcctgcagcggcatctccacactcacccagctccctgagtgcagcctgggccactggcctctaggctggtgcacatgctgctgcctctgtgtctgctccccgtcatctctctgtgcggctggcccttgtcatctacccagtctctgttttgaggtgtcctcctcagaggggctgccctggccactcttgcttgagtggcccccaccggccttgttcttctggatcttgggccctcgactgtctcctccatccctcacgtaccaagttctgctccacttctttgtttttaatttttatttatttatttatttatttatttatttatttatttttgaaacagcatctggctctgtcacccaggctggagtgcagtggcgcaatctcggctcactgtaatctcggcctcccaggttcaagcagttctcctccctcagcctctcaagtagctgggattacaggtgtgtgctaccacgcctgactaatttttgtatttttatagagacgttttgactaatttttgtatttttgtagagacgtttcatcatgttggccagactggtcttgaacacctgacctcaggtgatccacccgcctcggactcccaaagtactgggattacaggcatgagcaaccacgcccatcctgctccacttctttgtttacctattgagtgacagtccctctgactaaattgtaagccccaaaaggacagtctctcttgtttgccatcctggcaaatcgtgcgtttgaatgcattactgttttctagagaagaacactgaggctcacagaggtgatgaaactggccccaggtgagatcccacagtcagaactcaaacatgggtctccgactgcagggccaaactgtccttcatgcccctgccctggcctctctgatttgtcagtgtttggggtggtgttctcatccttcccgaccatcctgggcctgggcgcggggctggtgctgctgtgggaggatggctggctccactccagcctagaactgtctcccctggaagctgcttctctggaaaagactcatccccagggacccctcccagcctgtctcacctctggggcccctctggcactgaggcttcctcccagacaagccttgggactgtggggatggacagacaactcttctctgctttggggcagcagctggagaggagcctaggcctctcagccctgggccatgagctgggcccagagtcttcctcctcatgcctgctggagccggtgggattggggctgctctctgccccagcccctggccccgcggctccccagccctgacctggcccagtgttgcagcatttgttaatgcaattaacagggcggtccatgctgaagggctgggggccaaggtctgactcacacctccccttcctcccctccagccgccaaacccaaacggtagaggcccgcttggtctgccagacagcgtctgcagagagcaagtgaggggccaagaacggcatctttctctcattaggaggttttatgcgaacacaactgctattttggagctgggcacttggccggcccctgagccccagtgcagtttccagccgtcctgagccatggtcctggcacagctgtgtgggagctgggtgagcccctgaggccctgacttctcccacagcctgggggctcgggtcctcagtcagggcctgggagacacagcccctgggcagagcttgagagtggagagagcgattctgaggtggattccgagggtggattccgagtgtgggtgtgagccagacagggattccctgggctaggggatctctgacatcagggtccctctccttcctgtggaaaccaaaagtcaaggttgtggagaaacagctcagggccacaggtggaccccccagtaagcagattccagggacaaactgaggtctccaggtgagggtcccaagttggatgcccaggggtgtctgaggtaaatactgtggatgaggtgcaaactgtcccgtctgcgaaggcctctagctgtgaaaggggacagggccccggcctgaggaggggatcgggtggctcagtggatagggtcttagcatcccactggcacagattttagggaaaatggaggtttaacctgggaagcagctgagcttcaggaatggggggctgggcccagagtctggagttgaagttcttcccccagaccagagcgggtggcactggaagccactgaggaagggagaggctaaaggggcccaccctgaagttggtgcctcctctatctaacgggtcatagatggagggcaaaggtgtctctggggcccaggagagagagccgatgacaaacgccttgcccggggggtagggtggcagtggggaggggcctggctatatttgacacctagaaagcagtccccacccagcaccatggcccttggttgtttatctctgtaaccagggcttgatccctggagacgtgtttgagtcccagctctgtgtcctggggcaagtgactgggccttttctagccacagggcctcgtccataaaatgggcataacaatctatatagagttggttttggggatgaatgatatgaacgtgatagctcttactgtgcgccaggtaccattctaagcgcttcatattgttcatttttaatcctcacaacagccctataagctagattggatttttatcctgagggcctgagttgacattgccctttcctggggaaagggtcatagccaagaagctcagaggccatctggcctctgggggagtggttagttttgttgttgttttaggctttgctgtgctggccagtggaacttcctgtgatgatggaaatgttctatatcttgctgtccagtgtggtagccctgagccacatgtgggtatcgagcacttgaaatatggcttgtgagactgaaggaactgaattttaaattttatttaatctgaatccatttaaatttaaataaccacatacagttcgtggctacagtgtgagactctcttgaacagcacagctttagagagtacaaagtacacccacgtccaggtgctcagctgacactcacaacagctctttgaagcaagaattatcagccccatatcgtggacgaggccactggcacactggtggagacatctcagcgagatgacatgtgtccaaggtcatgcagctgagatgtagcagagctggggtcaaaccaaaccaatcctcctgcccccgaccccgtgttcttgctactacccagtagccaatgagcaggggctctgagcagatggtaggagcagcctgcatggggtggtcgggaggggctgtttctagaatctctcccaggcctgcccattctgagtttggtcccttcccaaaagtaggggttttgtgtggaaaatctgagcaaacctctgttgactgttctggggtggagtgaagggagaaggggctcagctaggaacatggggagattaggggaacaatgccttttatttcttgcttttaaagcaatttcaggagttttcttcctcttttggcgtcctgctgactccacagagcggaacacccaaagctgggactttccacctctctaatgctcagtgaagagcgggccaggggggtgtggaaaagaaagggtcctggaggagcccaaattacgaatggctagagactggcattggcaagcgaggaggcttcgtcacagtgtagtcttccggttgtccgagggtactgtcccaggggctggggggtattccgtcttctgcagatcaactcccgcaggctaaatgtggacatcgcggtatcatgcttgataaacggaccaataatcaagtggagattcattagaaccacataacccatactaggttgatttctcaagtataaggcctggtctgttgcccaggctggagtgcactgacaccatcatggttcactgcagcctcaaactcctgagcccaagtgatccctcccacctcagcctcacaagtagctaagactagaggtgtgcaccatcacacccagctaatttttaaagttttttttgtagagatggggtcccactctacaaaatatataagtataaggcctggtctgttgcccaggctgggcaacccttggactaaggcaatcctccagcctcagcctcctaaagtgctgggattacaggcgtgagccaccgcacccacctctaggatctctactattgaggaaaaattggaggcatcaaactccaagggcaaaacatgaagactcgctggcccaccatggatggaggttttctctcttaaaattcccacagcaccgcatggaactgcctctcctgggacctcagcgtttccttctttgctctaagcaatagcctctgccactggagattctgagatggccgatttccttttggatatttaagttttgaaatcatgctcatttggcataggaatgtttcacttcagtctcctttaaacaaaaggacacacaaccacgattgcccctccctcccgaagggtcactggacttcatgcatcagtaatgtttccaaaaatatcttaagtaccaacatgcagtggccagcttttcatttttccaagtgaagccatcaggaaaaaacaaaaaacaaaactaattaccacttgtcatcacctttaattaaaaagaacattttaactccaaaaatgtagaaaagacatcatctcaaaagacactctttagatgggaaaaatatagcctatgaaaaagaaacaacccaggaaagtgtttcttttcctgactttatggcagatgggtaaaaactgtcagaactgtcccattcatagacaggcactggaagccaccatcatggaccatttaggggtgacttttgggggaatggagagagaggagaggagtctacatacttcaatcccataatgcaaacactcagctcaaaacacaatgcttaatttccgtgaggaagccaggtagttccaggcatcttgccgagacttgtgaaaacaagagaggatgcgagtgaagccggcgagagctggttctaaacctccaaaaacctgaaacttcttggaggctctgcctcagcagattgggcctctgcacagcatcctacatggttaattcagaagggttaccttcctgaggggatttttcccaccaacacgtctggctggtttggaagccttttagaacttgatttactaggctattatatactaaatgccatttccacagttccccctaaccactcatttcccatgagctgtttgttcattgtaccaaccaaagtttgccagccctaaccctcactgaagacctaattccctgcttggaaaatggtttctaggaatgtgggaacccccactggccagggcttctccctctgcagggcccagtcttgttcacctttctggcctcggcacccagtctgatcaagataaggtgctcactacatgttttcggaatgtattattagcaagcaaggcagaaccagagctaagtgagtcgtggtgtgccgtaggggcttggctcacagggtttggggtcttggatttctagacagtgaaagatcttattttatatatatatttaatttcaatagcttttggagtacaaatggtttttggttacatggataaattgtttagtggtgaagtctaagattttagtgcacccatcaccggagtagtgtacattttacccaatatgtagttttttttccgcaacccttcccactctttcccttctgagtctctaaagtccattgtatcactctgtatgccttttcatacccatagcttagctcccacttgtaagtgatgacatgtatttggttttccattcctgagctacttcacttagaataatggcctccagctccatccaagttgctgcaaaaagacattatttcattcttttctatgactgagtaatattccatggtgtatatatatatcacattttctttttcttttctttttctttttttgaggcagagtctcactgtcgcccatgctggagtgcagtagcacgatctcggctcactcctgggtttaagtgattctcctgcctcagcctcccgagtagctgggattacaggcacctgccaccacacctggttaattttttgtatttttagtagagatggggttcaccacattttctttatccactcattggttgatgggcattaagttggttccatatctttgcaatcatgaattgtgctgcagtagacatacacgtgcgggtgtctttttgatagaatgacttctttgcctttactcagtagtgggattgctggattgaatggttgacctacttttggttctttgagaaatctccatactgttttccataggggtggtactaatttacattcccaccggcagtgtataagtgttcccttttcaccatgtctgtgccaacatcaattgttttgtgactttttagtaatggccattctggctgggataaggtggtatctcattgtggttttaatttgcatttccctgatgacgagtgatgttgaacattttttcatatatttgttgtatgaaggatcttattgttaatgtgaaggatgggctgttctcagggctcaggaggggaaggatggaagctagactgttttccaaaggccatcctcggggcaaggaccacacactcagaggtggaagctgcatgaccttcctctcacccacgccgggctttgggtctctgtggcagagaggtgtgggtccatgtgggagatcactcaggccttcccattctattccctccctaaaaaaaccccaaggccgagacctgccctgggcacatctgcttcctccatgttcactagcactggcgtggctgctgggctggccccagctgaccatgtttccagtggtggtggtgacaggggcctggcaggtggtcaggtggggactaagtatgcttgggcagatggaggggtggccaggccaaaatcctgccgtggtggcagtttgtgtttggggaagtgctctgggttacaattctctgacatggttttacctagaggcctggagcctgccaggaagaggtgcctgggcatgaagaaaaatgctctggcctcagagcccaacttgtggttggaatgctattaaaacctgttatttcccatgctctctgctgatagactggtcttgagtgcccttggtgcacaatgtccaatttattcatcctttgtgtctctggtcagcatcacctcctccaagaagccttccctgactttccctactccctgcctcagcctgggttagagggtccagctgacatagcacttgtcatataacttgtgtgttctactttccgtgtcagacagtgtgctggagacactatcacaagcttcacatccagtgagtgctctacgaatgctcattggataagcccatgagatgacgtacatcctccatcattatttaaaaattctgtgtgggctttggaagggtgtgtggtcctggggtctccactgtcagggccaattgagatgtgcagtttctcagggcagagttcccaagggtgcatttggtggctgacttgaagccaacagatcccctttatttccttatcagctctgggccaaggctcagaaatagtagagaggaagaagaagaaccatgcccacccttctgggagtcagtgggggtggaaagagcctgggcttctcagtcacatagaactagatttgaatcctggctccaccattaactagctgggtgacctcaggcaagtctcttaacctctctgagcttcagcagcattatctgtaaaatgggaatcatagtcacacctgctgcatagaattgtcgagaggcttcagtgagagcgtgtatgcagagcacggtgccaggcctattgtcacactcatcagacagtatctgccataataaaaataataataatcatgttattgttaggcatatgttaggagctaaagttacaaagaggtgtaagagacagtcactacacttcaaggggctgactatatgagtcaggaaattgagacacatgcataaaaaaactaatggcagcggcctcgtgcggcggctcacacctgtaatcccagcactttgggaggccgaggtgggcggatcacctgaggtcgggagtttcagaccagcctgaccaacatggagaaactccgtctccaataaaaatacaaaattagcagggcatggtgtcaggcgcctgtaatcccagctactcgggaggctgaggcaggagaatcacttgaatctgggaggcggagtttgtggtgagccgagatcgcgtcattgcatccagcctgggcaacaagagtgaaactccgtctcaaaacaaaaacccaaaaaacaaaaacaacaacaacaaaaactaatggcagtatgcagggcacgcccagtgaatggcaaacacgacaagtgtttttcctgttaatcaaaggagggagcagctgctgagaggtgggtgtccagcatggggaagtgggtcttgagggaacagtaggagccaggtaaatggagagcaagtgggaaagaagagaggacatagcacatgcaaagacagagagaagacagagcagaggctacctggggccacagccagcaggccagctcggctggagcacattggcttagaggaatgttagaggggatgagaccaggagggtcttcagcgctcgtctatggacttgaatcctgaagacatcagggagccattgaaggtctctgtgacatgggccaggtggaattttggagatgtttatcccggccagcccctggtttggattctggtactcttctcagaaaggagagttcagctcacaaaacccaggaacctgctctgggtagctgtgcctggtagtttcacaggtgcccttaggatccctgagatgacagggtctgtgtatctgcctcctcttcctcactgaccttgcctacacctcctccgccaccagaccctggccttcctgggtctctggcggcttctcgagtatgccacgttccttccagcctccacagcctggtcttcgcctcgtcctctgcttgggaaactgcccaggtctttgggggttcgcttcctttgcacgctcccatctctctcttcagagaggtgccctggccgccccatctgagtctcctggttcggcctggacccctgcatcacctgggttgtcttcacagcccttgaaactgcctgaggccacatcatgctattgttttcttgcttcctgttggtgtcctttactcgaccgcaagccccagatggacaaggactttgtcccagtgcctgacattcactagggctcaacagctatttgttgaatgaatgagcgacagatggatgaggcattgggtttcgagggtgcggtgtgagccagaccatgcttccggggctcacatgtgttccccagtggaggtcctggtgggggaggggccggactccatatcccagtgtgtgcctctgcgtggaatgttcccttggccattaatcatgggatgtggctctggactttgcaagggggtgaaggacagtgaagagaggagtcagcctggggagctggtggctaatgctgcatagggctaaccgggaggagggcctggtttcagctccaccttgcctccggctggacccacagcccaggaggcagaatccagagagagcctgagcctgaacagaggccccacagagcggggcacttacctggccggcagcggctgtggtgccggcagctatattctggccaccgtgctttctctggccgcagtcgagagttctgccttgctaaggagggtgggagatggagaacaatgggaaggagaggagagaccgtcaagctgaaggtgcctttgaaggacccttagagtcctccagcctccttagttcacccctcccgtgatttaggcgcaaatagaggctcagtgaagtcaagaccatgcagctcacaagtgacaggaaaaccccagcaactcaaaccgcttgaatttcaggccagtgttgggccctttcccgcaaaagagactgattcattcatccattcgctccatgtttactgagaatctactctgtggcaatccctagtcaaagttccggggccgctgtctgtcctcagggggcttccagtctggtgggagtgaacatttcagtatagacacagtgtcaggcagtgcacttcctcttcagggtgtgctgtgggacgtggtggtgtgagccactctgcagctggccatatagtctttggttgtccagagatcagaggtgaacaagtcctgggggtctgtggatggaggtgggagagacatgggtcagggagccccctgaggccaggagagtggcttcctgcttgagcgacagggttgcagcactcaggagggcccttctgacaggaaggtgtgggcagctgtggtctcagtgccctatggccactgctgtcacctctctccctgtgtcctcagccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggtaagtccccttctccatggggcttggggtctggggctcagtctctttttggaggggcttcttcctttggaccgtttggtgaaggctggtggagaaggccgcagagtcctcccttctctcctccccaccctccttggctttccctggcatggccagagatatgagcaggagagtaggtgttggggctggcatgggctttgccagcctggggtgggaagaggaggagggaagcgaagtctttgccctcgagtgcctgaaagaaagctgaggagggcgtgtacctgggaccacggcttcttggttcacagcctggctttgccatttcccaggtgggccaccccaggcgagtcacttacctctctgtgcctcggattctgcatcagtaaggtgggacaatgataatacctgtgctatgaattgtcgtaaagattaaattagtcaatataaagaaagtgcttagaacagtgcctggcacatatggaagctctttatacttgttctcccacaccccatcctgacctcctcctcctctgcctgtggtccctgtgatgtaggaaggactcctctgccagaagaagacccttcggtttcctcggcacccagcttcagcctctctccttagaggggagaagaaggagcatgtgggagaagggagtagaaagaaaagtgaacaaggggagtgttcatgggcaggattccctggcctgcttgccagcccatctggctagactttttctagctcaggacaggaaatctgaactttataaacgagtccatttctaggggactgtgttttccttttcgtttttcaggttagtttttccattcgctttctgcttaagaagttctttctgaaatgttgcaaccttgccttgctgaactaaagggaaagaggatttgctctttcagagcccaggagaaccagggagaggaggccgaccttgaggttaggttccagcaggaaaggttaggagagactggctgagttggagggagagcaaagaaaggaggttgagggtgtccaggaactctgagagtgggtgaggtcaggcggaccaggatcttggtgagctgggttccggggccctggtcacccaagcagatgttttccaagggcagctaggagcaggaagaaagaaaggatggactcaggtcaagggcctagggaactccaaggtcaagagcaaaagagccaaaccctgcagccaaggcccaggggtgctgcagcagaaacaaggagcagagctaagggtcccaggtggataacaatgagggcctgggattggcagtgagcaggtgggcagtgccggtgccttgttctgatcggtcctggctgagggtcctaggtggtaagcctggtgtaaggcacctggaggaatactagaggtgccagttcaagggccagccagggcaggggtgggcacagagtccttccagcagagcttcccccatctcttttggcttgtgggattcatttatttatgatgcactgatcccatgtaggtgtgtgctaggagcaggggttgctgggcaagtcactctgcctctcacactcttgaatcttgagtcagagccgtttgaagtcccctgctgcatcttcccaccagtctgactcctccccattcttcaaggtgaatcacattcactaggctctctggcccctgcagcacttactctctggcatgcatctgcgccctgcacccccagctgcttgtagacccagtggcctgtgctctggatttctctacagcccccctgcatagtgcctggcccatcaaaaatgctcagtccatatttgctctgacactgggtccaaactacagttagcctaacaaaagggcctacttggcgctgaaccctcagctgtacctgcagccaagggcaccaccccatgtgttgctcagagggcaggaggaggtgaggcccctgccggttcccatggtgggttctccatttttccctagcgcagcacttttcaccctgccttcagatgatctgtccatttgctcactggaccaggagctacccgggagctcacagggactgtgttctgctcattcaaaattgtgtccctggtacctaacaccatgcctggcacacttctgtgctcaatcagtgtaagttaaatggataaataaatgaggctaggtgatggggagaggggaggctgcaaggccaggaggatgggcagtgtgagccttctatcccccagtgaaggtttcctgtgtgtgacaggcagtggagggccaaggtcctgggtgaggtctctggcccacagcagggctgtcctctttgactttcacaggctccctggccaggggctactgtgatgttcttaatgagctgcagcctccaggccagcctagtctctctgtgccctggggcctcaatgccatgaaatctgggagtgccctactgttggcccagctgctggcccagctgtgttttgctttaggaggccaaatcctgcttgcctggtggtgtcagacatttcctgtgaccttggccaggtttctcaagcagttgctggcctctctcctgatagcaacttggacaagccctgtgtgtccagatagaggtggtgacatgacacagggggcattctaggagttggggagggaaatgtctggggaggggaacactgcagggattggtgatggccagaggccctctttaggagagcaggcagagaccgagagacttgtgtcctggaggaagaccagagggagaggccaggagtgtcccaggcagcaggcagggtgccctacagagggccagatgtggactgatgctgtccagctgttgtctgggctgactggaggggcctggagactcccttgagcctcatgtcctggcttcttccccaaggctgggcagagtacctgcctcacctggagatcaaaagccaggcagctgggaagggcctggagagatgggagagggctggttacaggaacctgcaaccagcaggctttggaaagcagtggtttagaccagcacttctcaaactgaaaccagtaggtaagtcacctgggaacttgtcaacatgcaggttctgattcggcaggtctaggatgatcagctctaacgtggtcccacaggatgctgatgctactgggccacggaccatattttgagtagtgagggttagagcccgggctttggtgcattctaattctggatttagcactcaccagctgtgtgttaacaggcactcatcctaacctctctgagccaatagtgtccacctgataggatgacaggaaagattaaatgagaccatgtgagtagaacacttagtgtggtgcctgatatgaattagtgttcaatacatgatagctgtcaatgggcaggatctctttgctgtgaggacttgggtggatgggaggaggtggcaacaagcagagagaggaaactggagtgtgtgtgtgtgtgtgtgtgtgtgtgtgtgtatgtatgtgtgtgtgtgcatgtacacagaacaggtgtagacctgttctgggaagaaatcagagcccagactcagcctcagtggtcagcaggtccagtagtggctttggctggcttgggatacagttattccaccaggaccattgtcaccagccctagggaagaggaggttaaggggaggtgtcaagaatgggagggacctccactgggtttgctctagacctgaggacctagaggctgagccctggagacatcctacacaggcttgagaagaatcacttgaacccaggaggtggaggttgcagtgagctgagatggcaccattgcactccagctggggtgacaagagtgaaactccatctcaaaaaaaaaaaaaaaaacaacaaccctaggcaggctttgtcacaacatgggcaacaaggggcctgaaggcagtgctgagccctgagtggggtggctggggtgtgtctggggagctgtgaccctgtggtggtggcttccagcaggctgctcctgcctggtcgctccctctcctctggatctcttcctctctgcacaccccacctctttatccactgtattcgttttctatggctgccatgacacacgatcacaaaattagcaggttaaaacaacacacatttatttctgtacagttgtataggtcacacatctgaaacgggtctcaccaggctgaaatcaaggtgtcagcaggctcctggggctctaggggggctcggtttcctcgctcattcaggttatctgcagaattcagtcccttgcaattgtaagacggaggccccatttccttgctagctgtcacttgagggccatatcaggagctgccctcattccttggcttgaggccaccttcctccatcttcaaggccagcagcagcaggtggactccatgtttggatctcccctctgcctgcctctttggctgtctgtctccctgactcactcccttgcctccctcttctacttttaggggcctatgtcatgaccctgggcccaccaagataatccaggaccatctctctattttaaggtcaactgattagcaaccttaactccatcggtaaccctaatttccttttgctatttaatataacatattcaaaggtgtaaccccaggaacagagatcatgggggccaaccacacccactcactacagcacattccaactgggacccttgtccaaagtggaagagctccctcttatcaagggcttgccacaagggtggccctatgtgatctggccccaaagcctgtctgacatccccagtgtccaccctcaccactcacagcccgtgttcatcctgcttctgctctgccagctgactgtattttcctcaaatgtgctggagatgctcccacctcagggccttggcacttgctatccccctccctggagccctggaattattattattattattttttgagacagggtctcactctgtcacccaggctggagtgtagtgtcacagctcactgcagcctcgacctcctggtctcttgcaatcctcccatctcagcctcccaagtagctgagactacaggtgtgcaccaccatacccagctaatttctgtatttttttatagacgtggtttcaccatgttgcccaggctggtctccaactcctgggttcaagcgatcctcctgccttggcctaagtgctgggattacaggcgtgagccactgcacctggcccctgtgttagttttctaaggcttccataacacactgagtggcttaaaatagcagaaatttatgctcttatagctcaggagctggaagtccaaaaatcaaggtggcaggattggttccctctgagactctgagggagaaggttctgtgcctctctgctagcatatctgttggcaatccttggccttccttggcttgtagctgcatgaccttgaccccgcctcagtcatcacgtggccttcttccttgtgtgtgtctgtgtgtctctgtgttgtcttcttcttataagggttcagccattggatttagggtcctccctaatccagtgtgaagtcatctaaacctaacaacatctacaaagactctatttccaaacgaggtcacattcataggtccggggttaggactcacgtcttcatgaggacacaattcaacccgcatcaaaacactcttcccctcacactcccgtggcttcttctcccctttcctttgtagtggggccctctctgtccaccacatctaaaaccatgccctccacatcctccccacctcccacctggcatttttctctgcaacactaacgtcttaggtattttacctatttatttgaattcttcttcttcttaccccaagaaagcgtcagatgtgggaggacaggggtttttctctcttttcttggcagaaatctctccagcacctcgagcatgactcagcccattgtagcattgagtaaatacatgcccagagtatggttgagtcaattagctgtctacacccattttgctttacgtctacaatcggctgtctacatccattttgttttacatctcacaactccctacaacaggtggccagggttgccgttctgttggtgaggagaggctcagagaggggaggtagcctgtccttaccccttcccagcctggtatttccagcacctgtcctctgcctgcactaatctctctgagtttttgtccgtggggagacagggaagggccagggcaccagggcagctcttgttggaggtccaacctcaggtggtgagtgccaggactgctgggagcgtatggcagcatgtgcctgcatgtgggtggtcacctgggcagaggctccctacctcagagcagaaccctgccttgcctcagcctccacggctccacaggagccctgttggcactttttggcatgacctttaacctactgatgctgagagtgattggcatgacctttaacctactgcactgagagtgagcccacgggtttcccgtggcagtgctgcctgcctccacccaagaccttgactaactttcctgttgggagcacagggactctgctcccaagtcggtggtctctctaagtctgagggaacggagggaactatcaaaagattgctgccccagagccactgccggggagacccaggcatcccttcctaggggcaaaggtgcggggaaggcagcaccccctggttgacaaaatggcaaggggttttcccagtgacgaggcagaatcagaaactaggtgctggggccaggcgcagtggctcacacctgtaatcccagcactttgggaggcagaggtgggtggatcacccgaggtcaggagttcgagacgagcctggccaacatggcgaaaccccgtctctactaaaaatacaaacaattagccaggcatggtggcaggcgcctgtaatcccagctacttgggaggctgagacaggggaattgcttgaacccgggaggcagaggttgcagtgagccaagatcacgacattgcactccagcctgggcaacaagagcaaaactctgtctcgaaaacaaacaaacaaaaagcctaggtgccaggaacagagtggctgggaacagacacccagcctggggacctcagtgtggcagcttgtaaattgtgtccccttcccccagtgccagcagcaaaggggttggggtcagggaggacacaggacaaggctccctgcagggctgttgtggacaggtctgccgatgatatcgtgaacctagaggcgggttcaggcttggctggcaggaaggaggccgtgtggcactgttatgggggagtgcagactagtttctgactggggcagtgctgggtgccctgaggattagagtctggtggctggatgaggggacatgagtagggtgcctggtggcccagtgtgtgtgtcaggggagcccggggcaggggggttaaatttggtgttaggcagaatgtaaatcctgatgccctcacaaactttgcaagcccctttacctccctgaaactcaatttctttgaccttgatgtgggaaaatgaatgtccatcttctacgatggttgggagaatttactgaaataatgtagcacgattcgcggggtgtctgccacacagtcggtccaataaacctgaaatctcttggcctacctgcctactccatgtgcttatgacagatcagtgtggaacacctcatttgccaggatgagtttttctgcacctcactgtctgggcttatagctggggaaactgaggcaggatgcaggttggccactaggttgtgggcccacctgaaggcctgccctggccttctgagcctggctcctgctccagcccctcccaccgctgccaccctcccctctgggcttctgtgtgctgctgcgggccttctgcttgttcctttgggctacgtggccccctctttgtctttcttccttctcattcaagtcccttggacccaagattgttctctgattcagctgtgacgtgccagaagaccaacgtgtgctcggagaccttgggaaaatcttctgcccttcctgggcttgttcccgcatttgtaaatcagagggctagtgtggatctcctctaagctcaagagctaatggtcagctgggcgcgctggccatgcctgtaatcccagcactttgggaggctgagacaggcggatcactggaggtcaggagtgcaagaccagcctgatcaacatggaaaccccatttctactaaagatacaaaaattagctgggtatggtggtgggcatctgtaatcccagctacttgggaggctgagatgggagaatggcttgaatctgggaggtagaggttgcagtgaactgagattgcgccactgtactccagcctgggcaacagagtgagactctgtttcaagaaaaaaaaaaaaaaaaaaagagataatggtctaggattccggccagcctggccatcttccatccctaatggtgaaatgtgctcattctcccctttgcctgtttccaaggttgtgacaagaacatgtgagcctctcaccagggcagaccttcgctgtccctgacaccttggcaagcctgcagagggctaagcagcctgcatcttctgtgctgtgtcacccatttcctcatggccactgagttctctttctctgcggggttaactcaaacctacaaatctgtggtggcctccgagggttgagcccttctctctctttcttttctttttttagcctttttttctttctttttcctgacctgtttgtataactctgattcccaaaattgctccttgggtttttctggaattcccccaacacttaggaccttgaaaactattttgaatagactcggaatcagtaaacccaattttggcctcttagttactaactggccttgtgaccttgggcaagccacttaacatcactaagcattaatgtccctttctgtaaaatgagagggttaattctcccctcactgggatgttgtgagaattaactaagacgtgtgtgaaagattgctttgtgagttttaacatgccttgcaaatgcttgttattactttttagctgtcctgacactgggcttgggtatttgctcatgcctggtatatgtacagaagccacttttaggaagaagctccttaatgaggcccttgaggaaatagtttagaggaaatcttttaattttaagcttagggaaggacatcccctgttgtgtccatcttaacacaacaacaggggatgtccttccatcatatcatactctctgtgacaggtaccccaagagttgtacagtgtacagcgtatgcagctgtatgtggtgaccccagacctggcttcttccctagaaggagatgtctcccatttttccaatatttaatattttcaaacctcaacttgagagtcctttcctctggctcactttttatttccacagtactttctattttccactttctaacgtagcatataatttacttatttattacattggtatataatccatttttcccagttactatattcctcaagagcagggatctttgttttgttcactgacatatcccaagctcctagaatggtgcccaggatatagcaggccctcactaactaaatatccactgaatggacacccctgtcctaacgcatcttctgttgcttcctagagcagagagatggtctcagggccatttccttctgagctgatgctcgggccatcccctagcaagtcactgacatggaggggctctcccagccctcccaacaggtggtgcttcctcaccctgtgccccttggccctgggagtcggaagccaggcaaactgagggcaatgcctctcccctgagggcagggagagtgggcttgacagaccctcaggagtgctgagagtctggacagggggttgtggcagctgtaaaggaggctcctcctggtttcttccatctcttgggccttagaagagcccccatgactccccttccctggggctgtgggtttggaagagggagggctcagaggggttaggaagaaggggaatgctcactgtaggcctccagccagatccaatggaagagattttattttcccaagtctgagggtgcagaagccctgctcatgctttttgaggagagtgggaagagacctttgtctcagccaagaacttccttcaccacccacgccccatctccctgctgttgcagagggtaggttctagaaatgtggatgggccacactaaggcttgtggagggtcccttggcactcaacctctgccagccccagtgcatccctgtccagcagagactatttggagtggccagatgggtctgaggcactgtgttccagccaggcaggggagggacgcctgctgttctgcattggacctttcagctgttggacacaacaccaggggttgtccttcacattatagtctctgtgacaggtaacccaagagttgtgcagtgcacagcctgtgcagctgtatgtggtgatactagacctggcttctttctgggaaggagagagatgtctcctatttcccttacaaagtgtattgcttcaaggccgtcctttccagctgggtttggctgttgaggtcccttcgaggttcccctgaaagggggatggatctctgggcctttgtagtgttaacgtgcatctctccaacccacacaaatacctgagatccatggaggtcaggccctgagcaggccacggctggccttagggggtacaggtgtgggatgataaaaagactccagctctgggcagatgtagcccagggcacacggtctagctatgctttgatccggagcctagaagtcccaggagaggttgtgaggaaggtgggggccagtgtgccttccttcttctgcgtgataaagccggcaacctcttccttttctcatgctgggcacagagcagacatctctgggttggtgaggatgccgagctcaggcctctgagtgctcaggggaggaggccccgccttctccccacatggggcactgggcagattcaagggaaatggtgtctgctttctacacacttcctcctaccttcccccttctcccatttgagcctgaaggcggacatctggcccaagaagatctcaaactctctgatgacaacctagtgactcccttttttagtattctcccagagctgaggaatatatggaccgcatcctgggtttggtttcaggagaggactcctcccagccctgccccaggtccagccctaaacaaatctctgagatacgagctattcaccttctgtcctcccagagcctacagttcggtgatggggaaagctaccttttccagttcatcatcatcatcttcatcatcagtaggatttattgcaccctgctgtgtttcaggcattgtgctagattcctaccctattcttttcctccttgctgtccccactttagagtcaccagctcagtgacatgcaggacatggatgttgtacaaatgtcttttggtcaattgtgtcgtgtccaaatagtggagtataaatggcatagcacagggaccagcacccaggagcacaggggtgcagaggttccccagagctcatcatggccttagtggtgtgcttagaattatggttaccatggcggaagtttgggttaagattgactagcactaaggttgtggttagggtgacattctatttaacagtacggtagtggttagggtaagattagaggaataactttagcagtgcagcattagggtgaggttttaatcttaggattgtggtcagggttgggttagggttatgctaaagtaacatttaggactgtgggtgttttcgattgtatgtgtggttgttgttctaacccaccattgatggagccttattgaataagctgacagtttacaggcaccacctaatttaatactggggacagctcggcacagtggctaagagcatgggccacgagtcagacagatcccggttccacttgactcggttactccccagtcgtgctatcaagtgtgttctttcacctccccgagtctcaatgtgaaagactgatgataccaatactggctgcgcagagctgtggtcagaataacacaaaggaatgtggataaagtgccggctcacataggtaagtgctcagtactcgatagcaaatactttttcttgtctgggtcagttagagttccagcaggaaagggatggcacactcgatgtatttatttacaaaagcactggcagagtcaagagaaaacaatgaataatggtggagtatcccagggtagttacgtaggcaagctcttaccctccaggtctaaaggggcaagggaccagcagtcataagaacccagggtagctcaggctataggagagggccatggacagggctgcggcctctggtggaggaatgcagccactgctcacctgcagtacctgttgcgagggagctgggaggatctgcacctccactcacccttctcctgccctctgacctcctgccacagttccccactgatggaactggaccagaaggcagagggcaaaggaatctcccaggactcagagtgggatggagagggatccaggggcaagtggaagatcttcagcacatttgccagtccttgccatgaccctgtgaggagggtattcccatgactcccactttgcaatgaggacactgagggtaagggcgattccagcctagctctcctcgacttcagaacttgtgattatagtcattgtgcgaaccagcctccagggcatgtgagcgtaggcaagtgcggaaacatccagcttggcttggaaactgcagagtactgggttaggcaaggtatccagcgtcttttcagaaaactacagaagtcggtgagagcctggagcagcattcggcctcattaaaatgttaatgtatacagtttccagcaccggacttaaaataactagtgacaataaacatttcaagcttgtagctatgttcatagcatctagccaacttaaatcctgtaggatttttgtttgaaaggaagaggctgggagcaatgaagcaagaaaagagaggaaagactggcaaagctctttttcagatggcccagggaaggttcgccccatccggctgctttttacagaactggctgctcactcagtgagggtctccctctgcgggggtatgtgtgtgtatgcgtgtgtgtgtggcggggcgtgggtggaagctgtggagagaacatgtctcaaaagtcataatggagattttttcaggctccgtgaattctccttttgagctcaagtttttcaaatatgtatcaggtttcacctcttgtccaggacataaaggaggtttctgatttatgggtccggtagtttttccagttactccatctttaaatctgccatcagttaattaatttgccacggtcagaaaaggcactgtgagcttcccaggtgaaaataactttagcaaagtatgatcacagtttaaaaaaaaaaaaaagggaggcattctgaaacatacacttgtttccacttgtgaaattaactgaatcagtgtctcggcactcctcctcctccccctgtcatggcgcatgcacacacacacactctctctctctctctctcacacacacacacacagacacacacacacacacacacaccccacctctgcagaagggctaaaggggaagatttaaacctggcaggataatttcccagaaaaggattagaaggggaaaatggattaactgcaaagtcatctgatgactgtgttgtatgaggctgcttgggacccagaggggtgtattcgtctgtctgtgtctatctgtctgcagatgacaccgggaagattgctaaatgattcccaataatgaaatgtgaaaacacatagttgctttgctagccacatagctgtggttttgtgtctgtgattcatggtggaagtgagtagctgcgacaagcattctgtgggtttttttttttctccttatttctcctacaaaaatatttgtgaaaggtctaaaaggaagtggagtactttttgaaaagaaaaaaaatccctgttccttgcaaaacaaagattacagatgaaaacttctggagctaccacatttctgcttccagatgtcgcctacgctgcattttcctcctggagcctcagccctgcccacgatgtaacatgtccacccgcgagtgcccgcagcagaggccacttgagggagtctgcatctgcaggggtctggcggtatcctctcaagaccccagccaggccacgcccttccaggggagaaaaattaattccacatttctttcttttttgatgttcttgggacaaggtcagaggctccacaaaatgcagtagcgtgtgagggcagaattgtgaaataatttatgtcttaaataaacctgagtttgaatctcagctccaccacttagctatgcagcctacagtgagtgatttaaccttgtgagcttcagtgttctcatctgtaggctggggatgatcattgctaccttatggaattgtcagaaggattgactaatccacgtaagtgcatctggcacatttttggtcctctataaatgacacccagtcttttttggtggggaggaggatggagtctcgctctgttatccaggctggagtgcagtggcatgacctcggctcactgcaacctctgtctcccaggttcaagcaattctcctgcctcagcctcctaagtaactggggaattacaggtgcccaccaccatgctcagctaatttttgtatttttagtagagacggggtttcactatgttggccaggctggtatcgaactcctgacctcaagtgatccgcccacctcagccttccaaagggctgggattacaggcatgagccaccgtgcccactcttttttttttttttaatataaagaaaagtggtttatttggttcatggttctgtacatttgttcaaagtctcaccgtacccactcttacttgtcccctgcctcgggggttatctgagcctttcagaaatgcagcagcggtcatcagaaactttgagaatttgcccagagcacttgaaggtgtttccagacctgggaggtttctggtcacagccaagggtgagcagcagggtggggaagggaatctcatcccccagaggcagacagagctcagcctgaagaccctggcccagcacttccctgctggggatgaccccgggcaagttagcaggctccctgtgcttcagttttctcttctgtaaaatggggacactagttcctgtatcatagggttgctgtactaatcaagtaaataaaaaaataaaatgccttagcagaggcctggcacatcataggttgacagatttgggctgctagattgctgaatggaagctttccaggttggggccctagttcccatagaaatctccttttgtttatggccccggggtaaatttccagcccctgtgagagcggaaagggcaggctgggactttggccagttcctgaaagtgtatctttgacccaggtccctagctgccttagtctacagtgtgcttgtcggggcaggcccacgagtggggtaaacacatctggagtcaggcctgtgtttgctgttcaataagccagacctgctaagcttgtgcatgggcatgtgtgggggcgcatcatggagggtggaagggtcctgaaggccatgagctgggaactcaagggttcaggaggtgagcatctcatggccaagttagtggtggtgagatgtttgtataccaggtttgctgtggctttgggaaagagtcctagctcaatcccctcagcctaggtgtctctcctccccttcctccagcccctcctccaatctcctgtagcacttgccaggtccctaggccctgccttgcattttcattcccttttcatggctgcagctctccagccacttctggttttcatacacttccttgtagttaatgcagcatcaccatggcagcttgtggagggagtttggctgcagtgatgggaggggtgagatgagctttagagcctggcagtcctgagctttaggactgtgggttttgccgttcatgagatacgtgagcttgggccagctaccttcctccttcatgccgcaaatttctcataggtcatagtggggcagagacacctatgtcttaggttcttgttaggggacctttataaggtcatgtgtgtttggtgcctggtgctcagcctgtgtttagtaagtatagcaattatttcatcaagacaggttgtgtgggaaggactctgacgccccagcagatacccagaggaagagataccagtggacaaatctcattatagtctgatctctgcccctcagcacagctggcttctgtcattggacctgggaggagtaacccccttttggcatgagcagatgccctgttctaatagccaggggaaacccaggccttgatctgagctccagcagcacgtctgtacacaactttagtccttcagttcaacattcccagtgtctgcccacccaaagaacctgtgctaagagggggtctcctgcaattagaccccataacacattccaagtggtaagccaggaataaataaccttctcctgtgtgaatctcatacttcctattaatcattcttccattcattcaggccagttggaagaaaggatgctaaaaagagggatgttctctgagtcgggcaactgacaaggattttgttcagacttggccacccttctttccctccctccctccctccctccctccctgcttcccttcttccctccttccctccatctctatcttcattccaggcactagatgacttggacccatgcctcgcctctaagagctcacatccagcggtttgacatgctcaagcagctacagcacacccagcccttgggaagcttttgcaagtgctctaggagacaaggaggggagcatccctgggcagtgtgggtaataggggtaggtagggggcctccaaggggagttttccatgactatttttaaccttgttactttctggtgaaaacacttttttcaaggcttccttttcaagcatgaggttcataggatgaggcccagactgttggccttctgtactaggtcccgaagtatagttctcaagatggtgcaaagattcgtggtataggctctggaactagaatatctgcagaatgcctgtatttgattcctagtcattgactatgtgaccttaagtaagttacctagcttctttatgcctcatctggaaaagggataataataatacctacttcctaattttaatggtggttaactgaattaatatatgtaaagtgcttagcacagtgcctggcatatgattagcactatgtaactgttggctattattattctcatccttgactcctcctatttctctttaatcagacaggtctgattatccctgaacaccatgccagcacattcctgaatatgtccgtttatgcttgtggctctctctgcactccccaccccttcctccggctcatgtctcccaccctctggaaagcattccccagtgatccagccccacggccgcgctggaacatgctggctggacagcttacctggccataagactcctggcttctgcccctctcctccatctctgctcttggattgttatgaaatgctcgcatgcagggggctggcccggggctgctgtatatagtgtacctgctgtgtcctgcacaagggtgccaggcaggagatgaaccctggggccaaaatctagcctgtgttctgctcacccagcaccgggaccacgctacatcagcctgaaggaagtagggcaacttctgtaaactggctgcccagagaggcctcttgtgatttgtgcgaaggcaccaggtatgctcggcctctccctaccccctgccccccagtctgggtggcaagctcttggtgggaaagatgccctttgcataatgcctgatgggacggtgcacgttggcggtggttgaacgacgaattcatgaaatccaggttcaccgtgtgctgacaagtcttcccgagggaactcggagccaggggcctcagactgcctgcgggccctgggtggctgaggaatggggcccagctagggctggggagatggttccagtgaggcaggaggactgggagaagccatggagaagtctgaagttgagtgtgagaaatattttcagggcagcagctgtgtgcccagcgctgtgacgactccatggaagatatgaagagggtaaggcccagtcccttccctcctgggggtctgtgtcccccgccgagctgcaaccctttgggtggtccagctgggcccagaaggagacagggaagcacttagaggggctctttttcctggtgggaagaagagggctatcgccacagcagctggacacatgggcaagctagggagaaaatgaggggcatttcctggagccctgagaacctctcagggccacccccaccccgcctctgcccctgaggtggcccgggtgtgagcccagtgcccaggcagctcgctctggctctcttgcctggctctcttaccctgccaggagggaacaaaggccgcgcaggatctcgaggggccagggcttggcagcccggcagcctaaaggctggctgctcggtggaaaagtgttcacagtggaccaacacatgagggggctggagggtggaggggagagatgtggctcctaggagtctctggaccctttagaaactgaggcagcacctacttcagggctgcccttgaggggggaccgggctgcaggcaagggctgggtgcccctccctgacattaaccccgacacgcagagctcatgcctccctccgtctccctgcctgaaacaggaatgctgtgttcccttgagctgtctgggaagcagggcagggtgtggtctggacaggagagactgccccagggctctacctcctccccacccacagcctggcagggtcatcccctggggtctgtgtgctggggaatccagtcctttcagacctaggtgtggccataggaagagctagaggcccagagcctcagagcactggggatgtgactcatggcagccaggtggggtgagtggggtgcctggagctgactgatgagggcaaagaggttgggtgggtgcgccaagcagacacagcagcaggagtgatcttgagactccttggggacacgggggagagggctggctctcgaccctttaggataggcaccagggaatgttgatgatgccctatcagcgtgccaggcaacaagaaggtacagattccaatccaggctctgggcccgttgaacatgctgtccctactcgtctccctatcttaggtccccaggggtttggcagccaagggcctgcctggccagacaggaggagaaaggagcagagctctgcaagggccttcctctgccttgccagcacccagatcctcaggggagaccaagccatcagggaaacacagggcatgttaagctgaagtgagctgcccctgcagccgcaggaaggagcagcctctgcgctttggccggcagcagagagagttctgggaacgccttcctctcttggagctttctcctagatccttcctattcctctggctgctcccttccagatgccttcagagcctctccctctgtctgcctcttaagcgttggtgttccctaggccccctctgcccttctttgttctctttcctcttacatttctcaaactgtttaggtgtcagaacacctggaagtcataaggagtaccacgaaatatcaatatacttaatttcatgattagagctgggaacagttttattagcagaaactatgacgattgtctatgtatgcataaaaaaaattaaaaaaaaaaacccagctataggcacacgcacgtgtccgtgaaaagcgcaaactgtgggatgaagtatgataggctgttgccacatttttccgttaatattaatttacggcttgttcgtttgtttaatcgtgtgctagcagacaagtggtagcaggcgccagaggttggagaagaatttatgggagcaagacttagaactgagaccattctgttcattattacattttccccttttaaattggaaaacgttggcagagttaacgccccagtcaggcagtggcactctgaagcatggtttgttctgcctgctttcctcgaatgatatcatccttccctcttaactctacagctaccacctctactcttacaacctcctcccagccccaactgtgtctacagccccaaaactctctcccaagttctgcctcctgggtgtttccatctcaagataccaagcactcattatatccaaaactgagcccatcattcacttcttggatttctcatgttgagatcttggctcttggaactccctccacctattagtccaagtcatagctgggaattatctgtctctacatctgaaatagcccttgcatccatgccttcttcttggttctttcctcggccactgatagcctagaccacagccaaagccttccagctggcctccagctcgcctctctttagtccactctctaccaggtggtctttcactgcaataatcatcatttaagaatgcccatcccaacatgtcctaggcctgcttgaagaccacgagtgacttgaggctaacatgtggcttcccctctgccccctcacctttgctagggtactagtccctttgtccaccccgcattggagcttaggggacaaaagacttcaaccaaggttggagtttttgccatccctggggtcagtgcatggcctgtaacaggcactcagtacttgccctttgaatgagtgaaaaagtgtagctgttcttcggaccgggtcatttcctgcttcaaaatctcaggacactccccttcacccactcagtacagcccagacacctccctgaatatttcaagaccttcaccataagggcacagacctattctttaatccctcaaagcctcaatgtcctcatttgtaaaatggcgataaagaaacgattaatggtagatttaggatgaagttacctggtttggtaacctggcctcagcacttaggagttcagccaccttctgcaaggcatagaacccccatagcctctgttttcttgactataaaatggggataatgagtatctaagtcttaggatatggagagctctatgtgagaggatgcacgtaatgggcgttattggcacagaacatggcacaaagaaagtgtcattaaattatagcaccagttggctgggcctggtggctcacacctgtaatcccagcactttgggaggctgaggtgggcggatcaccaggtcaagagttcaagaccagcctggccaatatggtgaaacaaaaacaaaaaaaaattagcctggcatggtggcgagcacctgtagtcccagctactcaggaggctgaggcagaagaattgcttgaacctgggagacggaggttgcagtgagccgagactgcgtcactgcacttcagcctgggcaacagagtgagactctgtctcaaaatatatatataaaaatatataaaatataaatatatatatataaatatatatataaatatatataaatatatatatataaatatatatataaatatatatataaatatatataaatatatatataaatatatatataaatatatatatatatatataaatatatataaatatatataaatatatatataaatatatatataaatatatatataaatatatatatataaatatatatataaatatatatataaatatatatatagcaccagtttattccctacccacccacttcccacttcctgttctccaccctgccacatacgtaggtaaccactgttattaatattccagggtatccttccaaggttgctttatgaatatgcaaataactgcaacatatatccttattttctgtatgttacacaggagttcacatgccctacaccaggagccagcagacttccataaatggccagacagtaaatattttagattttctgtgacatatggtttctgcaactactcagcggtgccattggagagcaaaaccagtcacagatgaggagggcagctgtgttccagttaaactttatagatgcttaaatttgaatttcatatcatttgctcatgtcttgaggtattattctttttttgatttcttttccgccatttaaacatgtgaaaaccattgttaggtcatagtctgtacaaaaacagtcagtggtgggattgggctgttgtgctttcacttttcagtgtatcttggaaagcttaacttattgatgtaaaggagctgccgctgtgtttccagggcctattaccccattctgccagcagatccttgtttgtttaaccaatcccctactgaaggacacttaagttgttttcattctgtacaaactattttgctattacaaaatagtgcttctgtaaatagtcttgttcatgtatcattttggacatttacgagtgtcttaggtcgggtcccctagaggtgggattccagtgtgtgtgattttgcgggggaaatgcgaaaggaaagaagaaagcagtgtgggaaaggggagagagccaagtaaagatgtggtcccaggtaaatcaagctttgacctgattgaggatagagcttacaaagttgtttctccttaaggcctgggggcccaggcttttgaacttccctttcaggcagtcattggctgtgtggtcatggtggtgggaggagcttctcaggtggttcccatcagccaagagcatggcttggaagaaatcacaggtataagcctttagctgctacacttgcagatacacaagccagaaaggggaccagggcagggcagcaacacctaccacagaaggtttatctgcaggatagtcttggaggtggagcagcagggtcaaagcacagatgcattgggatgtggatagacgttgccaaattgctttccagaagggtcatgtcaatttacattcctgccagcagcatccgagagcgtctgtttctgcatagtctcacaaatgagtatgttattaaacctttgggtttttttctaatctgatggattaaaaaatgctacctcagcatagttttcatttgcacatcccttacaaggagaaaggttaagcatatttttctgggttcaagaaatatttgtatttttttttctgtgacctgttcatattccttgctgatttttcttttaaggctgttggtctctgacatttctgtttctaggaactctgatattatggagactcatcttttctctctgatacgagttgcacatatttttcccaccatgtcatttgtctttttactttaaggtgggtttggccaagcaggggtttttgatcatagaattgtttggacaagtaaatgatatattagctaaaacacttagcatgatacctgccacctgataggcattgaattggaatgatttcccttcccccctctcccctctaatctgtgctttacccaaatggtgcttattcttcttcaaacatggcctgtgcttcccacctccatgcacttcttatgttatttttcttttcttttcttttctttttttttttctgagacggagtctcactcttgtcacccaggctggagtgcagtggtgcaatctcggttcactgcaacctccacctcccaggttcaagtaattctcctgcctcagcctccaaagtagctgggattacaggtgcccaccaacacgcccagctaatttttgtatttttagtagagacagcgtttcagcatgttggccaggctggtctcaaactcctgacctcaggtgatccatccgcctcggcctcccaaagtgctgagattacaggcttgagccaccgtgcctggcccttatgttgtttttctaatctggaatgtctgcctcctcattttgggtctgttaaaatcctatctatccctgaagctccctggatccttctcctagatatggtctgtattctatctgaactcctgtacctctgctctccaacacagtccatcgtgggtcctagttatgtgtacacattcaccatgctttttctgagcctcagtttccttagctataaaatggagttgctgggaagaatagagatttattttgattacaaaacaaatacatgtttattccatgtgatgcatatttattgtaaaaatttcaaaaatattgaaatgataaagtttaaaataggaggtacacacacacagacactctcattcttaaagagtggccactatttacagatcttccggccttttcctatgcttatataaacatctgtaggggaagagagagagaaaagcttttcttaaaacacaaaactagaagcatactatccatatattctgcaactcagttttttcattcactaaaataacatagataagatgatgtatataaaatatctggcttcatgttcataatgataattacaactattctatgcatctttttttttctttgagagggagacttgctctgtcacccaggctggaatgcaatggcgtgatctcggctcactgcaacctctgcctcccgggttcaagtgattctcctgcctcagcctcctgagtagctgagactacaggtgcccaccaccacgcccggctaatttttgtatttttagtagagacaggtttcaccatgttggccaggctggtctcgaactcctgacctcaagtgatctgcctgcctcagcctcccaaagtgctaggattacaggcatattctatgcatctttagtaacactcttaaattttttttagcagcaagagcctttccaaacaaaatagtacagtcatccctcgatatccacagggaatttgttccaggacccctgtgaataccaaaattcatggatgttcaagtctctgatataaaatgacataatgtttgcatataagctacgcacatgctcccatatactttaaatcttctctagattacttataatacctaatacagtgcaaatgctaatagttgtcatactatataatttttatttgtattatttttcattgttgattgctatttttgggggttttccccccaaatattttccattcacagttggttgaatctgcagaggcagaacccatggatatgatgggccagctgtttttggaagcccgatttatgaagtaaatagaggagagcagccaggctagggtgagggtgaatggggtagagggcacagagctcctcgcccacttgtcttcccatcgctgttgggaaaccttagtgtgtcgggcagggtgtgggcacaccttgcacatttcagtaagtggcatcattatgggtacagactgcccaggcagctttcttgtgggcctgaagaccccggccactgggatgagaatttttcctcatcttggttgaaaagcccagagtccacagttgagaacagactgtggtggatctggtggctgtctcttggctctgtgctggcctgtgatggggatttcatgatccataaagaaatgaagaaaataaagtcatttggtgagatttccatgaagttaggcttattcaaacgtttcttttttggctctgaaatgtcttttctttcgtgaaattatggtggtagtgattggcagttttgtgtgtgtttgtcttaaagtcttagcaacctaaataaaaagcgactttatgttgttcccccaattttgttccaaaatcttacggattcatgaaatcctgaagtctagagatgactttttggtccattgtggaggcttggccaggacttccctggaacagtcccagaaagatagcaagttccattcttgtgctgggtgagtttgggaacctctgtcctttgatgaaattgcagcggttcttccaaggctgatagtagatggagcatctcctgggggctgtggtcaccttctcattgagacttgccttcttctgttaccagacctctactgtccttaatcggggggatactgcttctttggaccagcctggggcaaacatggcaccagacccttctcttgatgtcccacaacctgagactaggaaagaacatgcaaacaggatttggctaaaggcttgcgatttgcttaaaggaaatgagtgcaaagataacacaaggctagacagtggggtttgcaaactccacagctcacagtctccactccatcctagctgcctgtgcccttctatggggtgatggcagtggtaaccaattggagaccaccagggatccagagttgagccaagaacctgcagccctccacacagcgagagcctctctcgctgctcacctctgaggcctaggctgggacttataaagggagttatcaacctccttatatggatgctttaggaataagaggcaggacctataaaaaaacctgggagcttcttcctttactccacgacgagcctctcagaatgcagggcttttttatttctgtcatttaaccccaaatccccattagagtagtaggtgacaatgaattaggctcagaggactccggttgttaaaaatgtgttgacaccagattagacacttggccctgtgtatatataaggacacttggacagcaataacacttttttctggagtctttttatttcccttaaagaagaactttaagtggcccagtcatgttttcttatttgcttggggagatgtatttagtccaaactgtagctaactccttttttcctccttgtttctgcaatttaaaaattctggcgtatttttctactttgaccatttacttgtatttgtgaaataattgcatggtctcactgttctcgtcatcctcacaccagccctatgaggtgggcattgctattcttgtttcagtgatgaggattctgaggctcaggggagctaagtgacttgctcaaggctgtgctgctagtaagaggcagaaccaacatctgtctggcccagtcccaacccctcccctctgtacagccaggtcctgtctatgactagggaatacatggtttgtttatttggttttcctctctgcaaaactacccaactggcccttaagggatttgaaccctgggatcttggtgccatgagctctgagcaccaattagagaaaaaactgacagcagcaataacataacaatgacaacaaaccaccaagaaagaacactttgagtttccatcctgaccagactggagagctctttgtcagggtcaagttcagaaaagtggcagtggtctgggcagaacatgagctactcttttcacctctctgggatgctctgtggcgctgccactaacctgagcatggcaccagcctggtacccaggacgaggctcccagtgagccagcagttcagccacctctctctcccaggcgctttcttggaagtcctcggagggagtttgctttcttttttgttttgtttttttgagattgagtctcactctgttgcccaggctggagtgcagtggggtgatcttggctcactgcaacctccacctcctgggttcaagcgattctcgtgcctcagcctccccagtagctgggactacaggcatgtgccaccaagcccggctaatttttgtgttttttgatggggtgtctctctgttggtcaggctggtctcgaactcctgaccttaggtgatcctcctgtctcagcctcccaaagtgctgggattataggcatgaacaactgtgccaggccagtcctagtttgccttctgccaggaaagcataaggagtttgctcatggcctggtcaccaagggctaacagaactggggtggagatttggggagggagagaatcccagggccttatcccacttgggcaaggaaaccagtggggagggttggcatgggacctactgggggaagggatgcccccgaggcctgagcagaggcttccaggctgagctcccactggggtctgggctggttgtcggctggcgcaggacacaggttgtggatcaggccctgggttggcatcctggtgtccccatttagctcttgtataaccttgggcaaggactgagcctctctcagctttgatgtctgcaatacgcttacacccaccacagtccagacactgtcgtatacacagtggttcatagacattgtgacaatgacagagtatttacaacagaggctgccttttagaacagcctgcccaataataaacatcaagagaatgtgtccaaatgtatgagacaattcaagcagttaagatgtcaaaggacatgagcggaggattttcacaagtggtaaataaatacctgaaatattttaacctcaaaaataattttttaaaggagagaagggaggtgaaaagaacattgaagtaccactttgtgcttattcaaagctagcaaagtattaaaaattaataatatgctgtgctggcaagattgtgctctaagtggttcatttatatatttggatgcaaccctttcagaaagcaatacaccagtgtgtgcctccagacataaatgtttgtaacctttgatacagtcattctagccccaggaattcatcctaaagtttttgttttgttttgcttttttgagatggagtctccctctgttgcccaggctggagtgcagtggcatgatctcagctcactgcatcctccacttcctaggttcaagtgattctcagcctcagcctctcaagtacctgggaccacaggcatgcaccaccacacccagctaatttttgtatttttagtagagatggggtttcaccatgttgaccagggtgatctcgaactcctggcctcaagtgatctgcccgcatggacctcccaaagtgctgggattacaggcgtgagccaccacgcccagcctcatcctaaagttttaatcctttcaagatgtttcctataacattttttcaaatatacaaaataaaatagaatagtacaacaaatctccctgtactaaaggaatattttaacagaagacaaagtcatataggtaaggatgtacacatttaaaacttaaaaacagtccaggtgcagtggctcacgcctgtaatcccaacactttgggaggccaaggtgggcggatcacctgaggccaggagttcaagacgagcctggccaacatggcaaaatcttgtctctactaaaaatacaaaaaattaaccaggagtggtggcgggctcctgtaatcctagctactggggaggctgaggcaggagaattgcttgaacccaggaggcagaggccgcagtgagctgagatcgcgccattgcactccagcttgggcaacgagagcaaaactcggtctcaaaaacaaaaacaagcaaaaaactttttaaaaaatctaaatatgtaacaggtaaatgtctaaataagttgtgattcatctttagctggactatcatatagcgatgaacatgacaaatatgacaaattgaattgtgtaaagtgtgatctaatgttaagtgaaaaacggaatttaaaattgtatctctaggtgatgacaatagtgtaaaatcatatacgtgagcaaaggttgaaagaaaatatgcaaaagtagttgctgtgttaggatgggagatgatgaattcatgtttttctccttgaatattgttgttacattattcttacaataaaaatcaatgagagggagactctaggctctgccctgaatcaatcttgaaggtgtgtttgttgggcacctcttctacaggtaattcatattaagggatatattaagaagtggtagggagtaggtacaggacttggttttagggcaggggctggtccatagtgggttctcaaagacttctggaatgtcagagctacgtgaggaccgtctaacacccccattttgcagttaagggtcctggggcccagaggagctaagtgatttgcccggaataacccaccaaaagcctggtgattccacataggggttggtatttctacaaaactagccggcaggccttagatcagtccttctgcctcagggcaccttcatgtctgggagtcagccatacatgggtgagaaggcagccagagagcatttttcttgtgcaaaggcagagagtgggtggctggatgaggagtggcacagacacactgttcccagggtgcaaacccccgtgccgcggttgtctccacaggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctggggtaaggataccctgtcttgggtcctagaagagcagggcctctagaactctcttctcccaccttggcttccccctctgctctcacagaggggctgagttgtcaccttgtccctcattctttcagccaatcaacaaacgcttgttgagcacctgctttgtgccggggtccaggggtcctaaaccggtggacctggacttcaccccgttgcaacctttagacctagactgctctatttctgcccaatctatcatcccctcctgcctttgcttccctcatatcccgctgtgaacctcaactccctggtcccactcgttccacctcatccctcctacaaaccccaactctcctggatcaacccaaccagttgttacctcagcacctacagctgcgcctctgcttcccacagaatctctgtggattcacgccatggcacactctttgttattgcctgacaacccctccctgtgtgcctggacattttctccctccatttctcagagcagctactccaggcctcccctcccctcccctcctttcccgaggccccatccatcagcccacagacatgcccccacctcccagagagctcctcaacttcctgcctatcacacccaccactaccctgtttacatctgtgcctgagctcacctccttccttttttttccattttaaaaattgaagtggaattcacataacataaaattaaccattttaaaggctacactgcagtggcttttagtgtatttataattgtgtgcaaccgtcaccactatttcattccacaacatttttatcactccaaatagaatccttgtacccactaagcagcagtcactccttatctcccctcctatccctggcaaccactcacctatttcccgtctctatagatttgcatatccttgacattttacatgaatggagtcgtacaatgtaccatcttttgtgtctggcttctttcacttagcgttacattttcttttcttctctttttcttttttaagagacagagtcttgctctgttgcccaggctggagtgtggtggcatgataacaactcactataatctcaaactcctgagctcaagtgatcctctcacctcagactccagagtagctgggactacaggcatgcaccaccatgcccagctaatttttaaatgttttgtagagatagggtcttgcatgttgcccaggctggtctcaaactcctggcctcaagtgatcctcctgcctcagcctcccaaagtactgggactgcaggcgtgagttcctgtgcctggcttagcataacgtttctgaggtttatccatgttgctgtgtgtatcagtgcttcattccttttcatggttgacgattcctttcacgccatcttgagggggaggtgtccctcttatctaaggcacgttctggcaccctttgtcatttcctctggaacgctggcatcacttgtcccccctcttctgtatcttcaccctctcccaccctctcagccctttcccctcaacgtgtacaattgcttacagctctctcattcacacacacacacacacacacacacacacacacacacacacacgtttctccgctttcttcctatctcctcccttcacagtcaagcttctcaaactcatggtcaaaacatattttttcaatttcctcccctcccatttctccctcaaccttctgcctctggcttctgtccccaggctccccgtactgaattaatagcccaatttcattgccaccactcttgggaaatgaagcggcctcagcttgcactgctgccatgacctcccaggtggtcaccctgcctccggaccccccagcacatcaaagccagcatgatgtcttgcttaaaagtcttctgcagcttccccatcacccaccaaataaagtgcctgatccttgttctggtaatcaggtcccccacaaaacctgactctaatcctttcaggctttatcttctcttctcttagaaaactctcctctctggcaagctggggctgcattctgttccctgcccttgggttcaaagcccagctgcatcacttgctagctgcgtcacttgagcacccaaacttctctgggcctcatttttcttagctgtaaaatggacacagtaggttggatatatgaaaaataccaacactcagccataggaacctacaaaaatggcaatttctaatgattcaacctaacataccacccactcaagagggttgatgtgcatgaagtgtgagcttggtggctggcacatctgcgagcttctcaaaggtatcaccttgcccctacgatgggaccctgcgtccagtaggtactcagcaaatgcccttgagatgaatgcagccctagtcccatggggctttctaaccagactctggaggtcacagctgtgcctctcagccctgccccctggacccaagccctctctctgcagggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctgtgagtccctttcctgctcagatggttcccagctggccctggagggtagatggccagagagccaggcctgccttggactggagcccgctgctcccaaactgtggctccacaagttgtcccaaatcacatggggagctgagtcctcacttggcagcctagctgtgtgactctaggagtcacataacctctctgagtccaagtttcctcaacagagaagagacagagttcatgataatgccacctccccatctcccaggttattgtggggtgcagggaaacgcctaaatagacttttcaggaaggcaggggctggttattatccactcttcttcactctacatgaatgaagtggaaagtccctacatttcagggggctccgggctacaggagccatctagggtcagggttctgccgcctgtttctctgtggtggtcaccagccacagagcgggtgctgctgttcttccaccgctggttaccttgagggttgatgttgcagatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctgggtgagtgccggcacagctgggccggcgggaccctgggaggagtgccagttgggtggaggctgtcaccatggctgtgacagggatagggaagctgcctgtagtccttcctttatgatcaaacctccctctttctcctggccctcagcgctaagtttcattccctcaacttctcagccccctcccatcggaatttatcgacttgtttttgccctttccctgtgctgggaaccctggggaagacaaaacagtgtaagggcagggtgccgccctcaaggaatccatgggcctgggtaatagagggagaatggatgggaaatagaatatcagcataaaacatttcattttccctgccttccattattaggtgccaaaaaaatacagaatgctttaggggatcaggggatggagaggctcctaagcccagagtgctctgggacagctgcgtggaggggatggactgcagttaggcctgaaacaatgggtagcatctggttaagcagagggactggcacgagcaaaggcacggaggtggggccatgcaggagacagggggctggagttccagggttggccagggtcatgggggaggtagaatcaggaaggtagcttggaatgtgataatgaggctccttcagtgacagagtttgcacttcatcccgtccccacaagggatcattctggggttctaacttgggagcaaagaaatggaaggagagttttggggtgacacatagccagtggcctgcctggcccaggggtggtggatacccttcagagggttggaaatgagggtggggccctgcttccctggctctgactctagcccctgtgcccagcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacaggtgagaacacagctctggcctcagccctggatgcttccaggatggcagttgtccccagtctgcccttctcctcctctctgtcctctttgttcttatggaatgtgagtgtctgcagagtctcccatttcccagatgggaaaacccaaggcatgaaattgtccatgtatggagagtctgggcctccttcctgggctctacttggtgcttgtcaataccaggcacacagaagaggacccaaggaagttcccctctggaggagctgtcaccagcatcctcaggtgaaggcagcctagagatgctgatcctatgacccctggcacatggaccagtggggctgttaggatctggccaggagttttttatccagttgaggctacagttggggtcgcagaggtgtggaattaacaaatggaggttaaccccaaagccctggtggtacaaagatgagagatactcctattgccctctggaaccatcctcagctcataatgggaaatcagggaagattttctgaggccaggcacccaagaataggggttagaccagacccagtatggtttttcttggggttgccaggaaaccgcttagtttccagaaactaaggtatttccagaaaccctatctgagattagggaactggaggaggtgggacagccaaggggtaaacaccctgaattcccagatcatccctggcctctcaccttggggtgtccctgagcctggggctctgctcacaaggcccactctgtgggtgaccctgcagttccctggaggtaggcagaggaagctcttcctttaggaccctttgtctgtggttggggccatggagggtggtggtttgcagccctgcacagggcagatcttgtgtctggggtgtcccatccacacacaaggtttagggctgggagagtgcatggcaggtttctctgcttccttctgggatatgggctgactcccttctccccttctttggctggggacatcctctggcagaatgtggggagtgagctctgtgtcctaggctttcccgggacatctctgtgcacagcctgggagggaaggggggtggtcacaggtgtccatggcctctccttccagtgtgccaaccctctgctggagctgactacccaggaggactgctgtggcagtgtgggagccttctggggggtgactttgtgtgccccatgcccacccagaccaggtgagtgctggagtccaaggtcacgtgttgtggaggaagctctccctgggcctgccctctcctgccagggtttcccctccagggtgtcagaggccaggcaggtagaacaggctggtaaactgcagacttcccagacctgccttgaaggtgtttctggccagcactgaggctcctggcagccctctgctggtgcagtctgtcctgcctgctccatctgattgcctgcaagggcctgctctctcttgcagagattcttgatcagattttagggatttcactcagtgttcccctgcacacccctcccagatgccaggggtccagagatcttgattcagtgattcagtgttttctttattctctccctgatggggcccccaggcctcctctttatctccttacctcctgttccagcctccctgactttgaattagggttgaatgtctgtcctagatgtcctcatccttggggtatgggagccctagttccttgccctcttttggacgatgggaaaaacctaacatgtgttaattcattcattcattcattcagcaaatactcactgggtgccttgtatgtgccaaggactgcaatttcaggagtgagcaagatgcctgttcacgatgctctccccagtcttagttgcacaattgggaggagggtgaccagacgcctgtgcgtgagtgtggcttctgcccatttgtctgtcttctccctccaggcctcctttctgggcctgggcctgagcctggtgtgtatttcctttgcctgtcagcagtcagcttggtcaatcagctttgtcaggaggctggacaggagcccaaagatgggaggggcagggctgttccttgcatcagactcagctgtggagcagtgactatattttccaaactaaaaataagtgtagacagttttacagtgtgatagaatttttggcgaagtagcaaagggtagtgttcagctcccaggcttaaatgtctaacacatactacgtaccagtcccagctcttcctgatcacctctctctgcgtcagtctcttgatctgtaaaatggagatagtaatagtgccagcctcgtagactgctgtagagattaaatgaaatgatgcacatgcttagtattaggtcaataaaccatggctattacaatcattatcattattgtaattagaaagtatccctcaagaaagcgagaaaggaatggacccactgcacaggagatgtgcatcaaactgcccaggtctcccctgtaggccagagatgtttttgccacttttcttctttccttgttttcttttctctttcctatcaggcgttgaacccttgaaacttctatatcccacattctaatcagtcgacaaatatttacattgactaagcccccatttgaagaggccatagcatgcaggccctggacagagagtagagaaggtggtaaaaaccgcaccttcctctccaagcttacgatttagtgggtagtcatagatggctggtaggcatcaggaatgaagaggtttgagcagtgtctggtcaagtgctgagtgctgtgcaaacacaggcagtggagcccaggcccctcataggtccagtagcacctttgtgcaaattagaaaaacctgcccttccatttgttcaagatcatcttcataaatatgccaatctaggatgccaatgattcccttagagatggtgcttttgtgcagtgcacaacttgcacatctgtacactgtgggatgggggccctacaggctaaaccctgtggatcagggaaagcttctcagaggaggtgacttccaggatgagatttgaagaataattaggggtaggacagttaagtaatggggaagagtttaacaacccaaggaaattgcatgtgcaggtaagaccaagagaatgagcaacattttctggagcacagtatgtctcttgctgagccctgctcagccctggctctcctgtagaaaggcaggcatgtcagaagggttaggtggggccagggctcccaagtccctgctctgggcaggttctggttcccaagagctggctcattcagacaagtgggtgggggtctctctccctttaccccatcaaccctctgaggggcatgcagtacctgctgcgctgaccaaggtgctgacctgccctgggacctcctgacccagttagggctgtcctaggagggagctggcttttctaggtggtaggaacaatgagatttcatccaagtggcaattcaggggcagccttagaagtttcccctccttgtctcagggctcagaagctgtcacgctgttgcctctggaatctgagaaataatgaaggggaagagtgggctcagctgccaacagcgtgagtgtaaaggagtggagtggtgcagctgagaaacaggcttccagaagggccttctcagaatcccgcttcactgctgggattctcctcccagctgaggtctatgcccctctcggaaccttcctctgggcaagtcttcaggccttaaggtgtccttgatttgggtaccaagcataatcctgaactcttgagatgcagccctctgggtggggtgtcagcgatcagggccccacagggtccttgggtcagtatctcctctgtaattcactaagccaatctgacagtgatgttagtggccacagacctatcaggtgacattagtgaaaatgaaaatagagccactctggattcttcacttatatgtcacatctgccacttataggattggaggggacagtgggagcacagggcctgcctgtcccaagctctggagcccatcaggggtgcagagatgcaggctgtgaggtccatgccagggctggctgctgccaatggaggattctaggcctgttgccctcagccagggctgacaggcaccatgaccacatccccagatcttggaagcacttctgagagtgggggagccctccactggaagggtggggagcaggagaaaaaggacagagtctgtactgaagcagctacctgctcgcccacttgctgcactcctggttccacctgtgtgccagccttgagagctcagcccacctgatgcccaaggaacctgctccaaatacagctggtgagctcggttcagacagggctagagcccagtggcggtgggcacgggagcagagctctgtggatcaggtgcgtgcagaacacgaattgtacccctcccccaacacacccaacgctcagcccttgccctcgctccgccccatcccagatggtggcctcccctactgtgttcagaacatctcagcgcgctgggcaccagggtacagaccctggaatgtcaagcatcccagcacactgagcaagaaataacaaagaccagggcaacataaacatcaaaaacacatgaaagtgcagttgggcattgtatagagaaggggcaagacgttggggagccttgtttgtgttgacagagtgccaggcacctcgcttcatgcctgaacctggggctggggtgggcacatttctttaagtggggatgacaaggaagcttctatacaagaagcagaggaagaaaagacaagctgccagggcaggtttggggaaggttggcaagacagacaggacttctggatcctagatcatccctggcactagtggctttgcctctctgagcccctatttctcctctgataaaataggcttatgcttctgggggaagcctttgtcatccccagtaaagtgttctagcaaatcaggcagtggtgggagtgatagggtgagcagcctgggagtggcttcatggcttcccttcagtcacattctggctttgaggctctgtgctggactgttgaagaaggtcgcaacagaatgccactattcctgacatggaaaaggactgccttgaagtcttaattgcatggcataggtaaatcccttttgttccagaatgccacagaacttgcatggagagctggcccgggagtcagtctagaccagcccacagttcccctctgctcccttcactctgagtggtagaggtaatgtgtacccagctgaactcccaggacttagcctgagccaggtcttcctgaccccttgggatttatcaaagggtcccagctcatagccctcttcaatcctcctgccagagtctggagaacacacggttctcaaaagccactttgattgaggccacatttttgagttttcatctgagaaagacagacatctgggctgactggaaagttggccactgccccatctggcttggcactggctgtgtcaacccccaggcccctttgctgggacaggcggggctggcacatggctcagggcctacagtggtgggctccagctgtttgccatgagatcgtcttgccatttgcctggggtgggttgagttcacctctgaacccagggccctctgtatctccagggagaacagattctcttgctctgccctttcaaggaactctgcacctttctctcttaaaccaagaatagccgccagttcctgaactttcacattacactgggcccttcacatgttttgtctcactgaatttgtacagccacctgcaagcccaggatttttaaccctatttgatggatgaggaaaatggagctccaagaaggctgaggagcttgtccaaggtcatacatctagggcaggtagagccaggattccaaccacagtatgtctgactctcagctgagcaagatctccctaatcattctggggagacctgagcctccctgaaggaaacaaagatcaggatgctagactggaattctgcagccaagaggatgcgcgtcaagattgggttttgtgagttacttgtgctatatccgtcaagaagatttgggttagatagaggggcaggttagcaacatgtagccccggcctgcgttaagagaaataattgccctagggagaagggtgtaggctttcccccacgtggttctcaagagaaatatccaatgtgtggtgtttctggtaaccagagctcgacttgaaactgatcacaagggacaacttattaaaaactgcaggtgcccagcaataaaatgggttgtgcctaaaagtagtgggctccagatcacagggagaatgactaccaagaacagatttttcataggagtcgacaaagaaaattgatttttgaggaaatgggggtttttagagatgtttgaaaatgtatttgaaccttccaacagaaagaaggctttgctttggtcctgacccttgcccatgacgagagttataggtgtagctctgtgatgccagcccctggggaggatgggtatgggagggtgctgggggcatgaggggcagagagccttagggcaggtcacagcagcaacaccattattatcacccttatcatcattcacaaccatttattcagagtacttataagtgccaggcacggtgctaagtgctttttcattttcttgcatcctaacaatatttctagatgttgggtgctattatccccattttacagaagagaaaattgggcctgaaactcccggcctatctgactccagttgcctgcttccagccactctgcaagtggcctctctctgctgcttcttgcacccggcacaagcatttgctgaactggaggaccccggcttggggaacagctgtgctggggtggggctcctgttctctgggattctggatgagatgcccagtcccctactctaaagaaatgggattttcagaattccagttgtcagctgaaaaggcagtgtctctttggctcagagatgttctgagagcttcttccaagggacttgaagcctgctgggaatgaattgtgcctcaggcttaagtgagcaccctcccaacccagcaggggtgggtgtcactgacatgtggcacctctagcccggagagcggaggaagggctggggcaggggtggctaggtggcacctgcctgagccaggggtctgaccagactctttttcgacctcactgtttgtggtgactttggttctatcttgctctgaggaggcagtcagaggccatctttgggcagaatgtccataatcactggggggccccactggtccttcaccaaggagggaaatctgaataatggacattatgagaattcctaaaatgggacaagtgttgtgctcagagttgtacatgcttatttcatgttcatcataaccccatgaagagggacttatcatctccagtttactgataagaagacccagcctcaaagaggttgtgtaacctgcccaaattcacccagctagtgagggacagtgggccagcatgccagccttgagactgtggggaaggaagggaggaaggaagggagggagggaggaaaaagggagggaaggcaggcaggcaggcaggctctatagggtttgtgccatgcatctgcgaggttcagtctgacatttattgtttcagcaaagctaatcctcacaatgactccacaagctgagtcttcgtcctcactgtttttttttttttttttttttgagacggagtctcgctctgtcacccaggctggagtgcagtggcgcaatctcggctcactgcaagctctgcctcctgggttcatgccattctcctgcctcagcctcccaagtagctgggactacaggtgcccgccatcacacccagctaattttttgtatttttaggagagacggagtttcaccgtgttagctgggatggtctcaatctcccgacctcgtgatctgcctgccttggcctcccaaagtgctgggattacagatgtgaaccaccgtgcccagcccagtccccacttctacagatgaaaaaattcagccaggagcggtggctcacgcctgtaatcccaacactttgggagaccaagatgggcagatcacgaggtcaggagtttgagaacatcctggccaacatggtgaaaccccgtctctctactaaaaatacaaaaattagctgggtgtggcagcgcgtggctgtaatcctgtttactcaggaggctgaggcaggagaattgcttgaacccaggaggcagagattgcagtgagctgagatcgcgccactgcactccagcctggtgacagagctagactccatctcaaaaaaaaaaaaaaaattcaggctgagaggttaagaaatgtgccccaggtcacacaggtagtcagagtggagcctgggattagatgtgggtctggctgccccagcacctgcactcctactgggggagtagaattttctctccagcttgcccttctgaggtttgcaaatcaaaggggcaaggcaccagcctgctcacgcgtccctgtgtcactgagcttggcctcgccaggcatgtatgtgtctgtccctgggcagaggggctgtgtggtagggacctttcacatctccctgctgcaggcacctgtcatcacaggctgagattggcacagcttgtaaacagccctgtggccagacactcttcactttctcctccacagctctactcatggagtcagcgccaaaactgtctcgagaaattagtttgcctttactgaggcctccttgggagtcccagcagccgagggggagagttagcagggcaggggcaggctgcagccaggggcccatctgcttctttcttcagtttgtgagcaaccgaggcacggcagagggtggacagggccaaggccagggaatcagaagaccatatgtcccgatgtctttaccaggaaggttccccacatccgccctgcatgcttcatgagcatttgtgatgtgaactccttggagttcaggtcggtccccactgatcctgggcagctgctttggctttcccaagtctaagagtctgaaaggcaaggacactgcagccctgcaaggcctccttgaagcatccgtgggagtcacagcttagccactctctctccccaggtctcacagattctcttctttctactctctgaccccttaccccttgtgataaccttgatctggctgaggagccacaaggggtaggatgagttctacaccatttcctttgtcagttctgcccggcactttggttatgcacatcgtggagcacttaccaggcatctgatcagttcttctgacctccttctgagtatccctacttttttttttttcttattccctctcctgacccctcatttaaaaacagggtagaggtttcctaggaagggtgctaggttttctactgggcaggtacctccattggtccctagggttttctgcctagacacccctaaggcttttcacaaatttatttatttggaggcagtggggagaatggttcagaatttctcctctggagctagactgcctgagttcataatcccagctctgtccaccagcggggtgaccttgggtttgtttcataacctcatccattttatggatgaacctcaatttgctcatccataaaatgggaataatattagtaagactctccaagggctcttatgagcattaactaagttaattcgtgtaaagcctttataatagggcctggcccatagtaagtgccatttgagtgtttggtcttcttatttgttcctattttgactgagtgcccacacagctctaggtgtcatgcttggcaccagagacataacagtgatgaagaagaataagacaaggtccttgtcctcacgtagcttatgctttgtggagagatggaaaagtaaacaggcagccacgacacaccatgaactgagtttttcagctcaaaagctagtgctgtgacttgggcagggctgtatgtattgggagcatgcaagagggacacctggtgtgggtggcagggacggtgacaggtgtcacctgccttcacctgtcacaaagctcactggctgctgaattttcaccctgagccatatggccatctaaacttccactttctcccaaggagatttaacctgaatttaacctacatatataaaaaaatatatatatatatataacctatatatattttaaatatatatatttttaatatataatatatatatattatatataaatatatataatatatatataatatatataaatatatataatatatatataatatataaatatatatattatatacaaatatatatataatatatatatatattttttaagatggagtctcgctctgttgcccaggctggagtgcagtggctcaatctcggcccactgcaagctccgcctcctgggttcacgccattctcctgcctcagcctcccaagtagctggaactacaggcacccgccaccacatcccgctaattttttgtatttttagtagagatggggtttcatcatgttagccaggatggtctcgatctcctgacctcatgatccgcccgcctcggcctcccaaagtgctaggattacaggcgtgagccactgcgccttatttatttatttttaagacatggtctcactctgttgcccagcatggagtacagaggcatgatctcgactcactgccacctctacctcctaggctcaaagaattctcccacctcagcctcctgagtagcgaggaccacaggctcatgccaccacgcccgctgactttttgtatttttggtagagacagggttttgccatgttgcccaggctggtctcgagttccagagctcaggtgattcactcgcctcagcctccaaaagtgctgggattacaggcatgagccaccatgcccggccttaacctgattttttggattcaatgctgtacttggtcttacagaagctaggaactagccccttatagactgtctctgagaggtgtgaggaggggtgctgagggccctggttttggggtggaggttgttggtaaaaatgggagtttccccagagacagtggcttggcatttatttccctctagaagcctgccttcatgaagaattgcccacgcaacacactcccttcaggccagcaggggggcaggttccccttattaaggaggagaccattttatataaaaagcacatacatgtatccagactaatgggtggacccagctcctctgagattcactcattcctcgggttctcacagttttctgcaggtgccagcagctggttccactcttgcttcctgctctcatccaagctctctgctgctccccttctgatcactaaagaagcaggggcctctgcttcctccctctccctctccctctcagtctccgtctccgtctccctctgttgcccaggctggagtgtaatagcacagtcacagctcactgcagccctgacctcccaggctcaagtgatcctcctacctcagcccccagagtagctgggaccacaggcatgaaccaccatgcccagttaatcttattttttttgtagagacggggttttgccatgttgcccgggctggtctcaaactcctggactcaagggacactcctgcctcggcctcccaaagtgttgggattacaggtgtgagctaccatgcccaacatcatttctccctcttgacatctagagagttgatacctttccggcctgctggctcacccagctcttcctgatctctctctctctcttagagaagcacagtggaaggtaggagaaaggatgtggccttcacagctagaggcccgatttcaaccctgcctctgctccagcaactttgttacctgggtcagttacttacccctcactgagccttgctttcctaatctgtaaaatggggatgacggtccctgccttagggcataattgttgtgagaaacagacatgaccatgtgtacccatggccttgcaattctgaagcactggacaaatgtgcacttggtctctttcctcagccctctggcagcagccttgcatcattctttcccaccttctgctcctcataatgttcacaggctgcatctaatcagcctgccttctgagtttctccaaaggacttctctttcttccctcctctctgtcctcagtttataccaccaggccccacgccagggacgtgcacatctcccagcctcactctcatctttccatctcattctcagcgttttcagaatccccgtgtgtctccacaagagtggccttctaggctggaccctggtccctacatggaacgtgcaaatccggagcgggccagtcctggcaggaaaacatttttgaacttcagtttacattttttaatcttaaaaaagttaagcgttactaatttatgtcctcacttggtctgtccctatgtcaggctgtcacatgtcatgcttggcacacagtgtgtcctcagggaagagtggggcttccaagaaaatgtggcgcctccttctatttgtctttggcatattgcaacacagtgcagttcacagtgctgtgtttactggattttttagttatgtattctggtgttaactaacccacacaaaatggagaggtggctcttaaaagctcctgcaaagaaactgtggatgcaaaatgacactagtcccataatcacaagcaatcattaaaaaacgcaatgccgacccttctcagggggtcttaccatgtcactcagccttattacaaagtaaaaatcgtgacgacctatcagatgtgacccccaagtaccccaggatccaaatgatcgagaagactatatgaaatacagattgatgtaggccattactaataacaaaccttgcgctaagtgtgtaagtgcccagagagagcagctaatggtgaaataatagctatcttgattagaaaaacattttaaaccaccaagacactcaaattttgctgtacaattggataaagaataaatatctctaacatgcctcttggtatttgcaagaattcatttcaacaataaaaatatatgaaaggctgggtgcggtggctcatgcctataattccagcactttgggaggccaaagcaggcggatcacctgaggtcaggagttcaaaaccagcctggccaacatggtgaaaccctgtctctactaaagatacaaaagttagccagccctggtggcacatgcctgtaatcccagctactcgggaggctgaggcaggagaattacttgaacccaggaagtggaggttgcagtgagccgaggtcacgccactgcattccagcctgtgcgacagagcaagactccatctcaaaaaaaagaagaagaagaagaagaagaaaatatgaagaactctctttttgtaaaccactaaaggatgaaccagtggacatatattctcaacagtaaatgacttcctggatgacaataagctttagcaaacaacactgaaagtgtagctactgatgttatgactgggagaaaaaggaattgggataaggtaacagagatggagggtgcagcattcagagacaagctattgccacaaaggagtcaaagctagaagacggcaaattgctacaggaagccatcatgcagctacctttatagagcaagacctttgaaatatcatggtatatttatggaactttgtatggaataaggtctgtggcaattgctcgtgcctgcttagaattgctggctatctataggcaaaagaattgtcagacttatagctgagttctctttttgttccacaaaagatagtattcccctgccttttcctgtgaagacaggtggcgatcagaagtatgcctcctgctagagcttttcaagagggttggcacactagtctgttcctccaaagtaatggagatttttttcctgtttttatttaatgtcaactctttggtttttttttttttctttgtaaagtaagggggaatgttgtgatttcaaggcaggatgtgtatcagcataaaaatactgagaataatttccttgttggtcaatctgcaatcagacatctgtgtatttttagtatttcaaaataaaaagcaaaaagtaataacaataaaatccatgttatatatataacatgcatgtagtgtagtagatactatatgtaataactatgtatgtgaagtatataatacatttttcttagtattaacaaaattttaattgacaaataaaaattgtatatatttgtggtgcacaactatttgtttgtttgttttgagatggagtcttgctctgtcactcaggctggagtgcagtggcgcaacctcagctcactgcgacctccccctcctgggttcaagcgagtctcctgcctcagcctcctgagtagctgggattacaggcatgtgctgccatgcccagctaattttcatatttttagtagagatggggtttcaccatgttagccagactggtctcgaactcctgacctgaggtgatccacctgccttggcctcccaaagcactgggattaaggcatgagccactgcgcctggctggtacacaactgttgttctgaaataagtatacattgtaaagtggctaaattgcacccatgtgtattacctcatatatttattttttgtggtgagaacacttaaaatctactctcttagcaattttcaagaatacaagacgctgttattaaccatagtcactatgtcgtacaacagatcctttgaacttattcctcctgtatctaactgaaatgttgtaccctttgatcaatatctcccctctcccccaggccctggtaactaccattctactctgcttctatgggtttgcttttcttaggtcccatatgtaagtgagatcatgtgatatttgtctttctgtgcctgtcttatttcacttagtactgcttttaataaaagcgaggtgggctgagaggagtctggtgagaaccaggaagcacagctgcccagggcgatggcttcgggggctggggctcactgctgccgggtgggctggacatccagactgcacccgcttcccagcatgggtgacagaggagcccaggggccgtccagtgagacctgtccgtatctccactcttcagcctccccggtgattgagaatggccagctggagtgtcctcaggggtacaagagactgaacctcactcactgccaaggtaggacccccagggccagggctgggctcaaggatgccggggcacactcccagcaccagacaggaggggtgtctgtcactggccgagtggtctccactgagtccctctaagccccagctttggggagtggtggggggctgctgattccaggggactaaggaaatccagggacttgcttgagagtgacagaggaagccaagggggccgacacctcccctcgtccccatctccacccacacccacctggaacacaggctaggggctctaggctatgtggggctgtgtctgaaggggccaccccagtctgtgcacttccacttttctcctgagctggtctccctggagtgggaagaatttcagctctagggtgggaaatcaagtcagcctgagttgttggggcctctgtgggcttttcccaactgaaaacctttagctactcaggcttccctcccgcttgcttcaacccatagccaggaaaggggacggggagcacgggggcttcctgcctgggacaggctcctggggctggcagaggccagtggggaacaaggtggcttccctgtggggagctttgacaactggacaaacagttgtctgtatggtttgctttgggtggagctgggtcagagacgggggattgacccagatggcctccaaggtgccctcctcctggaggttgcttcagagagaggagtctggggaagctctgcatggctgggctgtcttccttgggggtgccaggctgcagaagtgattcctagcccgtggataagcaaaggtgctggggccaagcaaaagggcaggtctctggcccagcctagtccagagtcagactccctcaggagccagtggtttgagggccaagcagacagtggatgtagggagaaatacgtatttttgcctttggagggtacatcggggctgttcatgtctaaacagtcaccagttgcttttcctcctggtatgtttcccaatctggagctttaaggttatactcaggatctcaaatgggctctctgccctccctctactgagccccaagattcaggacaccaaaggaccttccctcaggaggccctgcccctgaaacctccccttcccatgtatgtggctgtggtctctgtgtctgcgaagggacctgctcatctctgcacccgcatgcgtcatctctcctctctctccatccttctctcctacttccacagagtattggaggggaggttactatgggctacatacactgtgctaggagtacacagtgatggagaagacagtcctgccccaagtgcagacagaccccctgaacaatcaggtctaatgagcggggcattcttgagagaaagcagcagtccctgagtgctacaggatcccatggtgggggcgccttcccagactggaaggatcagggaaggctccctggaaaaggtgatacctaaggccaagactttaaaaatgagtacacgttggccaactaagaggatgcaagctctccaggcaatgtgaaccccataagcaaaagaacagtttgtgctgtctggagtgtcccagaaagtactgtgtacgtggcctgtgtacacacgggagatgccacatgtctgccagtgtctcatcagagccacctgtttacccacaggctttggggaaaggtagagggccttggataccatgttagggtttagagcctccctctaagaagtgacagggaacccagaagcagagggaagcaagtcagatttgggtatggaggcccacatcccactgtggccacagtctggatgcatatggatcactgccccttcccatttctcagtagcaccttcccagctcttattggcaccctgccacaatggggcatcctaccaaggagtagtgccccttggtgctcaggctgggtcacctttcagtccctcgttcctgtgcccagtgccaatttccccaaaccggtgggtgacctggctctgcagacacagggctgcctgtgttaccgcctggcctggaggcaggtgcccctcacaagcaattaatgcttatcatctctgctgccatcaccaccatcaatagaagtgccatcatcaagatggcccccgactcctcatatcttagattgtgagggctgagacttccccttggcagggagaagtttgcagcaggaaaagggggtttccccctttgaggtcacagaagaaaccagtgcacctcccttatttgaagaacagcatgagcctccacgggtttccggggggatgcgtgcagcctgcacaaggaagggcgttcaggaggacccgaagatgtgcccttctgaccctcaacctttgcacactcttaactgtgacccctgctgtccccttccccttcagtgccttcctccagcctctgcctccttttccttaccagggtcctccctcctccagctcactgcagacatgctcccagggtcttggggcctgcagaggtgcttcagggacctctggaggaaggctgaataggagggacttggctgccccttctccaccttccaacccacacagtccccctgatctgtttcctgtctgcatctcaacatgccactctccagctgaatgactctgtgcccagtgccaatttccccaaaccagtgggtgacctggctattcctgggacctcagtttcttctcctgtaaaatgaggacatgtgggcctatttgataaaattgtttgtgagaattaaatggggtattatatgttaatacccagcagagtacgtagcatgtaataggtgctcaataaacactagcgcttgaggcctggcaaggcagctcatgcttgtaatctcagcacttcgggaggccaaggcaggcagattgcttgaggcccagagtttgagaccagccatgggcaacatggtgaaaacacatctctacaaaaaatacagtacaaaaattagctggatgtggtggtatgcacctgtcgttccagctactcgggaggctgaggcatgagaattgcttgaacctgggaggcggagactgcagtgagctgagatcacacccctgcactccagcctgggtggcaaaacgagactctgtctcaaaaaatagataaataaataaataaacattagctcttaatattatgatcattgttacatgccacttattggacaaagtggtttgcaatttgatcttatccatttaacaacaccatctggttgttactatcattatcctcattttacaaatgaggaaactgaggcacagggagaggaatcccactgaatacatagcagctcttttgttgttgttttatctggagagagtatttgaagatctctgcccagcccctctgctccatcaggcctccgtggggcgggcacttggtcatctcctccaaccctgcagatatcaacgagtgcttgaccctgggcctgtgcaaggacgcggagtgtgtgaataccaggggcagctacctgtgcacatgcagacctggcctcatgctggatccatcgcggagccgctgtgtgtgtgagtgctggcagggatggggtgggggtggacagtgggagacaagatgggacacttcaggtccacaggccaggcccagggcagcaattttccccagacctgatcacgccatgctcagggcctgtgtcggctattcaacctggagttgggcccaatgtgaaaaacctgatcagcccatcctgctggaacagagatggttactacttcactttttacactaggcattttttccgggcctttgcagtttggaattcgtcttttctatttcttattttttttcctttctaatcatttctgttccatgtgtagcctcgttttctttggtggcgggaggtggtgggggtggcctctgctctgatgtctggctgagccttggctgctgagtgacctttccagaagggctgtccatagcattcatggagctgctgcccgacccgagggcctttccacaatcctgtggccccttgtggttctgaagtttctccttatctgtgaacacatagtgggcattagcattgtgtccaggtatgtacatgcatgtatgccaggcagccctgtttccagagacctctgtggtttccagggtgagaggcccaggctggcagcagcccccaatggcagaactgacaccacagcccagatagggctttccctgggccgggaggcctgaccagagctgaataaaaccagtcccaactggcctctgggaggcagcagccgaggttggatgggccacgcccagctcagcagagctccctgcaaccggccaagccctcagtctgcaaactttctggtactgggtttgggagggccatgggattggacaagactccagtgccacccagaggctgaacccagtggctctagggagagaagacagcaagagctataggaggggggtgcccagagagtgaggggcccagagtggggagaacatgtcagaccgctctcaagaaaccttcatggtggcagtggcaggtgatcaaggccttgagaggcttacacccttccttctactccacatcacttaagatccctttaccagagaggtgtgtttgacatccaaggtgacttatttattagtcccagaaagagacccttaatacagggaagcagagatggctctcgagtgtccttttttccctctctgtccctggtgttactccctccagcctcctacagtgattcacctccctgtaagtgggaggggtggcacgaagtttctcttccctttgtttctgagttctgcctccttccctccctgccgcctgaccaggtccagtggggcagtctacagggctgccccagcctcctgatattcccacctgggtcatctccaccctggggttcaaagggacagagcccttccttacagtgtcccaatggaagtggctgctagaagcagagtttgcacctggagatccagggctcacagacggctgatgatttacctgtggcgggcacatgacctttaacaagccactctcacacacctcactctatttaatctccacgacaataccacgaagaaagtttattaatcgggagtctttggattgcaagtgacagaaaccaaactcaaactgccttaagcaaaaaagaattcgctggggctgggccccgtgcctctcacctgtaatccaagcactttgggaggctgaggcaggtggaccacttgagttcaggagtttaaaaccagcctaggcaacatggtgagaccctgtctttacaaaaaattaaaaattagccaggcgtggtggtgcacacctgtagtcccagctacttgagaggctgaagtggaaggatggcttgagccccagaggcaaaggttgcagtgagccgagatcgtgccactatactgcagcctgggcaatagacaagactcttctcaagaaaaaccaaaagcattggttcacacaactaggaagtgcagacgtggtatggcctcaggctggctgacctaggcagccacagtgtctgcagggcatgtcctgctctttcctctgtgtgagtttcatggttccttcaaaggtggtcaccagatgctctaggcctacaccctctcagccttgcaaactcaataaaaaatgagccccttttccccaataacccaggaataatagtctcaaagctgattatcattgggcctccttggttaagtgcccatccctgacccaatcactgtaaccaggggtatggaccacaagccttcagccagaaaggcgtcagcctccactccagtcatatggaccaagggtgggaaagggtggttcctgtaggagaaccagagtgatgatacgagaatatggtgcatagactctgggcaggcagaaatacaggtgtcccctgcgatggaatcatcattctcatcttcattttacacgtgaagaagctaaggcccagggaggtctgtagttcatggtggagcagggatttgaacttggtctgctgcgtcctgggcctgaccagcacttccccagaatcattcattcctaaactttgattgatgtcctcttcagcccactctcctcctcttagaatccagtcagccctctacggattccagactcttccaacctggcatggcctcctcgtcttccattgagataacatacagaaactattctttaatatttattttcaaagtacaagaaaggagataagggtggtggcattgctatgacctaagcccagcatagctcaaactcacagtgaccctcagtattttgattggctggttgattctgtgtttgattggttcattgacctagccatccacgcatagcttcaacaagcattactaagcatttgcatgcaccaggcactatgggaggtgcctgggtgacagagatgacccaagatagggtccctgtcctccgagctccccatccggccttagctccttaccttgcctcatcttcccagggaggctgtggtcctcaggacatactgctgcccgctcaaccctagggacacgtggggccttcagtaaacacttctaaactcggcactggagacaagcagctgcatcctcattccctgctctcaggttctccacatgcaggtggggagtcacgagtctcatcaagcacacaacatgggcaggtgctgaaacattccactacgcctcttcctcctaaagttcttgtgagcatttgcagggctccaaacttcccaactgagatatgggccaggccagtctgagtgcatgtggccagccacacctccatccactgccctcccagctgcgcattcccctcccactggccacctgcccacctccacgtgctgtgtctgttgcagcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacaggtaacctcctgttcccatcccagctttcactgcccaggggctcaaggccagtgaccatgttgccaggcctgggtagacttccctcaatctggaagactgaagtagccttccctgcctgctcacgtgcttatcccaacctggggctccctccctccttgctgccacaattgccgtgtctcccaaagggagggaaaggaaggccctggtttcctgcaggaacagcacctctcagtttgtcctctggctgttggctttgcagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtatctgagctgggggagatgcctgagggattttcctttcccctaagtttccagcacctcagagaagtgtgggtgttaatcctgggtccctgggcatcccatctctgtggcattaggaaagggagcttggagcagcagcacccaaccctggcagccttctctcatggcctggccccacccacttcctcttccatatggggtcaagaggtgcccacgccccagggagttgcttgtggaggtgggaaagatcagccgcagcccccaccccagcgatcaggcctctccatctcctgccctctggccatgcagcttctggggccggtgcttgctgcaggcctgaatagctggcaggtgggtcctggggacctgcatgtcagacccctggcccggccttggagtcagagtgctaactccagctcaacggccttggaccccagaggcacggggctggagggaggctgggtatgaggctctccttgcaagtgccctgaaaaccatggagaagtcatgcccaggtcactggtaacactgaatgcaggaggcctggaacgtcatagcgccagcaaactatgtgattggtcaaactgctccaggaatctggaatagacaggggagtgaggacagagccccagttgttgtggacacaggacaccggccaagccaggagcaattccactccttcctcaaactgttcccctggcccaaagcccagggcagggggctgcatgacccagcctggctgggaggcatgggagggaggaggtagcagtgcaaggaggtgactccagaatggatggggtggacaggtccgggagcaggtgggactcctgtcacccgaggccttacaggaaagcagggccttccgcttaccaagtgagaggcttcactaagctatcttcaggccctccagacctggggttctggaattttgtggtggccagtccctacaggggtgatggggcagaggcaggtaagaagagtccacgctttctgtgctgctggccctgctggggatgtggtctggggcgcagactgtgaagccgcccaggtggcggtgaggggagaaggcagccagaccctcctccctgagctcacgctgttacctttcccttccaggtgactctcaggctggccaggtgagtgcgtcctcccactagggggccgggcaagcatggcagagagcaggacctggtagcagctcaggccccagggcagtgtctcatgagggagggagagggagaaagatggagtatctgttagattttacttgaagagatgaccaagtgggaggattgatccaaagacccagttttaccctaaaggaagtgataacaacagctcttgtttatggagcagccattgtgcaagcattttcccatttgggatgggctggggccccttcagaaaggaagtaggaacatgtcctgttaggcctggctgtcactcaagctttaagcactgcagacgaggtgtggagctgcttccagttcattctgggtctggcactttctgcgctggtttagttgaacctccaggtccctctgggagtggtgtacagggaagtgtgggcacagctgtgaacaacctcaaaccacctcacggagaaaggtgcatccaactcccttccctgtgcccaagattcccctgggaaaacctgggtgtcgtcccaggaaaacattccagaagaggggatctgcttcttccctcatcagcctcagtccctactctgtcccctgcccctccagcctgcatacctgactgttcccaaatacagtttcttccgggtgccttgttctgtccctgggccaccatatgatgtccccccaggccaaagctctaactctggtccccacagacgcagccagcctccagggcctttttcaccctctgcccactcttctgctgttacatccccacctctcagcaaattctgtccactggctatgttgagggacaccaggtataacctgtggtcccagcttccccactctggccctgtggctccaggcactctagtgaacctccagagcttctgttactgtgttgagatgctagggttatagctgacaccaaattgctgattttctaccatggacccaacactgagctggcatagtatgtacatcagctcatttaatcatttcaacctcccatcataagatagttgagaaggttaatgaagtgagtgggtgtaaagtgcctggcagaatgcccagcatagagtaagaactcatcaatacctggaatgaatgaaaacatgaatgagctcctggtaggaagcccggaggtgggggtcagtgtggtggaaggtggcacatcacagggacggcagaggagccaaaagtgaccttctcctgtttctgtgcaggtcacgaccagtgtcacccatgcacctgcctgggtcacaggtgagtccctcttcctggcggctcctaggcaaaagagaagggagggaaagagcccttaatcaggagtggagttactatgtgtgagctggttcacgctcacacacacatcagaggagggtgagaaggacgtggcctgtgagtgctgtttctgggagctctctatacacctaaggtgctgtgaagtcagcgagagaccccatgacgcttcacagatagttttctagccacagaactctttgcaaatttcatggcaccacttagcacataaatcagaacaaagagacagcactagctgaaacaggtgtttggctgggtcgctagactctttcccccaagaggtcttgtcctgaaaccactacttgcctgtcactggtgttgggttcagacattggaaggctgagctcatgcttcttgtaaaacggtagaagacactgatgcctgtcttgcagactctcaaagcaaataagatgttggtatttgtggcagagctctgtaagctgtgaaatgctttgtaagcagaagtgaaagaatgttgaagtgggaattaggaaacccaggtgtcagctgtgcctccgacaagctgactggccttggacaagtgaccatttctgcaagcctcagtctcctggccctgacatggaggattagactggatgtgctccaacgcctgttagagctctcagattctctaagtggggccagatcaactttcaggagactggaaggcatgggagtgacccaccccaggcttcacccttcgttcttgggagtctgagcaccagggaagagggaagggccatggccagccaaggggccacaaccccacctcttcccctctctcctccacagggaatgccacaaccccaccaatgcctgaacaggggattgcagagatacaggaagaacaagtgaccccctccactgatgtgctggtgaccctgagcaccccaggtagctgcagccagacctttggggctccctgcaccctgccctgtgagctgtgtctgtccagagccaactccagggcaggggcatgaatggaatgccccctcacctttccaactaggtaaagtccccagcaggctcccagctgggctgtgcacccctggcctcatcttacaaagaacacagggtccctcttgtgaaaacaagagccctgcctggagcactgcccaagcccagaagggggaagagaagggacaccatgggagaaggaagccaggggtcttccaggagaatctgggggtccctctcaaggaaggggagcatggggagtgagggccactgggatcctggctcttccaggccactcccctgagtcagcagagtgcctggcagcgagcagctgcctgcccacggggagggctgattttcgggaaggaacatggttctatttctcaaggttgtttaaccaagcctgcattcctctccctctggtcagctacagtgatgggggcgaggggcgggtgtgggggcgatcctggcaaatccaccttgctctggaatgtgccctccttaaaggctcattgtctggggacttggtgcaggagaagcaaggcgggtgttgttgccgctgctccctgtacacgtgtgtgcccgctcctggggctcctgctctcttaaccttacgactgggtccagagacccagtcaccttgtgttgggggtgagggtggtcagggggttctggatttccttcagcaaagggaaagcccctgcgcctggtggaacagtccagagagtggggagtaggggtccagccttcccaggcacaccccactgacctctcctgggacctctctcctctgggctcaaagcgctgctccagggagcatccccttctggcctctgctcagcaggcagagtgtgcagaggagtgctgaatttctgacaaggaaaatggacctggaggaagggatgggaagcagggggcagggggcagggggcaggccaagctcagcagcagctcttggcatgtggatgagtgtccccaccgcaaccccagcctcagccttttgccctatcccccttctcctctgccattctgtaacctcacccctctgggcagacatttaggacccagctgagggcccccacaacccccaaggctgacacaaacttagagccaggcccggggagagggtagccttgggtgcacattcaattcagtacaatctggcagactgttaagccccactgtatacccacgtacagaccattccccaacccattcccttgggtcttcggcttctcccaagctatgggggcggggcagggacccctgagcatgtgggcttcaggcaaagacttcagggtggacacaaatgcagaagcatcattcattcatttatccatttggcatgttctaagtgccaggtacctttctagtattagggataccgttcagaaagctaaagtctctgctgtctacacagcctcaaccccgagtcccagtgagtctgcctccaaactatttctcaattctgtacctgtctccccacttctcaccccatcaccaccacccaaggcagaccctcatttaaattatttcaacaggttttaaggacccactatacctcccttaccagttcatccatcatctcgttgcctgagtggcctttctaggactgctctgacccacccccacctttcacaaaatccttgttacaggccagtctcaatgtggctttcaaggctctgctcagctgaccccagtccacccctcccattttcccctggcagttttccccaagcaccttactcaccaggtctgtctgtctgtccagggaaaactgggcaggagttgcagggagggatggcgctgggcactgggtaggagtcaggcccattttcggggtggggctaggatggaggggttttgctggaaatttgctggaaatatgggttatccattagatctcggtgagggggatgccctactatgacctccatcctgggtagggctcggggtgctgggcagaggtcccctagggtcttatgcaaggccaagctgtgcatgggtatgggagggagggcctggctaaggttggccttctgaggcccctagaccctggccactgactgtccccaccccgctccactgcctttgtccagcacccaccctgccataacctctgttttgctctgtctcccacaggcattgacagatgcgctgctggagccaccaacgtctgtggccctggaacctgcgtgaacctccccgatggatacagatgtgtctgcagccctggctaccagctgcaccccagccaggcctactgcacaggtattcacttgggtgccctgggcttacttggcggctggggtagatgggagcaggggctaggaggccgagttgagagtccaggaagaagcagaaggtccaagcagtgctgggtggttgatgagtttaggaggagcacagtccctgtggactaagctaactttaaccttcaggggaagaccagtctcggtgagccccatccgatgagtctccaggactccaggagcacagaagccagcccattgcatgcatcctggcctgtgcctggcagccctcttctctgagatcagcccacccctcaaactggccattttgctgcctggagagcacacccaggactgccccagttgcaaatgtctccaccagggtcatccgtagggggaggtctgaggctaagataaatcatcaagtgtggacctcattcctcctccccccaatattttcaaataagggagaaatatccattgtggtttcaaaggagaaaggaatcatgaggctactgggggaaggagtcgaggggcagataggaggggctggcagtcacgccaggcttctggtgcctgagtgggcccactgggctgactttatggcttccagccttagagattttcagcctcctccactccctcaccccttccttgccacacagcaccatcccctgcccagcccctagtgtgggcaggttgctggtaggtgcccaaagaacggcaccgctggcccccctgacctccctccctgccttcttctggtcagatgacaacgagtgtctgagggacccctgcaagggaaaagggcgctgcatcaaccgcgtggggtcctactcctgcttctgctaccctggctacactctggccacctcaggggcgacacaggagtgtcaaggtaagccaagcccgcccttgcccttggccaggccccacagtcttgagggggtggaagaggaaccaggggttcacacccccaaacaccgtgccgcagaatggggagtgggcagctgaaggagtgaaggaggagagaccagaactccagcctggatctgggaggaggctgattctatgccagtggcaaggaggggtagaaatccaaaaaccagcaatctctgcaaaggccctaaggaattgtgggtggaaccaagagtgtcacagggtcaggagacatggctggagatgaggattatgcagcaggcccccaaactccgagtgacaaggagctggtttcatgtcagggaaggagggagacccataaggatgccaggctgggactactggcagacctgggagtaggtgtgcctttgaacgaggagcacggctcctcagcagcttggaggcacttgtagggctttgcacttccctgggaagatgtggcccactgccaggggacccttgataaatacgctcccaacgcaaaccctttaatgatgcaaaacaccccacatacatttttttccacatacatttttatgattaagttcacaaataatataatgcagcactttctaagcaacaccttaagattcataatccagttgtaaatccttcacctcaagagggaccctgcctgtgcttggggctcacattgctggttctggccagacccccagggaggccagggaagctgtgtaccctcctgctgccaggatcccctcgggttccaatcccccaagggtccagtttacagaaaccaaagccatccaggtccaatcacttgattatggagggaagggaagtagaaggggcagacctcctaacttaacggaggagcgggagaatcacgggtagtgttcattatgctctcatgcgttggcaccacctatgtgccaggcactgtgccaagctctgaggatgctgagatgagtgaggtgtgaatggtgacactgtaggatccagatgaggagcaagttgttctgtatgagattattcgggtactcgagatggagcagaataaaaatagctaccattcattcattcattcattcattcattcatttatgatggagtctcgctctgtcacccaggctggagtgcagtggcacaatcttggctcactgtaacctctgcctcctgggttcacgccattctcctgcctcagcctcctgagtagctgggactacaggcgcctgccaccacgctcggctaatttttgtatttttagtagagacagggttttaccatattggccaggctggtctcgaactcctgatcttgtgatccacccgcctcggcctcccaaagtgctgggattacaggtgtgagccaccacacctgaccaagaatagctaccatttaatgagcacttaatatatgctggcaatgtcccaagcattttgttatatgaagctcatcatcccaactccatgttatggaaatccttagccccatttaatagtttagcaaactgaggctcagaggtgaattgaaatacccaggggcctcaaacctagtggtgacagagctagaaacagaatcaaatcactctagctccaaagcatggtttgcttccaaagacacactcccttacacacagggtgttggagcatgaataggaatggagcgtgaataggaattgagggagcagagggtattccaggtagagagaagcatctttgcagagacctgaatagtgaacgttccctggcatgctctgggaataatcatgaatgcagtatgactggagcagggctacctggaggaagaggccagtgtgggaaatgtcttgagtgccaggctgaagcgcttggacactgtctcacaggcatgggtagccagtagaagtctgtgagcagaacagtggtgactgggtcagctgacttccggggagctgacttaaggggcagggctcagaacaggctggaggagccaggagagaggctgagggaaggaggcttctctgggctccaatcgtctaggtgggtgttgtgggccagaggcactgctctttgcagacccagcctggggagctggcctgggataagcagcagctgctgcagagaatggtgtcaccaggactggtgcagacacaagtttctgccaccgtgccagcctgggtgtccaagatgtctctgccagccccagcagctggggaacgggggtggggttcaaggctggctctaagtacttctcccagtggggcttgggtaccactggaagaggccttgtccagaataacacccactttctgaagcttcccagtctcataaagtaatatctcattacctcaatgatttgatatttatatctatttatagattatttaaataatgtatatataattaatataaatcataatttatattatcaataagataaattatttacatattaaatatctaagtaaatgtttaccaataaatgtaagcatctcttcatacattagcctgtgggtttcctcatctgtaaactgctggctcccatttttgctcagttttccaatggtggttgctgctttttcctggggctctttaggagtccgttatatattctagattcttggccgggtttagaaattgcaatgctcccattttgtcctctatcctttaagcttatctacatttcttggaacagaaatccttaattttgatttactgaaattcaccattttgccttatttttgtgtgttttgggggctttgtttaagaaatccttccatatcctgaagtcataaagatattctcctataccttaattgagttctagttttcccttttatggtatgctttgattcatctggagtccatcttcatatggctgttaagaacctggtctttctctattcacgtctccatttttctccatggagtgagggagttttccagcaccatctatcagacagtcgtcctgacctcaggggataatgagttcttcatccagttcccacatacggctctgtctatgagttcccttctctcttccattggggttagagcttctcacagtgaacaccagttattccagaattgcctgaagagctataacagcgtgggttcctgggcccaccagtacagcaggatcagaatctctggctgtgggcctaggagtgtgcatttcccaccttctggcagagactttgctgtgcactggagttttatgaagtattgctcaagtgaagacactgtccttaaacaaatggttattattcaattccttcagtaagcacttattggggttctgtgctgggcactggagatgctgagataataaggcatgttcccattagtcagggagaagcaagtaaatgaacaggtacactgaaagctgggccctcaggggacgctgggttggagataagtgggaggcagtcacactggtgtgtaggaagctgttccaggcaaggggacagtgtgggcagaggctcaggaacaggtcctgaggttaggcgagggtaggagaggtgcgggcggcaggaaacagatgagaagcaggctggggccggtcatgcaagatctcacacgccaggcttgaggagctgggattttatggggtttaacactaggataataatagctaacatttctgcagtgcttaccttatgccaggtgggcacagtgctcaacccctcacctggattattgtatttaatctgcacaaggactctgtgaagtgtttgtatcagtcccagtttaagggggagagtgggaaggtgaggccttgattaatttgactgtggggacaggggatggggacccacaggacccaaaggtgatgcattaaaccagtccttgaaatgggggcagggatttgctggccatcgtgaggaaagagactccaggtggaagcatttgtgtgaacaaaggcttggagattggactgctgaaatctgcaatagctgaggctataccaagggacttgtgtgaattagcaaatacagcagagctgggccagctggcaaaggccttgtgagccaagctgcgaacagaactggaggtagcaggggtctctggtaggagtttaagcagtggaggggcgtgagtggggttgggctttagatgatgggacaccaatatactttggaaaagtgacagaaaccacaccctacagatccatggttacctaaaacgcaatccctcactggctgcttggttcctaacctttatgaaggtccttaggaaggactccaggaggccaggcgcagtggttcatgcttataatcccagcactttgggaggctgaggagtgtggatcacttgaggtcaggagttcaagaccagcctggtcaacatagtgaaacctcatctctactaaaaatacaaaaaaattagctgggtgtggtagcgggcacctgtaatcccagctacttgggaggctgaggcaggagaatcgcttgagccagggaggcagaggttgcagtgagccggaggttgcagtgagtcaagatggcgccatcgcactccagcctgggcaacaagagcgaaactccgtctcaataaataaataaaggaagaaaggaaggaaggactccaggagcagacccgaaggggatatagtggggccaggagcggggtgggagtccttttggcctctgcagtttatactgtatggactgctaccccacctccagatcagcccttgcatgagggtgaggaaacagttgtaaggatccccatgggtccccagagtagactcccctgagagaaaggaactcaggtttatcaggggcctgagctagatcatttcagacctggcccaggagcccctccaggcaattgtggctgcagccagcatgccttccctgcccaggcctcagcatggcatcctttgtccttggcctctagaaggaatgctccaggaccccgccccctccaccatcctccagggctggctgtgactcagggcttttctgtgtgttcacagatatcaatgagtgtgagcagccaggggtgtgcagcggggggcagtgcaccaacaccgagggctcgtaccactgcgagtgtgatcagggctacatcatggtcaggaaaggacactgccaaggtaaggaacgggaaggagggaagcgccctgccaccccaccacccacctgtccctccctacgcactgcccaccaccaacacgccttctggcttgtctctgccctggccccttgatgctgagcccacgtctatggacagagacacctatgagaattcctgagcccttccatcccctcagtgacattctggcatcctgtctgccacctgcagcaggggagcatgaacaactttatccacatgacaccttaggaacatctcctctgtaacctccgccctgttgccttgaaaaatgtgctcttctcatggggcagaggaagagtcggtgtgtctgggagtgtcagccttcttattaagcttgttagattgttagctcctgagggctgggccatatctttagatggcccatacatggacaactgataagcacccaataaatgctagaggaaggaaggaaggaagggagggagggagggattccagatccttctgtctttcccagacccagccagaaggcgctgtgacattgctaactggtctcctcacagacccttgcctgtctcgtgccagctctgaagacccctggcagctttgctgccaccacgtccctgtcaggctggggtgtcacaggcttgtaggaggcccagggcatttgctctcgagactggctgggacaggaagaaatgagggtaaatccaggcgcagtccaagaagaacctggccctgggtccgagcttaggctgagactcctcccagcctccaggtttccctggctgggacttgcctgctttcagaagggcctggaagtcagagaagagcttgtgtactttgtgaaaggacagcttcccttcccaataccactaccatggaagcgaagtccagagaagcaaaggggagaggttgcggcaggtgcaggacagacagctctgccttcagccccagtgtgtcacctcccaatgcctccctcttggtcctccccctttaaaactcaggcctacccatgaccaaagccggaacccacctgccttgtcctccttagcacgatggagataagacagcctggcatcttcaggagaatggagaatgatggcacccaccactgacaggtgcctcctgtgtcccaggtgtctgggttaggtcctcaatagattacctcatttaagcatcataatgacactgtgaatttgacattagactttatcaaaaagagaagtaaaatgagaggaaatgaatcaagaaaataccagaacattaaaaacatcaggtttaggctgggcgcggtggctcacatctgtaatcccagcactttgggaggccgaggcaggtgggtcactggagatcagcagttcaagactagcctggccaacgtggtgaaaccccgtctctactaaaaatacaaaaattagctgggcgtgatagcacatgcctgttatcctacctacttgcgaggctgaggcaggagaatcacttgaacccaggacgtggaagttgcagtgagccgagatcacgccactgcactccagcctgggcaatagagtgagactctgtctcaaaaaaaaaaaaaaaaaaatcagatttatattaaccagtctgtgtgaagggcacaggctctggtgcagacaggcttgggtttggcttttgacacgatgtctggaaattgaactgtaatgcccatctcagagatgtttgtgagcaccggataagctaatgtatacaaagtgctaggcaccgtctggcacatacagaccttgaataagtagagggaaatgttactgtcagagggtagttctttttcatgtccaggctcccccataccccagccctctccttcccttcccaaggaaaggttctagacacacacctcatctgggaggtcaggcagagttcctggcccagggcagacactccgagtctgttgaaagaaagaatgatgtagcccgcacacttctccaggtttccatcggtaaccacaagcccggcccatcaccctgggagcccagtcaatttcctctccctctttcttctttctccaactcagaaaccactctcgccactgaaactgaaagtctctggtgaaaggctgagtggtctggacagaggcccgtccagcagtctcaacggcatttccgtcgtaccgggactccaggttcccacggacaggggatagacttccctgcagactgccagggcctttggtgtcgcccagccataaccaaggtcacttgagcttctggcccctgcctgagtgccttccctacccccaccgcatgctctcacaaccaccagaagtgaatgcctttatatttcctcatccaaaggctgatctgtggttagagaagctccaggattctcccagcgaaccaacagaagcttggcaagctggtctctggattgattgttgccatgggccctttggggtctcttcagcagccttataccaaaaagatgaagggtgaagtttgaggcatactctcccactctttggttagcaaacatttgttgagcaccagctgtgtcggccatgggctgggaacacaggaagaagacagatggctcctggcttcaaagacagaatattaaaaccctccaaaacacaccgtaatctcagattaacattcataccctaggccaggcagaaaaactggaatatttctgcatccagtgactggttccagtccaggcaccaagatgctggtgggacagcctcagggtagctggtaatagaatctgcttcattcggaatcttcctctggctcctttggattggcttggctaatggttcagttatattcacttccaccaaggagagcccttccctggctcgggtggagaatgaggggctgctttcatcatctgccctccccctcccattcacgtgtgataatcactggctggggctctggtctgaggaaggaagccagcagtggcatgccaagatagacaaggttatgctgcgttaacaaacaacccctatcttattgacatagcagccaagtttgtttgtttgtttgtttgagacagagtctcgctctgtcacccaggctggagtgcagtggtgtgatcttggctcactgcaacctcctcccccaccgggttcaagcgattctcctgcctcagcctcccgagtggctgggactacaggtgcccaccaccacacccggctaatttttgtatttttagtagagatggggtttcaccattttggctaggctagtcttgaactcctgacctcagatgatccgcctatcttggcctcccaaagtgctgggattacaggcgcgagtcaccatgcccagcagcagccaagtttctatctcatcagtgccacatgtccatcaagggtcagctgggggctctgccccatgtttcctcattggagatgtaggctaaaggaatagccagtctctgtggaagaataaaagagcactctggagggttgcacaaattaaatggtttggtccataaattatccgtatcatacgcactcacagttcgttggccctcactagtctcatggctccacccaaccacaagagactaggaagcaccagattaccatggtgcagaaagtggagagctggaatgccacatgcatcctaaatgcccagcattaagacactacacacaccacctccaagagatgtgcccagcatgtttggggcaggacagacttcagggccctttgctcctggcaaaccttatctccttcccacgttgcctgatccctgcaggaaaggtccaaagacttcatttttcctggcatggatttaggaggagctttgcctcaatctcgttctcttcatcctggaagagatcatctggcatccctgaaacagggattgctgctcattctcagtggctttgcccatcctccttcaagtaccttggccaaggccaacaggtcatggcactggcctctgtctcttgggtggccaaagttagtcatcttagatccttcattttatccatctctgtctttacagaagcccttagaatagttaaggctggtgtcaccacaactcaagtaggggctggggctaccctcttgccagagatgcgccttatctcagtgtccccaagattatatgggagttgtgggactctccttgcagagacccacctgaaaaccacctgccctgtggcgatgtccccgtcttctggaccctcaggcagaagctttaggcttgagagggtcccagtcctctgggacagagggcttcgatgtgtcctgacttctggaagccaaacaacctcagagaggactcactttcaccctccactttaaggtccatgtcctctcctctccatgtccagcagcagtgacagctgctggctttagtccctctgcagaaagcctatgttcagaccctaggcctgcctcccacacttcctccataggtgctgagtaggtcctcctctcgggcagtagagcctctaaatatgcataagctggtggacttcctctagaagaatgacaattacccatttaggaagaagaacccctcctctttccttggccaatggacctgttgtgaagagtgggccagagccttgataccgggccagaggggcataatgtcctcctgcagtgctgactcagagttcagtccctgtgacaggacctccctcactcagtccaggtcccctgggtgccttgatgatgaagcccatgatatgccaggttacgtcggggaagagccctctcctcggctccggggagaactagctccctcctcttcctgttgccactctcccttcctgggtcctctcgtcccctgggtgtccatttggtgtccaggcttaacccttctggctgactttcctggatctcaccagagtgggtgccaggatccctacatgattcttggctggaagaaatgtctgacagctctccagcagagaagctttgccagctctaccctacagtctgcactctgcctcagagctggtcttggccatatccaagattgggggttcctccatggtcctcatttcctggtgcaaggaagcccaagttgccttcactgcccctccgatgatctattgtggagcctctggcaatccagttagctgctgtgccaagcacatcccagtaatggtcactgcttataaaggattaggaattcgccaggggagagatgaaagcccatccccaacagcccagctcacaaagtggagcctctgaccctcccacagctggtggtaaccatagcctactgcacccacccagggagtctccctttctaatttttaagttcttccatctccctcttttgtcccagacggtgggtgagaggtggagttgggaacacagggcagctctcattctttcctagtttccctctgtccatccctctccccaaccaaaggcagggacaaggatttgctgtgtcacagacctacccatttgctatgttcccagggatgaccaagggaggggctgctgttttgcagatatcaacgaatgccgtcaccccggtacctgccctgatgggagatgcgtcaattcccctggctcctacacttgtctggcctgtgaggagggctaccggggccagagtgggagctgtgtaggtgagggctgctggccaaggcactgagccagccattcggccttgggacctctggttgagcccacacacggaaagggaaagaggtgggcagagggaggtggcttggaggctgttgtcctccatgatctagctgggttcccagatgacgctgggcatgagtcgccagggctctgccctctgaatcagctagggtggggcccttttctcctctttggccatattcattctggagtgactgcccaaagtcccagcagcttctgtagctggatcctgtggtggagcgaggagcctaagggtcttaggatggggccaggcccttctgcagttcccagggaggaagggtctcctgctcttctgcatctcaaaagcagcgtctaaactgcacgcccaccgcacagcggggcgctcctccctcagaagggcagcaggtctgcagtaggaggcgtgtgctcttttcctgcagccccctcaggaagaaaggctcagggttcagaatgctgggagggactgagtgttgaatagacgctttgaggctctggagagggcagacgtttcccaggccctcagggctgccactcagccacctcggcatgactggcctctctccacgctgcccgcccacccgcagaagctgcttgttgggttgggatcgtgggttgtttggttggccggtaggaggtcatgtagggttcctggcacacacaatgagggaagtcaagggtcttggacacctcatttcaagtatcctcagatgagccaaaccagccccagggcggggagacctggccccctgcgtggatacatgcagagtgctctgagttactagatagggctgaagtgagcccgggggatgggacgccctgccctgcctaggtgggaggagggagcatggcctcatggcctccccaggtggcctgcggcccctctgaaggctggttccctggcctcataactgagatgcttggagcctgccagcgggggctgcaggatggggaggaggccagcccaccgtcttggacttctctcccacagatgtgaatgagtgtctgactcccggggtctgtgcccatggaaagtgcaccaacctagaaggctccttcagatgctcttgtgagcagggctatgaggtcacctcagatgagaagggctgccaaggtacagagatgctgaagcgccccttctccgcaggccgatccagcttgtggctccctcccctctgcacaccacccttggccccctgaatccacccctggccttgcatccctattcacactgacccaacacatccctgcccagacctgtccttcccccacccctgcctacctgccagtgtcctggcctgtctgtcctgcagagtcccacacagaatgcaatgccctatttcagatgtggatgagtgtgccagccgggcctcatgccccacaggcctctgcctcaacacggagggctccttcgcctgctctgcctgtgagaacgggtactgggtgaatgaagacggcactgcctgtgaaggtaaccctggggaggcagtggtggaaggggacagaatataggctgtcttacctcccaaagaacactcaatttgtccccagtttggggctgatgccgaggggctccaggctaggctagaagaccccataaatggacctggccccaacaagagcttctattgtcataatccccaagttcagagtgaggacaggaggaaaagccagtcccagagaagagggaagctgagggcagggctgtcctgggagcgttctagggagggggttttaggaaagccccaggggctcagagagggaagccacggtgaggttcctgcattgcctggggagtgggagccctcctaggtccccgggcgagcgctgtctgtctgcagacctagatgagtgtgccttcccgggagtctgcccctccggagtctgcaccaacacggctggctccttctcctgcaaggactgcgatgggggctaccggcccagccccctgggtgactcctgtgaaggtatgagcctctgtgtgggagaggatacaaatgggatgccccctctgtcagggccatggtgaagcccagcaggtggggggctgctgaggctggaggagctgccatcatcccgctccccaagagtcgctcacaagcttgtcccagctgtgctgcctcatgaggggatgatcccccgtgggtccagctctgcaggcaggtgacaggtcctctggagacttcccccttgactcctgtccttgggaggtgctgccatcggctgtcttcctcccctgtgtggccctgcagatgtggatgaatgtgaagacccccagagcagctgcctgggaggcgagtgcaagaacactgtgggctcctaccagtgcctctgtccccagggcttccagctggccaatggcaccgtgtgtgagggtgagtgacccaggtcaccctactgggggtggggggcatgagtgtgtggggaggcaggcacatccccagcagacacccactccccatcttttccctgcagatgtgaatgagtgcatgggggaggagcactgcgcaccccacggcgagtgcctcaacagccacgggtctttcttctgtctgtgcgcgcctggcttcgtcagcgcagaggggggcaccagctgccagggtgagaagccagcacagctacctctactggccaggagcatgggaagccagcacagctacctctactggtcaggagcatgggcgctacaggctaagactagagtggtgtcccttttaataccagtactgagagcaagtgctcacggccctgcccagggaggagaagatgggagcgaggagtgatgtgagggagcccggggctcagggagggagggactcagtctctcaccagggcctcttcacgacgttgacagcaggcatgcacccactccaaactccgagtgtcacttctcccctttacagagctccagtcccagggaccccacctcacccctcacccccaccccggtgcccacctcccacagcctggcctctggcttcgagccttttcctacataagccactccctgactctcctatgggctactcagggcccagaggaagctacacaggaccctaacagggaagggacccgtggctgggtctgctgacagccatctctactctagatgtggacgagtgtgccaccacagacccgtgtgtgggagggcactgtgtcaacaccgagggctccttcaactgtctatgtgagactggcttccagccctccccagagagtggagagtgtgtgggtaagggctctggggggagggcacagggctctgcccacatctgcccatctctacactgcctggtccttagctcccatggagcagagcactttccacagatgaagtgtccaacaaatagtgtatgtattgagactcagggctcaggggctgtccaaggatgacaaaatgaagacaatcatcatcttcgtgctggcagagcacacaatctagttttaaaggccaaattgattcaatagacattaaacacctgctatgctcaatgtcttttgctaggacaaatagacagttatggatgatcttgaaagcaagggagacagatatgaagacaactctctgtaatacactatgctgaaggcttcgtgtaaagagaagtacagtgctctgctggtagggataggagacagatgggggcagtggaggaaaaggagtgtcacagaagggcaggagctcactgcttcctaaatagcatacggttctcttcccagaggctcagccctgcagggtcaggggaaatcgtcctgaccttgatgtgctggggttgggatgagcacagtaatttggaatagatcaagaaccccagaggttgtggggcatgaccctgtgggaccacagcagtgacctggccacctctgtcctctctcatggcatggctctggggacagatattgacgagtgtgaggactatggagacccggtgtgtggcacctggaagtgtgaaaacagccctggctcctaccgctgtgttctgggctgccagcctggcttccacatggccccgaacggagactgcattggtgagtagggagggaggagagagaggagagagggctgagaaaacctatttttcacatattgagcgagacatgattttctcctgaggacacgattttttgcagctgattgtagcttgtatattttccatccagcagagcttatgaaagatgccacaggactgtgaatgttaggattttcttatcctgggttgagaggctgcttttcacaggtcttggtgctaataagccaaataagtattctcagcagagaacgagagagtgtgcatgcgtgtgagagagtgagcacacacgcgcgcgcacgcgcacacacacacacacacacacacacatcctctatcctggttcccactgtcccacagacatagacgagtgcgccaacgacaccatgtgtggcagccacggcttctgtgacaacactgatggctccttccgctgcctctgtgaccagggcttcgagatctctccctcaggctgggactgtgtgggtgaggagcctgtgggctacccaaggtctgggccagggaagggaaggccctggggtcctcctcctcaactggtcctggtcacgtggctccatcacgggtccccagagcatgggcaagggaggcttcaaagaagagggagacttcaactcctcgcccaggggcacatgggccgggcgggtaaggggaagcacagccgcgctctgccagcagggcagcaggtgtcctcaagcctcagagcctcaggaggcaggaggtttggagaatgtgcactgaggggtaacccttcctctttgtgcacttctgtgaccgtttgctgccactcctctccttttttcttctttcccatgccctctgtccattggttcctcctccctacaaatctatacttactcttgtttcttccccaaggcctagcctgcttcttttgggggcagtgggctgtagtcaggggcagggggcacgggctgcctcttttctgcccacgagcctgttctcacacctggcagatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtgaggcctgggagacacattatccatggtgactcagaggtttacagagagcgtgtccctctgcatccctctactagcctctagccgctgagggggacactgggccagggcctggggcagcatagggaggtgcaggcggggcctggtgcatggaggggtgaggaggctgagggccgcgcgcagcaaaaccaggagctacagggtggcgacgatcctagaggaggctcaggaaaccctgatgctgacttagggtggccccagggaccgcagattgagccttggagggaccctgaatccatctaatccctgggaaccttctggatgagagaggacttggagctgaactaaaccgggctctccctttcccacttcccactccacccgagagctcctgggttcagcctctcacgccaggctggactaggactcagctggtcttcactgccttgggggaaagtgagggagacgaggaagggtgggaggggctggggtacatgtgaagcagaatggaccagagggctgcccatatggcatgccaggcactgggggcagcccgtcccagggaggcaggcagcatggtataccgcaaagcgcaggggaggaggaactggggtcagatccctgctgcactgcttaatagcttaatcgcacagcagtggcgaggccccaagcctctctaagcctcaatttcttgagatgatgattaggccacttcttagggttgtggagagcctcagtgaggtaatacaggtaacagaattttttccactgtaaagtgctacacaaatgttaaatttaagaaataaagtcaaggactattgaccccccttagagggtcatgaacagacagtaatgagcatctgtcacgcacaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcaggtaagaccccaagggttccagatcctcgaagggtcagctctgcaaggtgacactgaaagaaggggagagaggaagggggcagggccctccccactctgagctgaaacgcctctctacatagctgaattcagcgagatctgccctagtggaaaaggctacattcctgtggaaggagcctggacgtttggacagaccatgtacacaggtaatctgctccatcctctgccccaaactccttcacctgagtgggccctagcctgctcctccacagggtccctggggaagttctgcatccagccctggcctcgcagattgcctccaccttttctgtcccagggctgactccctgcagagtgttagctggaagttctgactcaagctgctcttggagtgtccacatgagcctcacctcagtttccctgctctcccaagctgcacctccagaaacaaactatgatgccttgactaactctcacccacagccacatgtgggcacagggacagagtggagagcactgctctagaggccagaggctgcgctcatctccctggccgcactgatgaggccagaaactctggggaacacacactcacagtaggatggtccaggtactgcgcccctcagcaccctagtcctgaagctagtcttgagaaggaaatgatggagacagagattgcttttcttgggtgctggctacacgccgtgcacttttttgagcacctcacacatattaacaccttttcatccttacaacaactctaagagtatgtaggaaccggaggcaaggcgaacttaagcaacttgcccaaagccacctagtaagtggcagagctgggattcaaacccagcctggctttggattccctgctctaggtacccctcatactgcctctcaccttcctctcacctcagctctgccttccacagatgcggatgagtgtgtgatattcgggcctggtctctgcccgaacggccggtgcctcaacaccgtgcctggttatgtctgcctgtgcaatcccggcttccactacgatgcttcccacaagaagtgtgagggtaaggacacacatgatccctgcccccaccccaggcccacagctgaataatggcccacccagcccctgccagccagtcccattattgctgagagtcccccttcctagggaggccgcccactgcagcaggctggtcccaggtgaaggagctgtgggctgtcagagattgtccccaggaggggccttccaggctgggctgggttgaggggagggaggcagggcactaactcttcattatcagtgataggcaaacacccttccctgagggtggttggtggaaaggccaccttggcaatgccccaccctttcctgcctccccagatcacgatgagtgccaggacctggcctgtgagaatggcgagtgcgtcaacacggagggctccttccactgcttctgcagccccccgctcaccctggacctcagccagcagcgctgcatgaacagcaccagcagcacgggtgagtgggcctgagcgtgggggagcaggagaagggtacctgggctggggggctcatgtgcctccgtgccctgtgccaccagaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctggtgagggggagcaaaggggataccctgcagggctgggccaggccccagggagggggatgccctcaccttggaactggggatctagaaagaaggagcagagcaaaggccctgtcttccatccctgctgtttggggacaaagtagggcaggggagaggtggggagaggaatgttgccaggatctcccagagggtaccagtccttgcatgctcccagagacaaagccagccaggctttagctggcaggagctagaacccagctccttctctccctcctccctgacagaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccaggtctgtgttgctgcaaaactggggaagaggtgggcaccaaagctgtttcacttccatctcctccacctgctagtcatattgccagcagggtgaggactgggaaggggaaagacacaccaagccagaggtccccgttcacggctcgcttgagacaagtacatacgcccaggtccgaccctaacaactccgtcataaactatcacagggacacaaaaaggtacaggacactgcccctgtcccaacctacaagcttcctgtggggactgagagagagagagaaagctgttcactgcagtctttttctccctccacgccacctacaggctgcagaataacctgctctaaggacacccagcattcacacttgtgacctgaagtgtggattaaggttttctaaggactttaaaggcccaccgtgatgactcggtttgtgaatggtgcgatccaaacactcaggccttggagtctaatgaggaagtcaagcctagcactgtgccatgcacacggtacccaccacaggcaaagctaccacatcagactaaaaccatacctctgggtagggtgtggccttttccatggggtggaggggtgcttagggagtgaagagggttaggtagatctggtcaatgttttgctttgtgttgagtgaggcccctctgctaccaattgttccccacttcccaaaaacacgatgtgaaggtttaaacaaaacacctcaccccttccccacgcccaaacccaaaaactatgtagcaacacactcctcgaccacccaaaccccagcaggagccgggcattgtggaagcagcgagtctcagcctccctggagccctcatttgaagcccagagcacctctccccatctaaaatgacacatactttttttttcaagagtactgccttttgttctagcatctttccacaagaattttatgatcctctctgcccccacccccacagttccacaggggcaccctttgtccagaagggcgagggtcccagcattagggagagtctggacacagccctcagcctcctcctctctccgatttcctcctcccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtaggtaagtgcagaattctgatggaggagtcaggctggcccactgcccacagagacgcctgaactcaggaaggctggaagagccactgctgcctcctagtggggctgtctgcatcaggctggaagggaagaaagcgccaaaggaaggtttaattatgtgctttagaaagccccttccgtgcaggttcccagacaaaagacaaggacaagagagcacggtcttgggcatggtatgagcttgctgccccctgctttgtccttgagttgcttggttttgggaagtgacttcagcctctggctgtcacacttagggtttcactctagggcagtggccagggcttactaaccagagaggtggaggcagccagcagaggcacctgggctccctacagcactctcctttgtttcctcttagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaagattgcttaaatgctccttctctttatatatttatctgactataatttacaactaaagccaggtgctaattatgtcaaaattccttaatgcaaatttgtcaggcagccctgtggcatttttatgaagagtggaaaatacggattttaaaagaacgatcataaacatcaatgctagataggaagaaaaatagaagagattccttcctttcagacaaaacatgcagtgaacagtgttaggccctgcccaaagccagctgcacaacattagcttgggtccagatttcaagggagagctgtaccaccacgatcagtgctgcccacttccctataccaggttgatcctgccaaatgccacccctgcactctaatgctttataacaaacgacaaaacaacagagctcgattctcagaagtt

SEQ ID NO: 11810 - DNA, 21688 bp, Human
tgaaactcatacttgagatgagtttttaacgaggtgcctctcagatccctccctcacaccctcaattggcatccaggctgccaaagccccctgcacacatatctgtgtaacagatcgtctccccaccctgacgccttccaccccatggtgctgttacttatggaattcagaaggcagctactgctttgttttctgtcttcctgataactctaggaaccttgaagagtacctgctacttacacatcatcttgttcttaaatcaaatttggaccataattgttatcatacaattttaactgctaaggtcacctagttctacagttcaaattaaacattagctcatattgcctctaggtttaaaactaatgtacccagaagaaatttactaagggccagcaatgttgaaatagcttaagtgcaaacagaggagtcctgtgtgctggcaatgacaaggcgatgttgtctaaagtccctatttgattcctcgtttgtccatcccttcccagtggccttttcctctctgaactttcaacagtcttgtgcctaagcacttcagttcactccttgttaaatgccgttgattggctatgcatatgtaacatcccttactttattccagaagaggtcaccttaatactgctttaattccctgaagggatgatgtttggtcatcagttagcaaaactcaagctttggagcaccagaatgtgtgccagaaaaaatttttccaaatgcttgataataaactcagaggggggtttggtcaccagaattgttaggtgaggctattgcttcctaacttttgcttcccacagtccaagctttgatgcacaaggttatggttgattactttttattgcattctagtgggaactggtttctccacccatcctcattttctgtggtctcaattccccattgttccttgggtctgaggatgcagctggatctgagagtgtgagacgctgtcatttagtacatgaactaaagatataatcctgtttactactttttttggtcaaagcaaaaaataatgcaagagttatgtgaacacgatgtttattacatgtatagaactgaatatgtagatgtttataatccggaagctttgggaaactggactttgataatttccctgtaatgaatccatttctcaaaagcatttttttctaaaaaaaacacacacacacacacacacacacattgttctctgtaacctccccagatagatactttttaaagatcttgcttgttaaaatgcctgccagccttttagagaagttgacaggttaggtggtttctgttagcagaaacacgtggactcaaagcttttcctctaaaatgaatctgttgtgtaacatcacagctggctcagaatacaggtgcgtgctcctgctctccctgagaagatagaatgggaagagaccaatccagatgagacgcaggggaggaggggacacccaacagcaaaggcactgttgcaatcttagcctaaaccatatctctgagaaagagtttcttgttgcctgcttgtatctctgggtgatcacagacccctgctctccaaggtgggttgtgaactctggagcactaccaagattggctaagagctgaaggagagtcccaaaggagcttcaattctgcagaactatacagccttctttaccttaccttgaccaggtgcttagagtttggaaagtcagggataagaattgaaattcctccaggtaagaagacccccctcttaggaaatggactcctccaattttctcacatgatttttcaggcactttcgcttttccatatataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccgggtaagtaggctgtcttggactgactggaaaacgatcattccaagcctatactgagggagtcacttacaaatggttttaatttgacacataataattgtgcatatttatggggtaccgtgtgttgttttgatccatgagtataacatttaatgatcaaattaggataatgggcatacccattgccacagacattgactacttctttgtggtgaaaacattcaaaattccctcttctagcccttcagtcaccctactgcgcaatggaatgccagagctcattcctcctatctgactgtaacttcgtacctgtaggagtcacttttaccagagctcttcagagcaatgtgtgtgagttaccagaagggatctctagagaaacagcatggagtagtttcataaaacagtccctcctgatgaagccgtgctgtggcccaccaccagcacgccagcacagtgggtccaagacagggagtagcagctggctggctaagagtatgacacatgcaaaatatatgatcaggtcttaactttttatatgtattttttttttaggaaagctttaatctattatccatggccaatttaagtcaacagggaatgttcctgaaacaagaccatgggtgactaaattttgcatgtgaagcatgtgcaacttaggcatgaaagcctgcaccctggtcactgctggggtagacctctaggtgctggggactcagtaacgttctctaagagcagaatagaagaccttctaaacaggaagaaaatttaggcattgattttggtccctgaaaagtaggtagactgtgatgtgcggaagtgagagaagcttccttgatgacggtgagaactaggaccaggacattcagagcctcaagtgtaggacagtggttctcaaacttcagggagcttcagaatcccccagagggcttgtcaagacaacagagggctgggccccaccctccagagtttctgattcagtaggtcttgggagaggctcgagaatttgcatttttgacaagttcccaggagatgctgatgctctggggtgagaaccactgctcttggagacccctgggggatagatgtacagacttctatagttaagtccctcttcaaaattcattcgagtgtttgctaacttattgccaagtctgcctttttccatcttccttgctcttgttcttcctcaaagatatttatctttcctaccttgtaacttggctttggacacctcagtgcactactccttccatatactttagccagtggtttttgactggtggcagttttgccccacaacccccaagagcattttgtactgtctggagacatttgcagttatcacaactataggaggtgggggtaaggtgctactgccatgtattgagtagaggtcaggcacactgctaagcatcctacagtgcacaggacagcctctcaagaattatctggcccaaaatgttaatagtgcagctgttgaaaaaccttgaattgaattgagttttttatgtgacttagctcagttcaatgtaaatagcctctttcattgtgcataactgtataaagtatctaggtttactgtattttcaatctcagatacattgctgatttctgacacattctgatcagctccatggctatgagcctcatgtataggttaggagaaagattcactccacccggaggaagtgggttttttggcatgcagcggctagtggtcccaagaatggtccattgtgcgcagcagcaatgtgctcagaggactgagaatgaacgtgccagccaatcaattgattgttttgtatacttaatgacagccaatcaatttgtctaatcgtcccttgtacttgccattgtaattgtccaggtaagtcagtttccatggaggctaggtgactttctgcttgtcattccattgctgaattcctctctgctagaaagataaaggttttcttctctggttttccaaaaaaacaactattggctatcttaagcctactaagtgatattgataaaaattttgaaagccaaaacaaaaacaaaaacaattcagaaacaacctccttgggcattgtcttgtgtgtggtgctatctggaagcccctgctggactccagctttgttccttctcctgttggatttccctaggcagagtgggagcctgtgagctgtgtctgcacaggcagagacattcacaatcaatgatcagtcagcaagcttctaggaactctgatgggtaagcctaaggtggccagcatgtatttattttaggatattttatcagcgagaggccttcagtggtagaagtgtgtagaggctaagggctcagacaaacctaaaggtactaccagggtctgccactggcaggaggctagattaaacaaacaaacaaacaaacaaaacacaacctcaaacatatgtttagcagtagtttctaaaggaaagattaaggaattaatgaatatctttaattacagaatttaacatctgcttttgagagccaaactgcttgattctggatctggattcttaacaaaaacatattactctattaagagcagactgtgggtatttttaacactgaatgagctataatatatgtagatagagatcacttttatttcttaatttgtagatattgacagtttgcataaccccaaagcaagagtagattttcctacaagcaccatttagtgctttacattttagaccctgcagagtctttaaggcaaatagtggaagaataaaatcaaattccagctcatgttgaacccttgtcagtcctacagtaattgaagaggtcaagcccagctctaaggacacctggctttcgggaggctgagtgaccatgtgggagatctgagagctgcttatggaagtattctgcaaaacaacaatgatgtataggggttatcttgtagaattcttatgggtggagtcatgtacttgggtgtggtgttttatatacggtgcattgcatcttgtggaacctgccatgcaatgcagctgtttgagccgtctgattttacctcttggcaaagaggtaaaattgacttcttaactatttttaagttcattttcaggacttttgtagatgttagaattaaagggaacatgatgaggaatgagagattttttatttagaagaatgcgtgtgtgtttgtttatgtgtgagttgcgttagactcctagaagagctgattttgaccgggcgcagtggctaacacctgtaatcccagcactttcagaggctgaggtgggcggatcacttgagaccaggagttcaagaccagcctggccaacatggtgaaacgccatctctactgaaaatacaaaacaaattagccaggcgtggtagcacaagcctgtaatcctagctacctgggaggctgaggtgggaggattgcttgaacccgggaggtggagattgcagtgaaccgagatcacaccactgcactccagcctgggtgatagactgacactccatctcaaaaaaaaaaaaaaggtatttcttttttagggcattctatgactttatataatacgtgtcatccaaaattaggcaggaatggaaataaataaaaatttcaaagtatttctaatttcttatacttaaaaaaagtgttttccctctggtagataagttgatatgtaaactgaaaagtcgatatctaattattttaagatttcaatttgttatcccgaatatttttgtgattctgacccatatttgctcttgtccagataagatctgtgaccagatcagtgatgcagtgctggatgcccatctcaagcaagaccccaatgccaaggtggcctgtggtaagaaacacccgatccctccctgctggagacctaagtgggctagactgagaaattaatcatgggtataagacaaacgagccatactcctcagttccaaaatccatgtcctctgctctgcagtagatttctcaattatgagacctcccctgtgtagtaacagggaggaaaaacatttctaaccatgaaacaaatagataattatttttagcaagaatctaacgttaaatgtcatagcaaccataaatagcagagggttggaccagcacatggcctttctgatgcttgatctcattgggaacaaggaggtctttcaaagttcttaggtgaatcttccagacgggatgaaagagcttgaaacacaggtagctgcctagatggttataagctgcatcctcattgtaggagcctttgttggctgcacagatacctggcttcttctcttgttttctttcctagtttgtggtatgatttaggttttaaaataattagtgtcccccatttaatagcaacaggaaggcaacatcttcaccaattgtttttcaataaatcaatggctttcctaagagacattaatgttaaactaaagtactgaagccctggctcccatctgcataatttattgtgtctgaagactcatgtaggctgaagatcttcacctttatttgtgggataagttgtttggcaggaaaacctttgcctggcttgaagcctgtggcacagtggcagagtcatggactctggagtctggaggggccccagggtgatcaggtccagcctgttcattttagagacaggatcacggtaccctctgcatcagggcctggccaaggccatggggtagggtgccccagtgtgaagaccagagccttgctctccttactgtcattgtcatgtcttgtccactgcacagacccatccttccctctctggttgcatcctcagccctgtattgaatactacagggactcatgcccctctgaaggtagattctacccttatatctttgtaaatatctggagagaaggttggcctgctttgattttttttggtccagatcccactccctaaagcctgcagtggaggtttagcaatgtgggggatggggggtcacatgtgtggactaccttctttatgacagctacatacaaccatcatctccctttaatccacatagcagtcttataaatagctttattaaatagatgagggaacagagacttagaggggttaaataagttgtccaggatcacagcttatgactgactctttccaagacagcattggaagatgctcagtgcttggtgctgggattttttctttttattggcgtttctattttccttctggaatccattcctcgtaaggcccctcctgtgtcttttctgtctgcactgtgagaggtctgggaatgtgagcttccctttgctggcacttggctgctaactctcctcgctccccgctccctttcagagacagtgtgcaagaccggcatggtgctgctgtgtggtgagatcacctcaatggccatggtggactaccagcgggtggtgagggacaccatcaagcacatcggctacgatgactcagccaagggtgagggcaggcctccgggtctgaaatccctgttgctctctgctgatagagaccccagtgctgagtcaaacccgtgcctttcagcccgatgggagtatcaatactaccaggaggaaaacactcctacacttgtctgtcaggttccaggggtcaaagactctggcataaggatggccaacaggcgactatgcccagtgggcccagcacatgcccatctgttgttgattgggcttgttttaggccttgccttcttggcgctgccaaaggctttggaagagaaagatgcactgaataaagggggctgccctcctttggggacatgctcgctgccaggcactggtgatagtctcttgtgttgtcttaatcatttatgtacttatgcagacgaggaaatggaggcctagaggggtaaacagtctgtgtgagatcacagggtaagcagccactaggctgaggactcctgtgcttccactaaacctacttgcaatcatagacatggagcaagatgactcagtccagaactggtgctgacagcaggcgaggctggtccaggttagcaccagtgctacatagtgtggggccaccacccagggaaggggcacaggccctagcagaactttgaagcagattccaacatctgagactgagcaggccaggcagcggcacagcctggagggcagcaaaggacccagagagcagacaccaggtgcggagggcctgtatgcgatcacattctgcaggagcttcaggggccctttgtccatgctggcttcctgggcagggctctggccccaattcttagagtctccacgttggtctctggcattagatgttcaggcaattctaatttttaaagaaaaattcattttgggtctctgttagctctttccctaattctctgaaatcactgtgagagatgtgatgacctcacgccatggcaaaaagacccacttccaggtcatcctgcctagctatacacctgtaatcaagatgcacagagagaagcatgactttaaaggtgttcatttctgcctgtgtcacataatcgttgtctagggtgatgtgtagcatcctgtgggtcagggtgctggacccccgtttgtaagtgagagagcccactcatggtatgatggtgcagactcgcagaggttcagtccagccatggcctggtgcagcccaaagcactcatgagcaattaatattggttgagtgcatgacagtgattttgagactcagtgggaagagaagcagtaagaaccagttaattctcctggtcgggacatgagggtattcacagaggaaacacattgtcccagagctgcagcttcctgaggcgttaccacacggagcctgttctaccaaaaaaaaagccaatttgtttatgtacatttagaccttattcaagtgcaaaactttttctgcattaggcaggagggaaattttccaggaggcaatgttccctagaaagggagaaatgagcgagagcccagccgtggctgagttgagctcagctggctgaggttccctgtgcccaagcttgtccatttacctgtgctcagtggacaggaacagccttagcagggtctcaggccagtggctcctcgttgctcctggctgcggtgttgctgggctcattgtcctttccaagtcctgtacctcccctcttggtcccctaagttctgtttttccaaattccttggagcccttgcttgatttttgagccctggggagattcattatttagacagacagtgattaggtaaactgaaatgttcagtgcagaacaggacagcttttggcagttctttaaagactgttcattgatttgtgcattcaaaaacattcattaggaaacaggagggtgtaaagggcaaaggtgacctgatactcccagggtatatgatgcaacatgaggtgccccggggtaagttcctggcattgtgtctaatgaactgcaggcaggtccagggacatgcactgagagtggacgtggggtttgggcatgtggggtgggagctggaggtagaacgttctaggcagggacctagtggagatggaaaagtatatcatgctgatggctaaacttgagttcatgttggctcaaggagtcccaggagcaagggctgtgtcagactgaaaagcttcagttttattccttggcagtagatccccacctgaagcttgtacagaaacagcagcttggatctgtgtgttttctctgtaagccctttcaggctgtgtgggtaggagaatagatgggaaagaagatggctgtgggggtttggagagtgagtgtgtcactatgcttgaccttgtggtgggggcgtccatgtattcagtcccttattctcacagtccctgtgactgagcccagcacagctgtgaggaggtgcgcacggtctcggtgcatagcagtttcctcatgggactcccagggctgagctactgctagtccagacttccccaaaccagtgcctcgcgtgctaggtgtagcaggcctgcaccctgtgcctcagctttgtagatgggaaagggcaggtggcttttccatttgccccagactctgtgtacctctcagggtcagaggaccctggcttggggagtctgtctggatagttcatgtacactgtatttgttcagtatgtttaatagttgtgtcaggcatacagctgggcttctgagtgacagtatcaaaagggctcttgattttctcctagtgcagtgatgctcaaactagattctgggaggcacctgtgggagagcctgaggggcagggtatgagtcagccaccgtcctcagccagaggagccttggcatcaccttgttttaatctgcaggtctctgtaggatgtgtgtgtgtgtgttaaccaaggtctaattgagcacagtaaaatgcaccacggagaattttggttggccaaagagttctacatgatagggtgggaaggtgcggggcctctcccatcctgggcctcagctgtgggcctagacagaccctggctagttagggaacccccacgctgacaccaaatggcatgtcaggaaccgagccatccattgggaagtttgtggccccctccttctgacctgttccccacttaggctcactttgcttccgcctaggctttgacttcaagacttgcaacgtgctggtggctttggagcagcaatccccagatattgcccagtgcgtccatctggacagaaatgaggaggatgtgggggcaggagatcaggtagctcggcactgcatgtgggagctgtgtgttgagctggctgggaaagttcatgagcagtgggttaatcacactgaggggtggattcttgtcctagcacgatagccaggagcgagttgggaaccccagcttcacggccgtgctgtggatggctgtggttgctgacactgggtttgggcttgtctccccctcctagagtgttgggggtcagggatgacgtccttcccctgcacatgccagtggaaagctccatggaggaggcacccaatcaacgtggacacaccagggagatttcaggcttggagagagctgcggtcctcttggtctagggtgggcgccgctcagcctgctctctcgccacagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgagcagctgaattaccccaggagagccctagacagaagctttaatacccccaaatcctcttgattcttgattgtgtcatttttaagatcgaaatattcaatctgggcattcaaagaatggtcagttttgaaaagaactatttatgtgaaaaatcttcagctagagatgcttcccacaacattttattataaaaaatttcaaaaatacagagaaatgaaaagaatagttccgttttttttgtttgctcattagtaaacattgactaatgagtccccaaatcctgccacaaacatacttaactggcttccatattttcaggcctctttgtcctgaacaggctgtctgtgctgtgtctgtgctgtgtctgtgttgtctgtctgtgctgtgtctgcgctgtctgtgctgtgtctgtgtctgtctgtctgtgctgtctgtctgtgctgtctgtctcatcatgaccctttttctcatctttgtttctcatgaaaaggctttacgtctgttgtttccagctccaaacccatgggccctgacctgtcttctccctgcagtgttgaaatcaacccaaggcctatatttgaaggctgaggtgattcaagtgttagtggagacgcaggcctcctggcacctcacccctgtatcccctccctgcttaaccccaatgagccctctcatgattcccaagttcccagcacttcatactgcacaacttctctccctgtgtccatgctcgtggaccccattgtcaccttcacatactcccacctgtgggtttctctgatcaccctccaagcagatgggccctgagagcctgccgtgtgcagcaccctgccacctccctcctgcccttcccccgtcctgttcagcgccatctctctccacctacccatgtccccagtttaccccatcaagcacccctctcgctccagctcagccttccccagggctgccatcatcccagccaggccaggatcagtggcctatccttccaaaggtactccctgcttggaaattccagctaatcccctttaggcctcatttttaattccctaacatctattcagtgttttctacaactttgggcttcctacaaggggaagggggaaatccacttattattctggcattcacaaccttttatggtcttccaactttacctgcctctgcctgccccacaccatctttgcttaatcgacatcatttcactcattgtccccttgtttcttagggctttgctttacctgagctccctctctggtcttcacctctccttcagtggccagcaaagttctacctcttttgggatgccatccctggccactagcagacagcgccagcgccttctcttgtcctgcacttggaatctggcacccatggtgttatagctcagcgtgctgtgtgtggctccatgtacaactccagttgtacagagatggagttccttcttgtgcaagtgtcagaccatgcacagggcagaggttgcatactggctgtactggggcagggaagtgtgcttatgcccaaagggaacccttccttgggacttcctgtgttatccacatgaccccccaaggtggggatgggaaccatcagcattccttgggtgttcttggaggttgtgagttaggagagctaaaacatgtagatcgtgatggcacccaaagaaaggggcccatgatgtcggcctgcctgtcctgtcctggactggaatggtgctgcgatatagaagcagggtgaagattcacagaaggggaaatcttagaacagggaggggaggtagccagtggctctgactgttttttctcttccttgtgcaagagagaggaacagagggaccacctactggacctgctgaaacaggttcattgtgcttagatatgaaatagaaggtttctaggtttaggggtcagcaaggaagggagggtgggatgggctcttttaggggttcccttcctttgaaggattgtctcgaaaatgccaatacagataccagagtcagcctcacttccctgccacaggcaggaccgcgggccagctccagtctcagggggtgcagacttgctgtggggctccaggaggcccctcgccagctggcctgcgaacagcctggcttgctctagacactccctccatgagagaggccctgggccaggcacagcttgtctaggtcccctgctccgcaccctgtttttgaagtagtgtcttcatccagctggactgctggctgtgagcaggatgggtctttccacctgaacaaatccctgctgctgatagtgaggcctgggtggcagtgtggatggctatttttgtacctagtcagagctgtgttttccatggtgtgtttttccccacatcttgctgacatgatgagataagcgccgtgttcagggccctttgctctgctgccctattctgcagttctgcaaggccactgcgtggagtctgccgggtgggggtggagtcacccaggggagcagtggagacggcctgagcaccctccccagctgtgcaccttctcccgaggctccatgcagactagacccagtcctagagtctgccacagacagtgcctcttttcctgggagtcccctaccccagattccagcccctttcccagggccgtgtgtgtgcacagcctggcatttgaggacttctctcagctcacgatgtctgtgtgcatcgggccatctcatgcagatcttacatggccaggactctttctcctgcttcttctggaccttccttgttgctccttagaccaggcagaacacagagtaggagtttgatacagatccagggtttgatggatacctgagtagccttggggaggtagagagtttgctgcaggcacagtcccagggagccactgtttgctgccccgtggttctgtccaggccctgggatgggagcagtcccatactcactggccagtgtccctcccagggccatctggcagagctgcacccctgcgggcaccacatgtccctaaaatcctctgagccctgctcttgtgggtccatgctgctttcggcagtattgggcctgtggccagcacagggtcttgagtggcatccaaccttcttcttggaagagccctgtctaccagcccatgcagctccaggtcagatcccagctcttccgactgtgtgatcttgaccaagacatttacattttggatccttggctttcttatctgcatcattggcaggaggagagatacctcctgggctatagagggtcaagaaagggctttggccagggggacatttgctggcacctggaagcctctgagacagaagaggagacatgtagtgggtcagaagttgagaggaaactcaagtctccaagcagtgctaattgtggccccatgtgggaatagctgggccttacacccagtcctcccacagcaccaggcaattttttgaacgtaagaatgtgtcagattaactcccccaacaccctttgaagacaggaggccccacttggctcctgggagccctgcccacctcctgggtgcctgtgtctggccacgatgtgccgttcgctcagcctcagcctcacagtatctcccccacccttctgatggacaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccaggtgcattcttgtctctgaacgaagccctggtttgtctttgttactggggttgcttatgtctcagagcaggaaaacctcaagagatagcttggagggggtcagctgactctggccatggactaaatgtaaagtcggtgaattttggcctctgtacatttagtgcactctctggggaggtctgctatgtgtctgacagtgtgcaagaaatgggggatatgtccctaggattcctccacttagcgccactgggccctcccactcctgccatctcaagtgaccatcgaccttacccacggctgctgcacctcaccctgctctggtgcacattccccactgcagcatttgcacgtggacagctgttcccgggtggctgtttccagatcttcaccacaggctgcctctggctgttgtgggcaccagagtgggacagggtgttttagacagggcaccactgccccctctcttgtactgcaagtgtgaggaggtggaggttgagggcactgctgtgaggctgctgcccactgcctgggccctcagccgtgtgtgctttgccagagttgagctccatcccgggttccagtagcaagtagagtgtagaaacacagagtagaaggaggtaacacttattgttttttcttgcaggacttctcaaagcctagacatactagtatgaactgtggatctctaaaagggggagtagagcaggcagacttccccaaatcatttaacatagaactcccacccttttaaagacatcactattgactggtgttgcccagaggacacttgggaagtgggcagcatggcatttgctaggtggcaccagccagggttgtatttatgacagtgcagttcctgcctgcagttggatctctccattgtgatggactcagtaacaaaggcattagggagtggctgtgaccccagagaacccctggcccaccttctgcacttgctaatgaagctttggcaggttacctgttttcaatatgttgtcagtgactgagctgggagtggagtccagagttctgggctaaggggtcttaggaaaatgtctgtgggcagccccaggacatccttcctgagttgcagttcagctgccatcacagtacttcagccccctccagcatctaggggctggctctgcttcttatcttgatttctctccctctgcagggggatgcgggtgtcactggccgtaagattattgtggacacctatggcggctggggggctcatggtggtggggccttctctgggaaggactacaccaaggtggaccgctcagctgcatatgctgcccgctgggtggccaagtctctggtgaaagcagggctctgccggagagtgcttgtccaggtaagccccctccacccaccaccgtcctgttgcagtggaggacccctgcccagttctgccctgagtgaggggatgttggcccggtgggaaagctgcacgctttgccaaaggttgtgattgtgtgattgtgttgggcactgtggccagggctctgaaaacctaggggagggaaaaccagaatcttcagggagagaggcgtgtagaagaactgccctcggtgaagatagcaggaaaattgcaggggagcatgtggggcaagaggcatgtggtccccgctggtcccttcagaagaagggcaaagcttctgaaaggggcagggcccacacagaggcttcaatccctgacgctgcaccttgctggaaggtttcctatgccattggtgtggccgagccgctgtccatttccatcttcacctacggaacctctcagaagacagagcgagagctgctggatgtggtgcataagaacttcgacctccggccgggcgtcattgtcaggtaaagtgccatgtgctgctattacacaggaccttgctccttccttgcccagatgctcacctcacctgaaagggaggcagaaaggaggatgtttctgcctctcagaagtgggagggtctgtgagctcttggtacagcacagtgcatccccagtgcagaaagcctggttgtcaggttaaaggaggctgccccaggttcctgctggcccagtcaacaccaactccagtggggccatctctgagcaactgggaggcaggcggggatcttaggaaaataattattaatataaggccaaatagctcaaatggctgggaatcaagtcagcaagtctattccgtttctagagcttagtggtgtcaacattggcctgggccaggtaagtggagtgggaggagaaaagcaccggaaggctggagttagatcctggtccctgaacctctaagcatccgtggggctataaaacgagaccagggtatggcacagataggatgggtgcgcgcaactgcggtggggaggcgtagtgccatgcgaggagggctgtgttacagttcgttgctccctcctgtccttgaaatggagaaagaaaccctgctcctgttccatcttccaatgcccttcctttctgctggacatgcagggatttggacttgaagaagcccatctaccagaagacagcatgctatggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgttggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaactaccctatgcttagttattctctgcaaaaccccagagacatgacacctgctctgtatagcattccctggttgcccacccccaccaccgggggaagttagtatcctcccctcggggtcaccccatcctgtccacgtggagcagatgtctcatggactaggtttttcttgttactagcagctatgttaagccacaccactgccatgttcattcctcaccacatctcaccaaggtggatattcttaggaagcccatttttacatgcggggccctgaggccccaaaaagggttaggaccaaaggcagtggccacctctggctcctccctgagttctgtgtgctctccttacgcattgctgcccttaggctgcctatgccttatcctgtgcccttcctgcatggtgtctgcatgagactggcgtgagggcatgctcaggccatgtctggagtatggataagtgactgaatttgaacaaagtgaaggagtggaggggattggtctgtggagagaggagccgaacttttaagtggatgcacatttcccttcactcgtgttcagttgtgaagagaataagcaaatggttctttttcattgaaggtcatccctgccatggcccccggtgatgtggttcttggggtttgatcagagcaggaggaagatgggtcctgcatggtttccggcaagcaggctgtgtggacaggactcagctctggggaatgtcctggtgcagcctgaggcaaagcctgtgtggcccccgtgtctcacgggcagacaaagctgatctggggtgccaggaagacccagaatgtggcggggaggggaggggaggatgaggccaaagggcctcacagtcctgtttgagacagaacctataccctgagaagacactaggtgggcaatacaatgaaacatgacacattatagagaaaagcacgtttctcaagaatgcatacaaatagacacacttaagaaacacactggaatacttgcctggggtagggggaggactctaggtataacatgcaaaataattagtgaaagcaagatagagaaccaccttctgagccacaaagccaagtgtcacagtgttagggaaatgtggacggagcaaaggaggttggcagggagcggccagtggagtttgaggaaactcaggagcacagagtccctggaagtcaggtgaagactgtttctagagcaggggagccaccaactatgcaaaatggttttgatgggttacatgatgggaggcccaggactgtccagtgaattcagccacatggaggttgatgatgtgggaaatggcagagtcacatttaaacgtaaatatgaccccaaccctcacctcaatcatcctcccctgggccatctcatgacattcagagtgcgtgctgggctgcactgccctgcatgtctgtgcagtgcctgccccctaccctcatcctggactctgctccccactccccacattccggactccttggctctttggcttcccccagcaggccaagctcgttcctgctcagggtctttgcacctgtcgttctgtcatgggtgtggggtgcgctgcaggtttcagatgaaatttctgtatttccaaaaaaccccttccttgatagcctctctttctactccattccatttctagtttctttttcagtgtttaacatgatgttccttggagcctttcacttgaatccttccctacccattcactctcccttccttcttcacatgcgggtcctccaaatccctgcagtctcagctgacaagccaccctccatgatgctcccaatctcccaggaagatgctcccaagcaccttccataaatcacacccaatgctgtctccatctggtaccgggctctcaaaggttgtagttctttaaataactaaatattttcattaattattaataataatgttatggcaataattctattgctcacactctgaagatgatgtatcaacccaaataagaaagcttttttccccagcttcat
